United States Patent 10,233,495 (METHODS AND COMPOSITIONS FOR SCREENING AND TREATING DEVELOPMENTAL DISORDERS) - sequence listing, part 145

SEQ ID NO: 744 - DNA, 1841619 bp, Homo sapiens
cttagagtgaacaattcaaggttctaaataacttagaaaagattcccctgcaggcacgatgcaagacaaattcacttactatttattgctgggtcattggtagcccttcatccctcgctaagcagaacctcagggggctgtacctgggaggcatgtatagatgtcccggtaagaatgaacacagaagatgagagaatgacagcgggagaggaagggagggatgcagagggaaacgcaaacatccagactaaaaagcacctttagccttcacctcctgccactgccctctgatcccaagcagggcttggaatccagagaggggctgcctccctcaagtcattccccctttcctttattcctgtgaccaattacagatcagtgaagcttaagttttttgcattcacctttttttttttttttttgaaataaagttttgctcttgttgcccaggctggagggcaatggtgcgatcttggctcactgcaaccaataaggtggacctcccggattgaagtgattctcctgcctcagcctcctaagtagctgggattacaggcatgcaccaccacgcccggctaatttttgtatttttagtagagacagggtttctccatgttggtcaggctggtctcgaactcctgacctcaggtgatccacccacctccgcctcccaaagtgctgggattataggcatgagccaccacgcccggccagcagattcacctttcaatctcccttcccatttccctcctaatcccaaacacccacatgtcagtctgagtgcttggttgtaacagatggtctcccttttcccctccagtttatcctgtacgcagctgtcagacaattttttctgtgtgtcactttctgctcaaggaacttgctggggaatctccattatcactggtcccacagtccacgtctctgtctggctttcagggcccttcataatttcactccattctctcaaccaggtttatttctcatcagtactcacactcacactccttcttgccacactcatgactttgttgatgctgtgcccttacccggaactgttctcctcccaccacgcagccaaaccaaattcaacccatcccacacacccacctgaagatggttttcccctggctgagctgagctgacctggcactattctcaatgcccagtgcatggacattaccacatagcctggtactgaagcattttccaactatttcatgcttagtaattatctctccatggactctaaatgccttgaggataggaatcatcttctattctcctatatatctccctgggcctagactaacgctgagcaatagaaatcatgttatcactcaagttataatgagaagaggaaactttttattttgttagatctctctggggaagtgctatatgtgcttggaagaaacatgctgacaagcttactgaggataagaaggaggcctcccagggcattctcaagcaacgaaagacgtttgctgaattattcgccagaagatcaggagagtactttatggagcttgtgagaaaaaggaaaagcaaaaagagaataagaaatgagacagggatgctgtacattgtattaaaatgagatgcctgtacccccaaaccctgagtaaaattctattaaaactcaaaaaacagctgtctaggtggatttctggtggaaaccagtgaaggggccaagatttctatggagggtaatgtgaggttttgagatagatgcaaacaggagccagatggacacggaggccttgactagcatttggattatattccaatatatgattgatcaattggccagtatggagaattatcatggaaatgcgtgtggtggctcactgaccccagatgtatatttctcctgcctcttccatctcactactatctatttgaggaagtattaaagtgaaggccacatcagactctgtaggataacaggtagccacaaagtctttattcataaaatccacttcaggctgggtgtggtggctcatgcttgtaatcccagcactctgggaggcagaagctggcaaatcatgaggtcaggagttcgagaccagcttggccaacatagtaaaacctagtctctactgaaaatacaaaaattagccaggtgtggtagcatgcgcctgtagtcctagctactcaggaggctgaggcaggaaaatcgcttgaactcaggaggtgaaggttgcagtgagccgagaccacgccattgagctccagcctgggtgacagagtgagactccatctcaaaaaaactaaaactaaaaataaataaaataaaatccacttccaaaacattctttttaaactgtgagtgtgtttggttcttagctcacctcaaggttaggtaagttacccactcagtgagcatacatctggcgattagcttgggtttcggtggttgcttcaggtatactcagggtgtaggtggaatttggcactcgctggttgagtcatttataattgtccaaatttgaggaggtatgaattatgccatctcagctagattaaaaatggaatgcacggtcttctagatgctttgatttcatcaatattataatcctggagaaaataaacatttcatttataagacatgacagatgcttggtaagtactccagatactgtaggtgctcagttcaagtctgttaataaatgcagactttgttcattacattaagtaaaaatgtaaaagcaagcagggtatgtattagtgttctccagagaaacagaactaatagggaatggatataggtatagatgtttcagtccatttttttgttgcttagaacagaatacctaaaactgggtaatttatttttttatttgtatttatttatttttgagacaaagttttgctcttgtcgcccaggctggagtgcagtggtgcgatctcggctcactgcaacctccgcctcctgggttcaagcaattctcctgcctcagcctcccaagtagctgggactacaggcacccaccaccacgcctggctaatccattcatgaaggcagagttctcatgacccaatcacctcttaaagtccccacttctcaatactgccacattgggggttaaatttcaatgtaagtttcagaaggggacaaatattcaaaccatagtaatagatgtataaagagattttttataaggaattggctcacacaattatggaggtcaagaagtcccaagatctgcagctggcaagctggagactcaggagagttgttagtgaagttttttgtttttggtttttggggggtttttttgagacagagtctcgctctgtcgcccaggctggagtgcagtggcatgatctcagctcaccgcaacctccgcctcctgaggctgagattctcctgcctcagcctcccaagtagctgggactacaggcatatgccaccacacccggctaatttttgtatttttagtagagatggggtttcaccatgttggccaggctggtcttgaactcatgaactcaggtgatccacccgcctcagcctctcaaagtgctgagattacaggcatgagccaccatacccagccaatgatgaagatttgatccaatgtttggtaggctcaagacccaggaagagctgatgttttagtctgagtccaaaggcaggacaaacagtcaatcaggcaggaggaattttttgactcttgggaggagtagccttttgttatatttaggccttcagctgattggatgaggcccaccaacattgggaagggcaatctgctttattcagtccaccaattcaaatgtcaatcacatccacaaacacccttacagacacacggaataaggtttaaccaaatgtctgggctccctgtggcccagtcaaattgacacataaaattaaccatcacaaggtacaacattgaattccaattatataaaatataaactcaggcaaaattaatatattctgtaacaaagtcaggagagtgtctgctctggagagaaagagaaggggcttgaatggcttctggttattggtaatgtcttatttcctgatttgatgttggttatacaggtatgttcaccttgtgaaaatttatggagctatccactagggatttatgcccttttctcaatgtatactatgcttcaattcaacattatttatttgtttgtttgtttgtttattgagacagagtcttgctctgtcacccaggctggagtgcagtggtgcgatctcggctcactgcaacctccacctcctgagttcaagtgactctcctgcctcagcctcccaagtatctgggattacaggtgtgtactacaatgcctggctaatttttgtaattttagtagagatgggtgttaggaacaggcccccaaatctggccataaactggccccaaaactgggcataaacaaaatctctgcagcactgtgacatattcttgatggccatgacgcccatgctgaaggttatgggtttaccggaatgagggcaaggaacacccggcccacccagggcagaaaaccgcttaaaggccttcttaagccacaaacaatagcatgagtgatctgtgccttaaggacatgctcctgctgcagataactagccagacccatcccttcgtttcagcccatccctttgtttccattaaggaatacttttagttaatctataatctatagaaacaatgcttatcactggcttgctgtcaataaatatgtgggtaaatctctgtttggggctctcagctctggaggctgtgagacccctgatttcccactccacaccctatatttctgtgtgtgtgtctttaattcctctagtgccactgggttagggtatccacaaccaagctggtctcggcagacgggtttctctgtttcccaggctggtctcaaacttgtggcctcaagcaatctgcctgcctcagcctcccaaagtgctgggattacaggcatgagccaccatacccggcaattcaacatattttactggggtgatgggagtgggcatgtggaatgtcttaggagataacactgctataaattccttccaacaagcttacgttttcttggctagaattgttcagcctctcagaatccctggataggaagttggatcatgcagctcctgtctgggttccattaagttaaagctcagttagttcgaggggcatctcttttgcctcaagagaagttcctgaaaggaaggacaacagtgagttctggctatgggacccttattgccaaaagcacaggagcccagtccaatcacagcaggtgccaaacctatcgatctaggaaaagatgacctagccgaggtcacatcatgcaagaaccttgcagccattggttccttccatttttgttgctgtcgtgctttctcagagtctccttctgaacattgttgctttgaaatttctgggcagcaagaaactgatataagacctgattcctctctgattctgtgggaaaaccacagccccaaagggagttttggttgatttttttgaagacatgttgcccaaaggactttttttccttctagttttttcaagtgcatattcgttgagacccaatcctctggcacccattgaagtagagatccaccgattaggttagccaaggcagagaactgatctaaatgatttgggctccaaattaaaattttgatctgaatccagtgccttgttaaaattcttcacattgagcttcgcctttcatttggtagaacgtttatttaggcattgtgtcatatgatgggaaaagattgacatggtttaggattccggctcagccacccacttgctgagtaaccattggtagatgatttaacctctttgaggctgttttctcaaactcagtattgagggatgaattaaaatgtgtatatgaggctgggcatggtagctcatgactgtaatctgcactttggaaggctaaggcgaaaggatttcttgagcccaggatttcaaaaccagcctaggcaacatagtgagacacaatctctacaaaaaattactaataaaaaattagccggggccatgtgtgatggctcacgcctgtaatcccagcactgtgggaggccgaggtgggcagatcatgaagtcaggagtttgagaccagcctggccaatatggtgaaaccccatctctactaaaaaatacaaaaattagcagacatgatggcgcatacctgtaatcccagctacttgggaggctgaggcaggagaatcgctggaacctgagaggtggaggttacagtgagccgagatcgtgccactgcacttcagcctgggcaacagagcgagactttgtctcaaaaaaaaaaaaaaaaaaaaaaaaaaaaattagctgggcgtggtggtgcgcaccagtagtctcagctacttgggagcgtaaggtgggaagattgctttagcccaggaggttgaggtggcagtgagctgggtttgcaccacggcactctagcctgagcgacagagtgagactatgtctcaaaaacataaataaataaataaaaaacatacatgcaaagtgcctaaaccactttagttactcaggtaagtaataaacattcatcatcatcatcatttcaatatcctgtgaagtcagtgtagacctggcctaatgcagtcaaagtggtttaactcaaaaagcacgtaaacgtctttattccacgggaagtgtgtagctttacagcccgcaggagacatttaaatagaatctagacaacgttcagatcatcaacaggttttgaatctcccagattagaatatttgtgattatgtgagcttgacatcaatgaaatggaataaataaaatgttcattgctctgttgcccaggctggagtgcaatggcacaattatagctcactgcagcctcgacctctcagtctcaagtgatcctcctacctcagcctcctgagtatctgggaccacaggcatgcaccaccatgcccagctaatttttgtgtattttgtagagatggggtcttgctctgttgcccaggcttgtctcaaattcctgggctcaagtgatcctcccacctcagcctcccaaagcacaggcataagccaccacacccagccattctaataactttggtgtatctggcttgatgtttatattagatttgattgatctttttgatggacatgagtgggtggtagaaaagagagtatttacttgtgttttgatgaactggtggatttttttaattttgaaaaatataattcacaataacataattcaaaaatatctaataaatgtgttttagaatggctattgatagtgaagaaatcttatgggttagggtgtttcacactgatttatttgtattgctgaccttagaaaaattaatttctgaaccaggagtggtgactcacgcctataatcccagcacttagggagtaccatgcgggtggatcacttgaggctagcctggccaacatggtgaaatgctgtctctactaaaaatacaaaaattagctgggtatggtggcgcgtgcctgtaagttcagctactcgggaggctgaagcaggagaatcgcttgaacctgagaggtggaggttgcagtgagccgagattgcgtgccactgcactccagcctgggcaacagagcaagactccatctcaaaaaaaaaaaagaaaaaaaaaattaatttctggccaggtgcagtggcttacccctgtaatcccagcgcttttggaggctgaggcaagaggattgcttgaagccaagagttcaagaccagcctgggcaacaaagcgacacctctgtctccacaaaaatctaaataaataaataaatcagccagctggggtggtgtgtgcctgcagtcccagctactcaggaggctaaggcaggaggattgcttgagcctgggagtttgaggttacagtgagctacgatcacaacactgcactccagcctaggtgacagagtaagacccagtttcttaaaaaaaaaaataataacagctgggcacggtggctcacacctgtaatcccaacactttgggaggccaaggcaggtggatcacaaggtcaggagttcaagaccggcctggcctacatagtgaaaccctgtctctactaaaaatacaaaaaattagccaagcgtggtggcaggcgcctgtaatcccagctacttgggaggctgagacaggagaatcacttgaacctgggaggtggaggttgcagtgagcagagattgtgccactgcactccagcctgggcaacagagcaagactctgtctcaaataaaataataataataacaaaagaaattaatttccttcacagtagtttaccaagtgtgacagcaaaagtactgaggttaacaagcattttggaaatgtgatttctgaataaagtaatgagtttttttttctttgcaagtggagagaaacttcctctttgtgaaatttcatgtcagataaacccaaggtataagctgaaataaaaacaattatgtaatcgctcttcttcatcttacctcctttttaaggaatataaactattggtaatgtactagtgagaattctaatgtgtgagtcatagcctgtgaatcatggtaacgcatcagaaggctctgattgggagaactgaattatagtcctcttcctgcactaaaataataacctcctcccacaggggctcaaagaaaaacatggttttccagcaatgaactttaacttctcttctttattttttcctggtttgatttttatgggaatctgctctaggatggctggctcctctaagacttacattatttagagtcgtcttccataccgggtgtaattcttgcgctcacggtctctctctctctcgctctcatctttcttgtacttatttgctgttatttctacaaagataagacaataacaggtaacttgtttttacagcgtacagtttacaaagcactttcataaatatctcatttgagcttcttagcagctttatagaaaaacataaattattactcatttctacagatcgggaaacctaggcccaagagaggtaagtgacttcccaaagtacagtgcctcttgatatcaagtcaagtaaatcaaatccctcttcagcttggtggacaccaccccgcatggttatcacagcaggaagatggagggtgggtggtcaaatgctaacacagtgagagcactagactttcttttatggcaaagagcacagtcacttacagagatgtttgtaccatgcaggagacagcatggctgactcccaggtggagttaggagctgcccaggtctgcaggtccccagggagggatagctttggaggacacccaggcaaactgaggattccagcagacacgagaagctcacctcagctgctctaatggggtggtggccagcggggttaaacctatctatcctgccccccaaaacacaccctcctcagctgcctatcctgggacaggacacaccctcttggctccccacccacaagttactagcatgaaacaaacccagcgaactcaattcaaggaaagggaaagctcgttttctaggcatagggtcctgcagtggggccgggcttccagcctggttgtgcttcagggctgcacactcacacaaaatgtctcatggagtagatgactcgttcactcaagaaccagccatcgatggcctgtggttacagaatggaagacacagtgaagcaggggaattataaatggggtgctcaatgtaaaccagattgtttgttttgcccctctcccctctctctcatctgtctttcttgtcctttatgccccaatggcacctgtggggtcccttccccaagcaaagctgctggcacctacacacagagagcatgacgctcatagaggctctccaggaggaccgaagtgcccacagaagcaccagtcagtgtagcctgaggctgcccaggcccagaacctccacccctctgttctcagccacccagagtcatacccttaacctcatcattatccagacctacagcgcctacacccgctctccaaccactcctgaccatgtcctctatctgtccagcttactccctcggccccccaattccagcaatcctgtgagccaccaagacctacagtcctgccctatagagacctcaccaccttctcactgtcccccagcccccacgtcctcccctccctcctgatccaatcatgacggtcattcatctgcttataccctccgacttcttcacctctttctcgctttgaggttctctctgatgaaatcacacccctggttaaatggaactctccagccgctctgggcctgcatcgccccatggctggagaacaaactcagtcagcctctgttcaccctttgcattgctgacaaaatccagtgggccctgactgatgctccacaaacgtatcacacttctctcgtctcctctctcccactctcccaggtgatgatttcataccttctcctctctctctacaccttcaacacctcctccccctcctccctctcagcaactttgcttcctatgccaccaagaacatcgcagccaccagaaaagagctcctacgtgctctcaccagcgcgcccacccaccccccgtgtctgtgtctgagcactcagccttctccccgcggcgtgggtgagctgccctgcccccacctgcccctccgtgggatgggatcccagcccctgcggcccactcgcggacatctctcctgccgctctgtcttctctctcctgcacctccgcattttccttctcgattgaattaatcccatcagctcataaacatactgtatttctcccatcttaagaagaaaagaaaaaacagctctcttcacttcacttccccctccagcttccactccacttctctaccttctttcacaacaaaactccttgaaagaatggaggacactcttcttctctctgcctctgatttctctcctccggtcctcactcgaattcaccacagctggacttttgcccccaccatgccactaaatcagtgttcaggtcactggtgaattccatggtcacctgtcggccctcttcttgcttgacccgttggtgacatgacatgcaactgacgctgtctcctccttgaaccgccttcttctctcggtttccaggatgctgcccactcctggttctcctcctgcctttctagacaccgtctctcaagcacttttgttggttttgttggtggtggtggtggtggttttgagacaagatcttgccttgtcacccaggatggagagcagtggcccaatcaaagctcactgcagccttgacctcccaggctaaagtgatcctcccacttcggcctcccgagtagctgggaccacaggtgcccaccaccacacctggctaatttttaaatgtttaatagagatgaggtctcgatatgttgcccaagctggcctcaagccatccccccacctcagcctcctaaagtgctaggattacaggcgtgagctgccgcgcccggccttgttggttctttttcctatccttgactaaagtgctgggattacaagtgtgagccgccgcgcctggccttgttggtttttttcctatcctcctatccttgactaaagtgctgggattacaggcatgagccgccgcgcccggccttgtttgtctttttcctatccttgacctctaactgtcagtgtgctccagggctcaatcctcggacgttctcttgcatacctatactcaatgctgaggaaatctcagcttgtcttatggctttaaatactgcatatctgataggtgtagatggatatgatggatataacgatgattctctaattttttttggagatggagtctcactctgtcgcccaagctggagtgcagtggcatgatctcagctcactgcaacctccgcctcccaggttcaagtgattctcctgcctcagcctgccaagtggcccaagtagctgggattacaggcacctgccaccatgcccggctaatttttgtatttttgtagagatggggtttcaccatgttggccaggctggtctcgaactcctgacctcaagtgatttgcctgcctcgacctcccaaagtgctgggattacaggcatgagccactgctcccagcctgattctctaatttttatcatcaggaagaccctttcccctgagctccacacccacctacccactgccattagacgatgggcatctccagcctcacagagctcccagttctccactcagccagccttttggcagtctccccatttcagttcaaggcaactttattcttctagttgctcagaccaaagacattcctcagtttgcattctctcaccccacacagccagctcattaggaagtcttgttggcaataccttcaaaatacatccaaacccaattcctttccatctcccccactgccaccatcattcctcacctgggttacttcagtagtgtcctaacaggccccacggctctgtcttcaccccgttgcaacctactctcagcagttttcagaaagatctgattcaattctgtcactcccctccttaaaagccttctctaaatgcattttcagttagagaaaagctgtagaccttagcgtgggcctgcagcccctagctgactctgcctcttatctctccgcgctcttccctgctgacccccatcccctgtgctgcagccacactgacccccttgagcacacgccaggctttagggctggtcctttccactctgtctgcctgggctgctctgaccccagacaggctgctctaaaaaggctcacccttctccagcttttcctactcaccctgcctgctatttttttctccttagcactactgccatcaaacatactatatgtggctgggtgcaatggctcacacttgtaatcctagcactttgggaggccaagacacagatcacttcaggtcaggagttcaagaccggcctagccaacatggtgaaatcccgtctctactaaaaatacaaaaattagccaggcatggtggcaggtgcctgtaatcccaactatttgggaggctgaggcaagagaatcacttgaacctgggaggtggaggttgcagtgagccgagatcatgccattgcactccagcctgggcaacagagcaagattttgcctctaaataaataaacaagtaaataacatatgctgtacttactaaccttgttaattgtctgtcccccctctaaaatgccattgggagtgggggttttttctgtttgggtcactgccatgtcccgatgtccacgggcgttcacggcagccacgtggcgagtgctcacaaatgtgtgcagtttcgtggacaggaaggtctaggctgaagcaagtgggatgatcccacagcctgactatcttagtagtcacccatgaggatggttttcagagccctcaccctcatgtaccgcagagaaacgactgcagcctggcccctctctgacttcccctccttcaagccaccgcagaaacagcaaggccgtgaagagcgtaacgagagagccagcagggcccgggctgacctcagcctctgacacttcggattttcatgctgggaaaaacatttcatctctctaaacctcagtttggtttttttttttttttttttttttgagacctagcccactctgttgtccaggctggagcacggtggagtgatcttggctcactgcaacctccacctcccgggttcaagctattctcctgcctcagcctttcaagtagctgggattacaggcgtgtgccaccacacccggctaatttttgtatttttagtagagatgtggtttcaccttgttggcggggctggtctcaaactcctgacctcaagtgatccacccgcctcagccttccaaagtgctgggattacaggtgtgagccgccgtgcctggcctaaacctcagtttcttaaccagtaaaatgagaataatgctacctacttcataggactactgaagggtgaaatgaaacagtgtgtgtaaagtacttagtacagtggctgacacagagcaggcacttggagaatggagattatttttattagtagtaagaaaagttataggaaggtgggtgtgggggctcacacctgtaatcccagctgctcctaaggccgacgttggaggatcgcttcggcccaggagtttgagaccagcctggaccacataactatcccccaactctgaaaatcgattaaaaattagctggagagggtgacacatgcctgtagtcccagccaccggagaagctgaggcaggaaaatggcttgagttcaggagtttgaggctgcagtgagctataatcaccccagtgcactccaggctggatgacagagtaagacctcatctcttcaaaaaaggaaaaaaagaaaaaagttacagcagctgtaggttcttggctcttgacttgggaagaatttcactgataattttttttaagttgatattttgtattttcattattttacctttgttagtattattcacaacaaagcagtgtcgagaacaatgatcacatttctcctcttctataacttattggttgtcctggagtttaatttttaggcttctccttttcttttttttttttcatttttgaaattgagatatgtttagattaaacgcagagatcttaaatgttacagtttgacgtgttttgaaaaatatgtacatggctgaaactcatatttctaaaaaaaaatgagtgtttccaatataccattaagttcactggggcccccttacagtcaaatcttatacaccacaacccctcagatgatcaaggttcagatttctttgaacataaattagttttgcccatttagagattcatctagctgtgtaagtcttctttcattgagaaaaagattttaaattcctccacattcgtggctatatcaatcgttggaaacttttaattattgcctagtattgttttattattatacttgaagttctagggtacatgtgcacaacgtgcaggtttgttacatatgtatacatgtgccatgttgttgtgctgcacccattaactcgtcatttacattaggtatatctcctaatgctatccctcccccctccccccaccccacaacaggccccggtgtgtgatgtcccccttcattcactgatgatttaaaaacagcttgtttatgattgcaaggacccaaatggttgctcgctgtctccatagaagctgacgggaagaaatgtgcttgagctacaacaggcagtggccaagtcaacctacggaagtcttgtctgatcataagaggttgaagccacagaagcaggcttatccaaagaagctgtgacagctcatcaggacagatccttaaagagtggcataccctaggctgggtgtggtggctcaggcctgtaatcccagcactttgggaggctgaggcgggcagatcgcctgaggtcaggagttcaagaccagccaggccagccgtctctactaaaaatacaaaaattagccgagcatggtggcgcatgcctgtaatcccagctacttgggaggctgaggcaggagaatcgctggaacccaggaggtggaggttgcagtgagccaagatcatgccactgcactccagcctggatgacagagcgagactctgtctcaaaaaaaaaaaaaagactggtgtatcctggtgtgtctagtcatagagtccctgcagctttctgggtgagaagtctgtgatggaaacagcatggaagcctcaaactccatggataaatggggcagctgaccagacagctgtgaactaacaggtctacactgcaaatgcaaaatattgcaggccccatactccacttgttaatactcctctctgccctttaaatatatatatatatttgaagtcttccgcttctcagcttgcttccatccccctcctcagtgcttgttgatgggattcaagcactcacccctgaaaactgcaggccctgctcttctgatgcctggtgaaagaatcttaaagatgagaaggagggacgtacgctctcttttcctgaagctagaaaaagtagatgctcttctgcatcatcaaccacctgtcttagtttgctttctgttgcggtgacagaataccacagactgggtaatttacaaaagaaaaacagaggccgggtgctgtggctcatgcctggaatcccagcactttgggagggcaaggtgggaggatcgcttgagctcaggagtttgagactaacctgggcaacatgaaaaaccccctctctacaaaaaatacaaaaactagccgggcctgtggctgtcagccctggctggatattagaatcacctggtggtgatgagttagctcagtaattagtgagtaaagtcacctaggaagtttggtctgggctcagcatggatagaattcaatgagaatttctggggatggggcccaggcaccagtgttttagtaaagatgcccagatgattccaatgtaccactaaggccgagaaccactggaatagcccggattattctaatgtaccactaaggccgagaaccactggtatagcccagatgattccaatgtaccactaaggccgagaaccactggtatagcccaactaacatatatccaagttattgctgcagagttttactgcttcatttctcaggaaaaccctgacagatgaaagaaggcttgatttagcaagaaagagagtattcagatcaatccaaattcttatgtcatttataactataatccctctgaatatattatttccacaatccccaaaacctttttatttttgtagttaaatttttatttaataggatacaatttttagaaaaaaaaactcttatttttaaaacactccaaatttttctttgcaaaaagacctttgcctggtggttaaattttttaagggaattgatactctttcacctcattagcaaaaaaaaaaaaaaggcttaaatttatttagatctctcaaactttttaagatgataccttttttattgcaacactgtcccaagagtagacatgtctttgacatgggagacctctggtgtctctatgttttctatatagagctgtactgtctgataccatagccactagccatatgtgattctggagtctcactctgtcacccaggatgaagtacagtggtgccatctcagctcactgcaacccccacctaccaggctcaagcgattcttccaccccagcctcctgagtagctgggaccacagactcaggccaccacaccgggctgtttttgtatttttggtagagacggggtttcaccacattgcccaggcttgtcttgaactcctgaactcaagtgatcctcctgcctcagccttccaaagttctgggattataggcatgagccaccgtgcccagccaatatgggactccttaaatttaaatgtctgggggccaggcacggcggctcacacctgtaatcccaacactttgggggcctgaggcaggagggtcacttgagtttaggagttaaagacaagcctgggcaacatggcgaagccccacttctggtaaaaatacaaaaattagccggacatggtggtgcatacctgtagtcccagctactcgggaggctgaggcagcagaattgcttgaacccgggagatagaggttgcagtgacctgagatcgatcacgccactaaattccagcctgggcaacagagcaagactccgtctcaaaaaaaaaaaaaattaaatggctgaggtggcagctcacacctgtaatcccagcactttgggaggcctaggcaggaggattgcttgagctcaggagttcaagaccagcctatgcaacatagtgagacccctatctccacaaaaaaaatttttttttaattaggtgagtgtggtggtgcacacctgtggtcccagctactccaggggctgaggtgagaggatcacttgagcccgggagactgaggctgcagtgagctgtgatcatgccactgcactccagcctgggcgacacagcaggccctgtctctaaataaatgaagtttaaatgaaataaaattagaggctgggcgcggtggctcacgcctgtaatcccagcactttgggaggccgaggtgggtgaagtgcctgaggtcgggagttcgagaccagcctggccagcatggtgaaaccccgtctctactaaaaatactaagattagccgggcatggtggcaggcacctataatcccagctactcgggaagctgaggcaggagaatcgcttgaacccggcaggcagaggttgcagtgagccgagattgcaccactgcactccagcctgggtgacagagcgaggctctgtctcaaaccgctccccgcccaccaaaaaaaaaagaaataaaatttaaaattcagttctttcagaatgaaatgagcacttcacatttcaagtgctcagtagccacatatggctggtgaccaccatattagacgatgcagctacagaatatttccatcattgcagaaagttttattagcactgaattcaagagtgacttttaatttatgcaaccgtatatggttttactcctggactttaatggaaaatggaggcccaccataacctgcagcagatcctatgccaagggggcaggaagtgccattccacttatggtggaaggaggtggtttgggggaggtggaggtgactcctgtgcttactccctgtgagaagaatcaacctctcagggcctgaggggtaaacatttgaggagggaagtgaaagtcctttttttctgaactgttaagcacccccacctagtgctcgtaatattatcattttatgtacaaattggatgcaaagcctaccaccctgtcaaactacagattgcagtgtgatcagttcaactgcaaagattggccaggaaaatcaactctcaccgtggacagcaaggaaccaagtgcatcagcagactctccactcattcctccccgtcactgagaaagagcccagagcggtgtgggtgactgacgtggaacggagctgctctgcgctgagcgtcggcacttggagacctcgattgaatctattcggcaggagagctgaattcagagcagcccacggctcaccccagcaattgtcagtgctggaaaaatcaccaccgttggtgtattcccggccactctgctggacggatggcaggattcccaagtagtgaaggggaaggcggccctcctgcccttcctgcttcctcaggtgggccccgcacctgtgggccggcctgcctgcctgctctgcttgcgagtggctcagaaatgccggctcccaggccgtcgggctgttcccgggatgagacctgctgcctacacatgtcacagcagtgggttctgttcaaaaagtgacatgagagaagagaaaagtctctgctccctcccatgacagtcatggagagtttctaccctctgtcaggaaatccgactctgtgtgtgagtgtgtgtgtgtgtgtgtgttcacatgcatgattgacacttcgctgcctcagcacctcgccgatcctgcatctttcctgtgagttcaaaatgagaatacacccacatttctctactgtcaaaagttttagaactgttcaagtgtgttgttaagtattcagagaaaaggagcttggtcctgggagaactgttgagtggcggggattagcagagggtattgaaaaagaagactgaggcggctgaaggcaatggcagaggtggagagaccctcacgcgtgagctgcagggtgtatgtgcctttggggattcaaaggagtgagacctgctttgactgtggaggaaactgaccacatatcacgcctccactgaaacgttaattagcagagcctgggagaagagctgatatcctcactctggtaggggctgtcagcttgtcaaaaggaaagctctgcttagctcagaagcccaaacctctaaccatggctctagatgtgtaacattcggaatgtcaaggactcagccaatccagatgattacaacagccctaaatatctgatgggaggacaattaggcaagacaatgatgaaaggcgtctggctggcaaagagcaagcaatactatatttgaaatgacacagtcttacatatagaaaatcctaaggaagctactaaattattattggaattaataaataggttcagttgcagggcacaaggttaatatacaaaaatcaactgtatttctatatactagcaatgaacagtacaaatgtaaacttaagaaaacagttctatttataattgcattgaaaagaataaaatactcaggaatgaatgtaacaaaataaatacaaaacttacactctgaaaattacaacatattgttggaagaaatcaaagatgaactaaataaatagacatcccacattatggatgggaagaatcaatattgttaacatggcgatactccccacattaacctacagattcaatataattcctatcaaaatctcagctgagattgtgaagaaaaaaaaaatcccagctgacttttttgacaagctgatcttagaattcatacagaaatgcaagggacccagaatagccaaaacaatcttgaaaaagaagaacaaagttggaagattcacacttctcaatttcaaaagagtacagagttcagaaatcaagacagtgtggaatggacagaaggacagacatacagatgaatggagttgaatggagttgaatggagtgctcagaaataaatcctcacttctatggtcaattgttttttgacaagagtgctaagacctttcaatgggaaagaataatcctttcaacaaattgtacaaagacaactggacgtcctcttccttacaccatacacaaaaaactccaaatggatcataggcctaaatataaaagcacaacctacaaaacttataggagaaaacacaggagaaatcttcatgcctttaggttgggcaaagccttcttagctatgacaccaaaagcacaagtgacaaagaaaacagtagataaattggacttcatcaaagttagaaacttttctgcttcaaaagatgccatcaagaaagtgaaaatggctgggcacagtggctcattacaatgctcaagtaatcccagctcttccggaggtcaaggcaggaggattgcttgagaccaggaggttaaggctgcagtgggccatgatggagccactgcactccagcctgggtaacagagcaagactctgactcaaaaattaaaaataaaagactgggtggggtgactcatgcctgtaatgccaacactttgggaggccaaagtgggtggattgctggagcccaggagttcaagaccagcctgggccacatggtgaaaccctatctcttccaaaaaaatacaaaaagcagcagagcgtgatgtcatgcacctatggtcccagctacactggaagctgaggcaggggaggatgacttgagccctggaggtcaaggctgcggtgagctatgatcgtgacactgcactccagcctggacaacagagagagaccctgtctcaaaaaaaataaaaaatatattaaaataaattaaaaagaaagtgaaaaagccagtccacagactgggagaatatattggcacatcatatagctgataaaggacttgtatccaaaacataaagaactattacaactcaaaaagaaaaataatactactttctgttcaccagacctgaaaaaaaagagaaagacaaatagcagaatcttaaagtagtcaaaaatctgaagagacatttctccaaagaaatatacaagcggccaataagcacatgaaaagacgcgcagcggccacagtggtgcacctgcaatctcagctactcaggaagctgaggtgggaggatcgcttgagcctgggaatttgagatcagcctggacaacataatgagactccatcttaaaaaaaagatactgaaaaatgccccattaggaaaatgcaaattaaaaccaccatgagatatcagttcacattcactcaaaaagtataatcaaaaacacaaataggccgggcgtagtggctcacacctgtaatcccagcactttgggaggccgaggtgggcagatcacctgaggtcaggagttcgagaccagcctggccaacatggtgaaaccccttctctactaaaaatacaaaaattagccgagcatggtggcgggcgcctgtaatcccagctattcaggaggctgagagaggagaatctcttgaaccctggaaggggaggttgcagtgaaccgagatggtgccactgtactccagcctggtcaacagaatgagacaccatcttgataaaaaaaattaaaaaagaaaaaattgtgataacctaaaaggatttggcactcagattgtttagcatctgtctaaattcttgttccacttacgtaaccaagactggatactgtccatgatgaattatcagtgtgtttacacaagaaaggacacagaattccactcaactgatccatactcaaagagaagaccttggccttgcattcagagatcagcaaaaacaatattcactttatgttttaggttagaatatttgatattctaacctaatatggctaataggttttaatatctaatggctaatttgatattctaacctaataaggctggtcttgaactccagacctcaggttatctgcctgccttggcctcccaaagtactggattacaggcgtgagccacggcacccagccaggatctcttttaaagtaagtacaactacaatagaagccctcttctcaatgtgaccagcatcgatgattggtgagtgaatgaagtcaaagtgggaatttaaacagacagagtctcactatgttgcccaggctggtcttgaactcctgggctccagcaatctcctacctcagcttcccaaagtgctgggattataagcatgagccaccacgtctggccagggaaggatttcttaaggtgtaaataatacaactattaaaaaaaaagattaatagatatgacaatattaaaattaataatatctattcaccaaagacatctttttttttttttttttttttttttgagacggagtctcgctctgtcgcccaggctggagtgcagtggcgccatcttggctcactgcaagctccgcctcccgggttcacgccattctcctgcctcagcctcccaagtagctgggactacaggcgcccgccaccgcgcccggctaattttttgtatttttagtagagacggggtttcaccatgttggccaggatggtctcgatttcctgacctcgtgatccacccgcctctgcctcccaaagtgctgggattacaggcgtgagccaccgtgcctggccggtcactttcagataatcttgtaaagctaagaaggttgttttttttgtatttgtttttgtttttgtttttgtttttgttttttgagacagagtcttgctctgttgtccaggctggagtgcagcggcacgatcttggcccactgcaagctccgcctcccgggttcaagcgattctcctgcctcagccttcccagtagttgggatttcaggcgcctgccaccgcacccatctgatttttgtatttttagtagagacggggtttcaccgtgttagccaggctggtctcgatctcctggcctcaggtgactccccacctcagcctcccaaagtgctgggattacaggcatgagccactgcacccggcctatattatcttcacaacaaattttaaaacaaacaagttcttttcaaaacagcaataaatgcttacagttcattttcactttctccaacgtgtacctttatctttgagccccaagaggggtatatatgactatgtacaacctaaaacaacacagcagaaaccatggctacttctaagatcagtacgagctccaagacgtgactgattcaatacaatcaactcaagtggggaagatgcaacaaaacacgatagcatttactcatggtgttgagcagcgagagatgggaactggggaggcaggggagaagccagggagccacctggaggtctggtttctggtgactagccagtgacaaagtcagatttcatcgaggggtagcaacagctggagccattgaggacatgacagccttagagacaaactgtgtgacaatttccccctcttccctccttcttcccaactcagttcaccctccgccctccacatgaatgagcaagacaggagggagacagaatgagaacgtgactgttcctcttccgtagcctcctctcacacaccctgccctcgccctcctcccgtccctccacacccaaccccttcccctgtggtgccccttcttttccccgaccctctgttgctgtcactccaatccacccacatagctcccttcccgcgatgatgacaacttcttgtatccaatgggcaacactgtgatgcccccacctgaccacccttcaaaggaggatttgtcgtcccagctgcttgagaaccatggaactctgggttctgccagcccaaggtgaaaattccccaagggaaggatggatgctggacacggtcaccatatgtccaccagttagaatcaactcctagagatgggatttccggtcaaatggttagatatgcatggaaatcggactttagtttcagcatttggccccagtctgctaactgggcttggtttagtcttgacctttggaaggccaaagagcctacttccatgttatttatgtttatggcctccacgaactgtgactgatcaatgattctgtgatcactcttctctcttactagcataaaaatgtgggccaggcacggtgactcattcctgtaatcccatcactttgggaggccgagatgggtggatcacctgaggtcaggagttaaagatcagcctgaccaacttggtgaaaccccgtctctactaaaaatacaaacattagctgggcatggtggcacatgcctgtaatcccagctactcaggaggctgagacaagagaattgcttgaacctgggaggcagaggttgcagtgagccaagatcgcaccactgcactccaggctgggtgacagagcgagactccatctcaaaaaaaataaaaaattttaaaaagtcagtaatactcaaagcatgccattttgatttagtattaatatttcaatattcacttccttttttttttctttttttgagacagggtctcactctgttacccagactggagcgcaatgaggccatcatagcccactgcaacctcaacttccttagctcaagggattcttctgcctcagcctcccaagtagctgggactatgggcacctgccatcacacctggctaatttttaaattttttttgtaaagacagtgtcttgctatgttccccaggctggtctcaaactcccggcctcaagcaatcctctcaccttggcctctcaaagtgctgggattacagacgtgcgctgcatgatccccgtgagccactgcacccggccctcaatattcactttcagatattcacaccttgtctagggtggcctacagccactgcccataaatgcagaagtataaaggtctagccatctcagcccaactcaagaagactctgaagggccatatttgtggcagagctcctcgggggttggccaaggctgtcattggccaacatcacagcttagcttctccctctgccctctcctgtttctgcctcctctcttctataggtgctgatcgcaagggcactccttaataaacatcctgcccatcaaactccatctcagagcctgcagcacagcccttactatctgaaaagtcatttggccttgatgctaagatgccttccacaggtgtccagcattttggcttccctgggccacattggaagaagaagaattgtcttgagccacacataaaatacactaatgctgctgggtgcagtggctcacgcataatcccagcactttgggaggccgaggcaggtggatcacctgaggtcaggagttcaagaccagcctggccaacatggagaaaccctgtctctactaaaaaataaatatgaaaattagctgggcatggtggtacatgcctgtagtcccagctactcaggaggctgaggtgggaagattgctggaacctgggaggcggaggctagagtgagccgagatcaccccactctactccagactgggcgacagagtgagactctgtctccaaaaaaaaaaaaaaaaaggtccatgcataattataattttcaagatatccgccaccatagagaagcaaaaatgtcctcacattcaaagggttagacagtgctcttttttttttttttttttttgagatggagtcttgctctgtccccaggctggagtgcagtggtgcaatctcagctcactgcaacctccccctcccgcgttcaagtgattctcctgcctcagcctcccgagtagctgggactacaggcgtgtgccaccacactcagctaatttttgtatttttagtagagacggggtttcaccatgttggccagcatggtctcgatctcttaaccacgtgatccacccgcctcagcctcccaaagttctgggattacagacacgagccaccgcgcctggcctagacattgctcttagactgtagagatgaggtttcaccatgttggccaggctggtcttgaactcctgctcatgtgatccacctgccttggcctcccaaagttctgggattacaggcataagtcactgcacctggtcctcttcaccttttaatcctcattcttctctttggactgtttcctgctgtaggatacacttacttaaaatcagctggctggccacagtggtgcacacctgtagtcccagctaccaggatggccgaggcaggaggatctgttgagccgaggagttcaaggctgtagtgcgctgtggtcacacctgtgaatacccactgcactccagcatgggcaacatagcgagaccctgtctccaaaaaataaataaattagctgatcactccttggagcatgtagtgaattaggaattcaccaatggaagaaacacgtgtgagtatacgatggcgacacctggtggtaggatatgcaataacatcgtgaacctcccttaatggtggattcctggcttattgttggaataaaatgtaattacatggaaattgtaagagccattctaaaaggttagcaacaacaagaaaaaggttgtctgcatgaacttgcatgtgtgtgtgtctattcttgtgcattaaggacagacaataatccaagacacagttaatgaagatgagagcctgatcaagaacctgtcgttcactctgctgcttactgttatgctgaccttgtgcaagacacttcactgctttgggctttggctttctcatctttagagtaggaagatttaagaatccccacttagttcaataaatagtataagtgaaaactgttttgtgaattgcgtgaatatgttatactacgttaattattatactattagctattattataataaagatcatcgttggcaggacacagtggctcatccctgtaataccagcactttgggaggccaaggcagccggatcagttgaggtcaagagttcgagaccagcctggccaacatgatgaaaccctgtctctactaaaaatacaaaaattagccaggcatggtggtgcgagcctgtaatcccagctactcggaggctgaggcaggagaatcatttgaacccaggaggccgaggttgcagtgagccgagatcgcgccactgcactccagcctggatgacagagcaagactccatctcaaaaaaaaaaaaaaaagaaaactgttacaaagttagctctctgctacaaatttcctgtcaaggaatgttaatattgcttgaagatgagagcgcattagtctggactttgaaccttgtaatagtcccttttactcagggataactgcttaaaactgcaacgtgtccaatctatgagcgtcaaaacagcaaccgggtgcagggttctcagccaggggcaattttgtccccaggggacatttagaaatgtctggagatatttttggttgtcacgactagggggaagagtgctactggcatctagtgagtagagtccagggacgctgctacacatcctacaaggcacagacagcacccccaccacaaagaattatccggccccacatgccaaaagtgctgaggttgagaaactggtctagcgtaacagaagggagaaagtagacctttttccctactgtcctaaccaccattaacagcaaccacaaagatgggatggtgggtcatcaatgtgaaattctccaacatatatgtgcaaaagagctcaagaaatgtattaagtagcatcatacaatgccattgttatctactatgtgtaaaccgtctcaacatgggcacaactggtcttgtttttccctcctctttttacaaagaaaatgaacctgacctgaatagaacttttgctctattcagacatcaaaataaaaactagcggtaactattaaatgtgtagttacttgtggaattaagactaagagttaaaagggagtgagtatactttgtaatgaccacatgctctgatagtgtatagtagtgccattttttcacttttcatttaatatttttcagacaaggtctcactttgtcaccaaggctggagtgcagtggcacaatcacagttcactgtagcctcaaccttccaggctcaaacaatcctcccacctcagcctcccaagtagctgggactacaagtgcatgccaccatgcccggcaattttttttttaagatggaatgccattatgttatccagctggtctcaaattcctgcactcaagcagtccacccacctcagcctcccaaagtcctgggattacatgtgtaagccactgcacccagctgagtactgccatttttaaaaatgggacaagaacatttacaaatacatttaaaggctgggtgtggtggctcacacctgtaatcccagcactttgggaggccgaggtgggtggatcaccttgaagtcaggagtttgagatcagcctagccagcatggtgaaaccatgtctctactaaaaatccaaaaattaaccggtgtggtggtgcatgcctgtaatcccagctactcgggaggctgaggtgggaggatcgcttgaacccaggagacagaggttgcggtgagccgagatggcaccactgcactccagcctgggcgacagagcgagaccccctctcaaaaaaaacaaaaaacaaaaaaacaagcacacacatttaaaaatgtgtgagcaagcacacacatttaaaaatgtgtgagcaagcacacagaaaaaaagctttttaaaaaacctttttagtaattatattagtgatggtaatattagtattgcagctccgacactgttatgagtaatgcggacacatcaaatgcgcaagatgaggtattctgattccattctagattttggttttgagaatcatattttcaacgtggaagaatgtgtatacaggattctcaagatgtagaggttaggtaaaattccttgctgttctgaatctgaatgtaaagtatcagtgtgaatgcatgaggtattttctattctattctcttcatgtgtctatatatgcaaaatcttcactgagaaggcccaaaagcaaagcaacgaccagcacagtagcagccagcatctttatgcccagagtaccgtcttcaaataccatttcccactaaaagaaacaaatgcttcatgaagaaatgactgattcccagtttggggcagaaaatatacattttgacctttgtcatatcatctagtcacatcagatagcaacaaaactaccgaagactactagggccatgtaagaaggattcaggagccagttggaaaaggcatccacttactgaagatgacacaatttatgcttcaataattccaagggactgaaaatgatcaaatatgtttaaatccctaagttcttaattatattcaaacatttttaatcatcacatttggaggatgctagggaaccaattctcttcccgggagaggagggtgggggacccattccttatcttagaaaacttacgagagaaaagaatctagtacttttcccaactttcctacatggattgtaccactgggtaacctaatggtagatgagaggaggcatctctttatgaaagtattgcaactaatagaccggcgggcgcgttggctcaagcttgtaatcccagcactttgggaggctgaggtgggtggatcacgaggtcaggagatcgaaaccatcctagccaacatggtgaaaccccgtctctactaaaaatacaaaaattagccaggtttggtggcacacacctgtagtcccaggtactcgggaggctgaggcaggagaatcgcttgaacccaggagttggaggtgcagtgagctgagatcatgccactgcaatccagcctagcaacagagcgagactccatctcaaaaaaaaaaaaaaaaaaaaaggtattgcaactaacaaatgaaaaaaaaagcggtagaattagagtattacaattttgtaattgtcagtggattaatggctttaggcatcaggcatccatgactattaacatagcaacagagttgacctgcgttttgtgcttcctgattcaagatccagtagtgacttagtcttgccatagagtctgaacctaagtctcatcataccttgggatccagctgctacatcgtaggaaatccagaacacattgaattccaccgagaatacttcatcagcaacatccagattgtgggaaatttcacaggtcaaaggattcaggtttttcaacagataaattgtcagaataagaaagagaggggaaacttgtagcttcggagacttaaaatcataactaattttcaaaaaatagagatggggtcttgttatggtgctcaggctggtctcccacctctgcctcagcctcccaaagtgttgagattacaggcatgagccaccacgcccagccacgacttttttaactggacaaccatagagtcccaggtgttcactataaagaaacacgaccaagtgattgtcttcgtggtttcttggcggcggtggtggttgggacgtgataggggtggggcccgtggatggtcttctcagtggcttgcaaagttctattccttgacctggatggtagttacaagggtgtttgccttcattacgctatacattcatttttgtatgattttctgtatttatgttttattttccaaaaaaaaaaagctttaaaagagtataaagaaagtagatggcagaaatttgtggaatcttcccccagcaacataaaaacgcggtgggtttttgtaacttggtttttacactttacaattaatattgtaatgagaaatactcgtgtggaccactagggcgcacaatttgttgcccgcagcatctgcggcactggcactgatgaaagggggatgctaaatgcttcagtaacgccacctgagtctcgggatgaagcaacattattcatcgccctttgatcatgagctacatatgtgagtgccaatgctggcgaatcgtatttggaaagtcgggtccaacatgtgatgtgtacatacagggtatacactgaaaataccgtagttttatcctcttttaagataagcttcaatttatttgagttattagaacaaagcctcataaaccacggtaaaaagaaccttaaaacttttttttttatttttgaggaagtcttgctctgttgcccaggctggagtgcaatggcacaatcttggctcactgcaagctccatctcctgggttcaagcgattctcctgcctcagcctcctgagtagctgggattacaggtgcccgccaccacgtccagctgatttttgtatttttagtagagacaggggtttcaccatgttggtcaggctggtctcgaacccctgacttcaagtgatctgcctgccttggcctcccaaagtgctaggattacaggcatgagccacagtgctcagcccaaaaacctcaagacttagtgtgtggagaatggaggtgaaaagtttttgtggtggtctcctaatgagacgatagccccctggcggagggagagaaacacgtgagagctatttggagcctccctgaaaggtgtcactgggctatggatggactgagaaccacacagcgacgggccagccttcgagggccaacacagagtgagagacggcctctgcagggcccaggctggggaggggtggtgaggccagtcacgactagtaatctaagagccgtctttccttacctgtggtgtggaaagggctgcgggtcacagaatcttagtgatacgagcttaggcgaggctcaacggccctacctctcaggtgagaaagcagctctcctgtaatcgttatcttttctcaaaggggaagaacaacttcttcctgttaataaatcacagacctcagatgctttgtattgctgaggaaacaaaacgtttatgaattgttcacaggctgagaaaataagatgctttgagtttttggttttttctacaaggctgcaataaataacacagcagtaaatcctaacctttagctctgattggtattatttcattttggtgcctttccagccggcccaaaagtgtgatgctgtgatacacacagtatgtgtgtatgtgtgtatacacatgactattttgtgagatttcgcgtactagttcattagtggcgccctggaatcacagatccttcctgctgcggtgatagcatgtgggtggtgccgaggtggactgctgcttgatggtgaagaaagaaaagaggacaggaggacccgccaggaccacatgtggagagctgcagcgaaagaatcctcgctcggtggacaccatggctttttgctaagccctggttctctctatggaccccatgcctcatctccagagccaaaacccagcctttctcattcaaggacactccccagagctttgggaacacatttcattctggctctgttaagtacccccatagggtcccgaaagtccaggctgcttcttgcccctgccgcctcaggtcccagaggcccactgctgcgtccaggacgcctcctccaccacgtcctctcccaaagcttatgcagcagttaagcaaaggggccctggcctctacagcaccgaggcagcctcctagttcagccactctcatgtgagtgtggacaaattatttaacctccctaagcctcccttctctcttccattaaatatggatgataaggataataaatattaacctcataaggttgttgtgagagttaaatgagaaaagatatataaaacttaggccgggtgtggtggctcacgcttgtaatcccagcccttggggagtctgaggcgggcagatcactgaggtcgggagttcgagaccagcccaaccatggtgaaaccccgtctctactaaaaatacaaaattagccaggagtggtggctcatgcctgtaatcccagctactagaggggctgaggcaagagaatcttttgaacctgggagggggaggttgcagtgagccgagattgcattattgcactgcagcctggacaacaagagcgaaactccatctcaaaaaaaaaaaaaaaaagatatataaaacttagtgtcattcctggcctgtaaatggtaagtaaaatgtagctctcacctttactccaggtttcagaaatgctgttcctctcaacagagaggtggtggattctccacaaatgctgaggaatgaatggatggatgagagaatgcagtgaccacttcccatggatggatgagagaatgcagtgaccacttcccaatgatgaagattatggcaaaaattgattttaaactcctacaagatagaatccatgatttaattctttttatttttttctttaagacagagtctcactcattgcccaggctggagtgcagtggcgtggttacaactcacggcaccctcaacctccccgggctcaggtgatcttcccacatcagcctcctgagtagctgggactacaggtgcatgccatcacacttagctaatttttctattttttttttaagagatggcgttttgccatgttgcccaggctggtctccaactcttgggctcaagcaatcctcctgccttggcctcccaaagtgtacagtcatgtgtcacttaagaatggagatacattctggaaaatgcgtcattcagcgatttcgtagttgtgtgaacatcacagagtgtacttacacacacctagatggtacagcctcctactacacacctagtctgtatagtgtagcctattgctcctaggctacaaacccgtacagcatgttactttaccgaatactgtaggcaatcgtaacacaatggtaagtatctgtgtatctaaatatatctgaacatagagaaggtacagtaaaaatacagtattataatcttatgggattctaagattataatcttataataatataatcttgtatatttggtccatccttgacaggaacattgctatgtggcatatgactgtatagctcttcgaaccaaaataaagcaaaaagatgactcccaaaaaatagattatgaggccgcacgtggtggctcacgcctgtaatcccaacactttgggaggccaaggtgggcagatcacttgaggtcaggagttcaagaccaacctggccaacacagcgaaaccccatctctaccaaaaatacaaaaattagccgggcatagttggtgctcgcctgtaatcccagtgactcgggaggctgaggcaggagaactgcttgaacccaggaggtggaggttgcagtgagacaagatcgtgccgctgcactccagcctgggcaacagggcgagactccatctccaaacaaaacaaaacaaaattatgaagagactacgcttagattagggactgggatttaacacaggttcaatcttcctagagtacatctttaataaagtatacacagggaacagtgcccaaatcataagtgtacagctagatgaccttttacaaagtgagcacgcatctgcgatcaacacccacagaaagaacattcccggcgcccagcactgtggccctcccgttcactgaccccgccttccaacttctggggcatagatttttgtttttgaatttcggacttgtttttgtttttgttttttcaggttttctttgttttgttttgttttgttttcctgagacagagtctcattctgtcacccaggctggagtgcaatggtgtaatcttggctcactgcaacctctgcctcccagattcaagcgattctcctgcctcctgggcagaggtagaaaaaaagtttcaaaaatcatgaattcatattaatattcaaattaggacatttacaatctaggcactaaggataggcattgctagtaggtgtcattgctttttttttttttcttaagatgaagtctcactctgtcgcccaggctggagtgcaatggcgcaatctcggctcactgcaacctcctggcctcccaggatcaagcgattctcctgcctcagcctcccaagtagctgggatgacaggcgcccgccaccatgcccggctaatttttgtgtttttagtagagttggggtttcaccatgttagccaggctggtctccaactcctaacctcaagggatccgcctgccacaacctcccaaagtgctgggattacaggcgtaagccacctcgcccggcctgttttttaactttggataaatggtaacctacagtgtacacatttttctgtctcctttcttttcattcaaccttctatttctgagattcacccaagttgtcccattaagttctagacttaaatattatatgtgttgtagggttattatggacaaataacacagcagaatggaaaagaacatgaaagtgagacccctgcaacccattaatgtgtgtttcatttaatgacggtaactctaccgaaaaagaacaagaagcgatgacacctggccgggcgcggtggctcacacctgtaatctcagcactttgggaggttaaggcgagcagatcacttgaggtcaggagttcaagaccagcctggccaacatggtgaaactccatctctaccaaaaaatacgaaaattagccgggagtggtggagggcagctgtaatcccagctactcgggaggcagaggcaagagaatctcttgaacccgggaggccaggagtttgcagtgagctgagattgcgccacagcactccagcctgggtgacagagtgagactccatctcgagaaaaaaaaaaaagcaatgacacctactagcaatgactattcttagtgcctagattgtaaatatcctaatttgaatataaatatgaattcatgatttttgaaacttttttctacctctgcccactgaaagagcctagacgaaatggctctcagtagcagtgagctctcctggggcctggttcttgggttccaaatactatatccactaggagaggccgggtgtggtggctcacgcctgtaatcccagcactgcaggaggctgaggtgggcagatcacgaagtcaggagtttgagaccaacctggccaacatggtgaaaccccgtctctactaaagatacaaaaaattggcgaggcatggtggtgcaggcctgtaatcccagctacttgggagactgaggcaggagaatcacttgaatgcgggaggcggaggttgcagtgagccgagatcacactccagcctgggtgaccgggtgagactccatctcaaaaaaaaaaaaaaaaggaaaaaagaaaagaaaatgtacaagatgttccagggatagcctttgtgtcagaaagtaagagagcttgggtccataaggagccactggggggaaacaacaagtttttaaaatttaaataaatagaaaaaaaaaggaaggaaggaaactattaaagacctcttgaatcttatcaaagaaggaaggaaactattaaagacctcttgagtcttatcaaagatacaggaactaattggatgaagtaaaaaatggaataatttcagcatcaaaaagaataatcactataatggatggaaaacaacaaaattataaaatttatataaaatatacataaaaatttatattaaatttatatacaatgtaatgatatatcattatatcaagtcctctccacccccatgaaaaatccctcattgttgtctttggaggttgctgagggaccaacacattatgctgaaaattggcaaatgaaaggagtgagtcaagcatttatcctgtgtcttcctatatactctgcatctttctttgttttcttttcttttctttctaagttcttttctttctttcttctttctttttctttctttcttctttttctttctctcccttgcttgctccccttccttccttcctcccttccttccttctttctctctttttctttctttcctctttttagagagatggggtcttattatgttgcccaggctggtctcaagctcctggcttcaagtgattctcccacctcagcctccaaaacactgggattacaggcatgagccacatgcccaggagtctgtgtttcaaagtaaccaaagagttaatgaaggaaaggtctttatttttatttacttattttttttgagacggagtctcactttgttgcccaggctggagtgcaatggcgcgatcttggctcactggaacctctgcctcccgggttcacgcgattctcctgcctcagcttcccgagtagctgggattacaggcatgcaccgccatgcccagctaattttgtatttttagtacagacgagatttctccatgttggtcaggctgatcttgaactcctgacctcaggtgatctacccgcctcagcctcccaaagtgctggggttacaggcatgagccaccatgcccagccaggaaagttctttttaaatgaaaatccagttagtaaatccagaagtaatggtagcaactaatgaaataatgtatttaggcaacaatcatcaacagctactaaaacatcaggcaaaaggttatagagaaactgtaatgggggatcagactgacaccacctcaacccactgaccagtttttgagagtgaggaacaggaagtagatggcacctctatgacatgtgctcaccaacaaaattagatctgaatggaatcaagcttctagcgctgcctaccagtttatgggaaatatggacaatagaggaaaaacacaatgacacaacagaaatcagtcagctgaatccgacgtagggaaattctacaggcatgacctggtttcttcaaaaataaatgacatggggcaaggcatggtggctcacgcctgtaatctcagcactttgggaggcgaggtgggcgaatcacctgaggtcaggagttcgagaccagtctagccaacatggtgaaaccccatctctactaaaaatacaaaaattagccaggcgtgatgggcacctgtaattccagctactcaggaggctgaggcaggagaatcacttgaacccgggagatggaggttgcagtgagccgagattgtgccactgctctccagcctggacaacagagcaagactctgtctcaaaaataaataaataaataaatgacattggggaatggcaggtaagaggagtgattaaaataggcttaaaaggctgggtgcagtggctcgcacctgtaatcccagcactttgggaggctgaggtgggtggatcacctgaggtcaggagttggagaccagcctggccaacatggtaaaaccccatctctactaaaaatacaaaaatcagccgggtatggtagcacatgcctataatcccagctactcaggaggctgaggaaggagaatcacttgaacccaggaggcagaggttgcagtgagccgagatcgtgccactgcactccaacctgggcaacagagacttcatctcaaattaaaataaaataaaataggcttaaaagaggctgcaaccaaagccactttgtggcacttatctgggtcctaatttgaatgaagcaattataaaaagacattttagagatgtacagggaaatgtgaacatattggtaattttattagatataataataacatcgaagttatttctctctctctctctttttttttttgagacagagccttgctcttgttgcccaggctggagtgcaatggcatgatctctgctcactgcaacctctgcctgctgggttcaagcgattctcctgcctcagcctcctgagtagctgggattacaggtgcacaccaccacgcccggctaatttttttttttttttttttttttgagacggagtctcggtctgtcgccccagctggagtgcagtggcgcgatctcggctcactgcaagctcctcctcccaggttcacaccattctcctgcctcagcctcccgagtagctaggactacaggcgccagctaccacgcctgtctaattttctgtatttttagtaaagacggggtttcaccttgttagccaggatggtctcgatctcctgacctcatgatccggctgcctcggcctcccaaagtgctgggattacagacgtgagccaccgcacccggcctcatttttgtatttttagtagagacggggtttcaccatgttggtcaggctggtctcgaactcctgacctcatccacccgccttggcctcccaaagtgctgggattacaggcgtcagccaccacgcctggcctctctctctctttttaaattatttttttgtagagacaggatctcatctctctatgttggccaggctggtctcaaactcgtggcctcaggcaaccctcccttctcagcctcgcaaagcgctgggatttgggattacaggcaggagcaacagtgcccagacttaagttattgtttttcatgcccatatatctcagagatagctactaaactatttatggtaaagtaatacaatgtatattatttgctttaaaatattctagcaaaaaaaagagtggaggggaacagatgaaataaggtgagccaaacgttgggtgttgaggctggatcaagaatgtttgagcactcactatgttatttcctttatcaggggcatttttgaaattttccaaaataaaaaaaaaattaaattttatcccacatttaaatgtatgcaactggcgtaaactacattaaaatctcaggaattttgacgaacggaaatgaggccagagtaggaggaacacagcagagagggaggtttggtggcaaagacgatggatgcgctgagtttgaaagatgtcaagtcgaagcgcctgtgagaggcgcggggagagtcgccgggcagggagtttggcagcagcgtctggcgttcaggaaaggggatgaggccacaggctgacgccggaagccacgggcctgtggatggcggctgcagctttgggaagggtgggcagtgtgaaaaggaaggtcagggccctggcaaagcctcgaggaggaaaagctgacaaagaaaagctcaactaagggccgggcgtggagcctcacgactgtaatccacgccctttgggaggccgaggcgggtggatcacctaaggtccagagtttgagaccagcctgcccaaaatggtgaaaccctgttgctctactaaaaatacaaaaattagccgggtgtggtggcggacgcctgtaatcccagctactcgggagactgaggcaggagaatcgcttgaacccaggaggcggaggttgcagtgaaccgagatggcaccacagccctcctgcctggacgacagagcgagacgttgtctcaaaaaattttttttaaaaagtcagctacagcctggagagcaaccaagaagagtaagaaaaaatggtgtcatcaaagtttagggacgtgagtgtttcaagaaagaaataaacccaaattgtcagatagggttggtcaaaataaagacttgaaatgggccttggagaattcttctgtttttgaaacacatactgaaatattttgggataaatgatatgctatctggagttttcattaaacttatccagggtgaggtgagagggagcaggtggagatggtggcaacaagattggctgtgagttgtgactgtggacaccgggcatggaacacgtgggaattcactgcactgttccttccacctataggtatgtttgaaatttcccataatgaagttctttttttatgtttctataacaatcagtagcctgtggatttctcatcacggaaaccaccagtaacctctgcgtgggtagtttgggtggcctatggaggcagaggccaggctgaacggatgaaggagtaagtagaggtcaggttctcaagacagtgaggaaggcaacagacaacttgttcaagaaatttaactctggaggggagaaggggcaaggaagtagacaggggaggatgtgaggttgaaagatggtattttatttttcacactggagagactagaacttggttatagcctgataaggcgagccagcagacaggaaagtttttgaaaaaggagggagcccgagaaagtaggaagcgatgggagggaggttccagaagaagaaactggccttaaatttgataacagctcttcctctggtacagaagaaagtggtcaaggaggccgaggtggaaggataggttgagaccaggagtttgagaccagcctgcaccatagcaagacactgtctctacacaagcaaaatacaaactggttttgcgtgatgtagttccagctacttgggaggctgaggtgggaggattccttgagcccaggagtttgaggctgcagtgagctatgattgcaccactgcactccagcctgggtgaaagagggagaccctgtctcaaaaaaaaaagaaagaaagaaagtgagtgagggcacaggtagtcaaaggtgagtgatggggcatactcctggcagatggcttttcttttccctcttgactggatggtgaggacatccactaagagtggaagtgaggccggccatggtggctcatgcctgtaatcccaacactttgggaggccaaggcagatgaatcacttgaggtcaggagttcgagaccagcctagccagcatagtgaaacctcatctctactaaaaatacaaaaattagctgggtgtggtggcacacgcctgtaatcccagctacttgggaggctgaggcatgagaatcgcttagacccaggaggtggaggttgcagcgaaccgagatcacaccactgcactccagcctgggtgacggagggagactccatctcaaaaaaaaaaaatggagtagaggcaaagaggcctgaggccagaaacagtggagccaggtgtggtggcacaggcctgtagtcccagtgactcaggaggccaacgtgagaggatcacttgagcccaggagtttgcaaccagcctgagcaacatgatgagactgtctctacaaattttttttttttttttatggagtcttgctctgtcgcccaggctggagtgtaatggcatgatcttggctcactgcaacctccgcctcccaggttcaagagattttcctgcctcagcttcccgagtagctgagattacaggcacctgccaccacgcccagccaatttttgtatttttagtagagatggggtttcaccatgtggaccaggctggtctcaaactcccaacctcatgatccacccaccgcggcctcccaaaatgctgggattacaggcgtgagccaccacgcctggccaagaaatttttttaaactacccacgtgtggtggtgcatacctgtggtcccagccagtcagaaagctgaggtgagaggattgcttgagcccaggaattcaaggtttcagtgagctatgatcgggttactgcacactccagcctaggcaacagaacaagaccttgtcaaaaaaacaaaaaacaaaaaacaaacaaacaaaaaaaaacagcccaggcatggtggctcacgcctgtaatcccaacacttcgggaggctgagatgggaggctcacttgaggccaggtatggtggcacacacctgtaattccagctactcgggaagctgaggcaggagaatcgcttgaacccaggaggtggaggctgcagtgagccaagatcgcaccattgcactccatcctgagtgatagagcaagactctgactcaaaaagaaaaatttaaaaattaagaaaaaaaaaggagaatatttgaaaatgagagagttcactagaaaacactgtgaagcagtgtcgaggatccaaatgacatgggtggacatgaaaacgacatgccccgttttgtgaaattttccagcaatactcagcagcctggttctgagctcacgagaaggtccaggctcattccactgatggaaggttaccaaggatgtggataggacaattgaacaagagagtcaagaactgtagttcttcaatgttgccgaacaaattacatccaaatttagcagcttaaaacaacaagcatttatcatcgcacacagtctctgagggttgggaatcctggagcagctaagctggacagctcctgctcaaggtctgtcacagggatagggtcctcttcaggcttgccggggtggaggaccagctcccaagctcactggcatggttgtcagcaggctcaggtttattgctgattactggcaggaggccttgccactgggctctccataggactgcttacaacatggtaccgagcttctcccagagtgaaaatctaacggagaaaaagagagagcgccagcctaagatggtggcatttcatagcacaacacatcatctcaaaacttttacttgcctttgcccatcgcccatcagcttcctgaaaggggggactgagtgtgtctgtcttgtccactgctgtacccttagaggagtgctaggcacatagcagacgatcgagtttttttttctttatctcggctcactgcaacctctacgtcctgggttcaagtgattctcctgcctcagcctcataagtagctgggaatacaggtgcatgccaccacgcccagctaatttttgtatttttagtagagacggggtttcaccatgttggccaggctggtctcaaactcctgaccttgtgatccacctacctcggcctcccaaagtgttgggattataggcgtgagccactgggacttgttgttgctgttttttttttttgttgttgttgttgtttttgagacagggtctcactctgttgcccaggctggagtgcagaggcatgatcatagctcactgctgcctcaaactcctgggctcaagcgatcctcccacctcagcctcctgagtagctgggattacaggtgtgaaccctgaaaatctgagacaggttccagtaaacttagaaagtttattttgccaaggttgaggatgcacacccgtgacacagcctcttaaactgaaccttgggagttcctgacaccgtgtggccaaggtggtagggggagagtttggttttctacattttaggagacatgagacctcaatcaatatgtgtaagatgaacatcggttcagtctggaaaggctggacaaagcgggacaactccaagcaaggaggggcttcaagtcacagtagatgggagacaaacagttgcattcttctgagtttctgatgagcctctccaaaggaggcaatcagatatgcatctatctcagtgagcagaggggtgactttgaatagaatagggggcaggttgccctgcttgacttttccctttagcttagtcattttgggaccacgagatgtattttcccttcacacaggcatgagccattgtgcccagctctaaaatacatctttaagtaaatgaatgaaatgagtgagtgaaacccaccggagaaaactgtagctacactcagtgaaaaactttctttttgagggaggggcagatcttccatgggctggattataaatttttataggtgaccgggtgcagtggctcacatctgtaatcctggcagtttgtgaggccgacacaggcatttcacttgaggccaggagtttgagaccagcctggacaacatggggaaaccctgtctctactaaaaatacaaaaattagccaggcgtggtggcgcgcctgtggtcccagctacccaggaggcggaggtggtgtcagaggtgtttgaaccagagcaactgcatcttgaataggggctgcgtaaaatgaggctgagacctactgggctgcatccccagcctgttaggcattctaagtcacaggatgagataggaggttggcaaaaaatacaagtcatatgctggccgggcgcagtggctcacacctgtaatcccagcactttgggaggccaaggcaagcggatcacctgaggttgggagttcgagaccagcctgaccaacatggtgaaaccctgtctctactaaaatgcaaaaaattagctgggtgtggtggtcgcgcctgtagtcccagctactcaggaggctgaggcaggataattgcttgaaccctggaggcggaggttgcagtgagccgacatcccaccactgcactccagcctgggtgacagagcaagactctgtctcaaaaaaaaaaaaaaaaaagatacaggtcataaagaccttgctgataaaacaagttgcagtaagaagccggccaaatcccaccgaacccaagatggccatgagagtgacctctggtcgtcctcactgctacactcctgttagctccaagacagtttacaaatgccacggcaacatcaggaagttaccctctgtggtctaaaaaggggaagcatgaataatccacccctcgtttagcatatcatcaagaaataacaatgacaatgggcaacccgcagccctcgcggctgctctctctctggagtagccattcttttattcctttacttttcctgataaacttgctttcactttacagacttgccctgaattatttgttgcacgagatcaaagaaccctctcttggggtctgggtcgggaccgcttttcagtaacatctttctggtgatcacggaagagactatagtgtggaaacacccgacccaaaggctaactttgagcccggtgtggtggcacgcacctgtaatcccagctactcaggaggctgaggcaggagaatcgcttgaaccccagcgacagaggttgcagtgagctgagatcgcaccactgcactccagcctgagcgacagagcaagactctgtctcaaaaacaacaacaacaaacaacaacaacaaaaaaccaaaggctaactttgggtaagtgatggggttcagtaacatctttctggcaaatcatggaagggacgatactgaagaaacccccgacccaaaggaaatagactggagcactgattggccgactttgggtaagtggtggagtactctggtaaagggtgggatgggattagaggcccaatttaggggaattagagtctctcctaagacagagtgggatagaggcccctcttaataaaaggcaaggacacggtgaaaccccgtctctactaaaaatacaaaaaattagccgggcgtggtggcaggtgcctgtaattccagctactcaggaggcaggagaatcgcttgaacccaggaagcagaagttgcagtgagccgagattgcaccactgcactccagcctgggcaacaaaagcaaaattcggcctccaaaaaacaaaaaaaaaacaaaaggcaaggacgcttgaccgaccttgggttagaagcccaacttaggagggttggagtcccttccaagatttagggggttagaggcccctctcagtaaagtccctttcagctaagaacgggtttggcactatgggatgttaactgctgttctctttagattaatctgccttgcactctttgctgatggctgtgggtgacagcattaagcgtgtacaggatcgtgggacatagggagcttttttctccctaaaaggggaaacttgagagctgatgggacttctggaaaagatcccttcacgaccgacaagcagccgcctggacttttcagtgtcactgcaatgggtgggtctttctctggcctccccgagcacctcaccttcctcaccttcctcaccttccccaccctgcctcaggcaatgcattcctctctctctgtgcaaatgggttaaatggtaaaaatcactgtttatctcctctatgaagttttgatgaatggaagaaaggatttgcgaggctaatcttaaactgtagtgaatctggtgtgctttgcctgtctttctgtgttctgtgatggagaggagtatcttaggacagaatgagggcctaggacacctataagcccgctgttcagagacggcccagcacactggtcagttaaaaacttcggccgggtgcggtggctcacgcctgtaatcccagcactttgggaggctgaggcgggcaaatcacaaggtcaggagttcgagaccagcctgaccaacatggtgaaactccgtctctactaaaaatacaaaaattagctgggcgtggtggtgagcgcctgtaatcccagctactcaggaggctgaggcaggagaaccgcttgaattcaggagatggaggttgcagtgagccgagatcacgccgctgcactccagcctgggcgacagagtgggattccgtctcaaaacaaacaaacaaacaaaaactttgctgcaggtccctgaaaaaaactggatgaggttcccttcttgtcttgtatgtccttgggagctcgaccttgtaaccatgtggctgtgctttctctttccacagtggcagcctgggttcagggtccaattcctggcttgaggaatgagtcctttatcttctgtctgtctgcgtatttatgtgtgtcgtgtgtgtgacgtttacatataaaagagcttgggttgattggcttaaaaacaagtgcttaaatcaaatattttgacagaaaagtataaagtataatgccttttagttcatgtgacttaagtaatctttgggaaacagttttaaagattattggtaaaataaaaatatcttcaaaaatgtaaatatttggtctaacttatgcaggtcagatgtttgctaaatgctttgaggttataaactgcttctttgacttttggaaattgttcagtttacctaccttgctgtgtatgaacatattggctaaagttgggtattattcagtttttgcataaattaaacattggaaaaaaacacaacaggtttttcctgaagcaaaaatctgcttatgatctgctctttaacaaaaattgtaaagggttataaaaagtttatgagaatcttaccttagggtcaaacattaaaattgggtaaatgtgtctatagggttttattaagaattgggtttggctgggtgcagtgaatcacgcctgtaatcccaacactttgagaagccaaggcgggaggatcacttgaggtcaggagttcaagaccagcctggccaacatggtgaaaccccatctctactaaaaatacaaaaaattagctgggcacggtggcacgtgcctgtaatcccagttactcgggaggctgaggcaagagaaacgcttgaacctaggaggtggaggttgcagtgagccaagattgcaccactgcactccagcctgggcaacagagccagactctgtctcaaaaaggggaaaaaaaaagaattgggtttaacattaatagtacactaatgtaaaggtgaaattcggcttatttggtacaaaactcatacaggaaacattgtcaaatatgaaacggtgtttgcttttctttgggctgtatttgtataaatgtgttattggcatatgttccaaaataataggaaattcctataattctgatatgacttagtatatgttattaataattataattgttacagaaaatcattgtatgccacagaggtaaccaaaaaaccaaagtcttatctaagatttcttctatggaacagagttccatcaaagccaatttaaaaacagcttatgtgggccaggcgtggtggctcacgcctgtaatcccagcactttgggaggccgaggcaggcagatcttaaggtcaggagatcgagaccatcctggcaaacacagtgaaaccccatctgtactaaaaatacaataaaattagccagacgtggtggcgggcgcctgtagtcccagctacttgggaggctgaggcgggagaatggcgtcaacccgggaggcaaagcttgcagtgagctgagatagcaccactgcactccagccagggcgacagagcgagactccatctcaaaaaaaaagcaaaaaaaaaaagcttatgtgaaaaatagttattcttgctgcactttatacaaataatcaggccaaagaaaaacatcctttgtcaatcatgtttttgactgtggctgtcctaagacattttgccatccacagacaattgttgtcttaatactctttaaaaggtggtttataatcaactagagaactctaacaggtattcttaaatgcaggtttctgataactttggaaattgtgatattaaaatagaggaaaaaactttcagaactctcacagagaactggaatgtccgtgaatatcaaacacagcaggagataactgcagcagctcaagtcagtaattctgaagtcatctttttgactttgcttaaaatattattgatcctttgttttgcttttcagagtcaagaaaacttttcttttgagctatttgcatttttttcttttttttttgagacggagtcttgctctgtcgccccagctggagtgcagtggcgtgatctcggctcactgcaaactccacctcccggggttcacaccattctcctgcctcagcctcccgagtagctgggactacaggcacccaccaccatgcctggctaattttttgtatttttagtagagacggggtttcactgtgttagccaggatggtctcgatctcctgacctcgtgatctgcccacctcggcctcccaaagtgctgggattacaggtgtgagccaccgcgtctggcctgcattttttaacaattgagtaaaatatactcctatgaacaaactttggagcatatttgtttctctgtacctgctttctccagaatttgcaaactagagagtattcttaacttatggcaatatagttatttgcctaattgcaacaataatttttcttttgtaaccggacacaagtggaaaagctggttattttaccaaggctttaaccggaatggtgtgtttttcctttaaggaattaaacttgacttacagagccaataaaagccccttgggaaaacaggcctcataccttgcccacacagtccctgtacagggtttctgacccatgggaagtaaagaatgtcactttccaacaggcccaggagccccaagttatctgggatcccaagatgggaggaatgtactcatcccacaggtatttgaggatacaaacccatggcagggctcggctctgaaaaagtcttatctaagattccttctgtggaacagagttccatcaaagccaatttaaaaacaccttttgtgaaaaataattattcttgctgcattttatacaaataatcagaccaaatacaataaagtaaatcggccttaccatgatttgtatttagtaaaaatgagaaactggagagagaaaaattatatttcaagaactataatacacctgttattagattctagtctcatgagttgtttttaagtttgtttctgtaatttaggctaaccctgcttattcctgtgaaccaaccagtgatctctggctgcagctcaaaaaaaaaaaaaaagggatgggtaatgtaaaaatctggatcagtattctaattctgggcatgcattggaattgctaacaaccccgtatcagcttagttccaacagttgcccagttgatgggaagccttctaatttagtttacttggaataattttacttattttgctttactcttgtggaatatattgttgttgtactctttgtgtaaaaatgaggataagtttactcaacgttttcttaaatttaacacttatgatatcaccttctgtcggaattcaagagttatgaatggccctcaccatatggatgctttctgactgagctcctctctaccctgaatgcaaaagacccagtagttgggcagtaatataattgcccctattcagcctgaagaagttgcagaagatggatctttgtccctctgcaactcttaggattaaggattctcttataaaagggaggggggaaatgtcagaggcatttgaaccagagcaattccctcttgagtaggggctgggtaaagtaagactgaaatgtactgggctacattcccaggtagttaggcatcctgagtcacaggatgaaataggaggtcagcacaagatacagctgataaagaccttgctgataaaacaggttgcagtaaaggagccggccaaatcctaccaaaaccaagatagtgatgaaagtgacctctggttttcctcactgctacactcccaccagcaccatgacagtttacaaatgccatggcgacgtcaggaagttaccctatatagtctaaaaaggagaggcatgaataatccaccccttgtttagcatatcatcaagaaataaccataaaaatgggcgacccgcaaccctcgggcggctctgtctgtggagtagccattctttattcctctactttcctaataaacttgctttcactttactctatggactcgccctgaattacttcttgcccaagatccaagaaccctctcttggggtctggattgggacccctttccagtaacagtgggagaatctcttgaacccaggaggcagaggttgcagtgagccgagatcgcaccactgcactccagcctgggcaacagagcaagactctgtcttaaaaaataaaaataaataaaattaattaaggggctgagcgtggtggctcatgtctgtaatcccagcactttgggaggccaaggcaggcggatcatttgaggtcaggagtttgagaccagcctggccaacatggtgaaaccccatctctactaaaaatataaaaatgagccaggcgtggtggtgggtgcctgtaataccagcaacctgggagtctgagacaaaagaatcgcctgaacctgggaggtggagactgcagtgagccgagatcatgccactgcactctagcctgggcgacagagcgagactccgtctcaaaaaacaaacaaacaggccaggtgcggtggctgacacctgtaattccaacactttgggaggtcgaggcgggtggatcatgaggtcaagagatcgagaccaccctggccaacgtggtgaaaccctgtctctactaaatatacaaaaattagctgtgcatggtggcgggcgcccataatcccagctacttgggaggctgaggcaggagaatcgcttgaactcaggaggcggaggttgcagtgagctgagatcacaccactgcactccagcctggtgacagagtgagactctgtctaaaaaacaaaaacaaaaacaaaaacaaccaactaaccaaacaaaatccaaataagtttgcacagaagttcaatggctccctaactgtatgctattatttttaacttttttctccttttgtctttccttttttcaaatttaattagctgatattgctgcccatgaaacagttctcagggttaggacttaacatcttgtgcctttgaaaattcgccttcaaatacaaacacgattttcccattctaaatgcaaaacagaagttccacaaaggattgctggaaagaaagcgtccacttagggccaggcgcggtggctcacgcctgtaatcccagcactttgggaggccaaggaggttggatcacctgaggtcagaagttcaagaccagcctggtcaacatggtgaagcccgtctctactaaatatacacaaattagccaggtgtggtagcgggcgcctgtaatcccagctactcgggaggctgagccaggagaatcacttgagcccggaggcagaggttgcagtgagccgagatcacgccactgcgctgcagcctgggtgatacagcgagactctttctcaaatgaaaagaaacaaacaaacaaaaaacagtctgatatccatactaattgcataattgcgtaaccttaagcaaatctcttaacatctttgattcaacgttacactgtgagggagagacactaatacctccttttatagaggaggaaattgaggtccagtgactggctcaaggtggcagagctggagagagttgaggtgcaactgtgggttcaaggtgctggcaagaggtcccccagcccccagcccctccgtgtcactcactacctgccatctcaaacagtggtataaagcccagtaaaatgtgcatgtttttatatgcatgtacaacccaaatgtaaatgtatattggtttaggtgggaaaaaataattctaaaatttgcaaaaggagttatgtcaaagtccttaaatattgatacgttaaaaagttagtaagtattctgggctgggtgaggtgtctcagcctgtaatcccagcactttggaggccaaggcgggcagatcacctgaggtcaggagtttgagaccagcctggccaacatagtgaaaccccatctctactaaaaatacaaaaattatctgggtgggtgtggtggtgcacgcctgtaatcccagctactcgggaggctgaggtgggaggatcgcttgagcccaggaggtggagattgcagtgagccgagatcacaccacagcactccagcctgggcaacagagcgagacactgcctcaaaaaaaaaaaaaaaaaagggtaataagtatcccttcatcagtgcttaataaatgtattaggaatatgagtaatttctatgcacttcaagataactaatctcaaattcatatggatatatttcagaaaagattgactctaaggaccctcatacagccatggaatgtaccgcttttttttttttttttttggagacagggtctttctgtcagagacaactgaaattttaaaataataataataataaagaactgggaattggggagatgatgatgataatgatgaggagcagaggcttgcccagcttgggtctccagggacacagcaacaagaatgagcccagaactctgcatattctatttcttgtcctcattttcagagatgtattataatctcagttttgcagatatgaaacctaaggccagccaagatatagctttaatatgcatttaaagaaaataatggctcaaaaacaaggtgcaatgctttcattctatgatcagcaatgtagatggaactgacatgtatatacaaagcattatctttaataaaattgtatcaatggttttttcttttgttttgtttgtttttgagatggagtctcgctctgtcacccaggctggaatgcactggcatgatcttggcttactacagcgtccgcctctcaggttcaagcaattctcctgcctcaggctcccaagtagctgggattacaagtgcccaccaccatgcccggctaatttttgtatttttagcggagacagggttttaccatgttggccaggccagtcttgaactcctgacctccagtgatccaccagcctcagccttccaaagtgctgggattacaggtgtgagccaccgtgcccggcctcagtgttcttcttatacttaaaaaaaattcatctcaaggggctttaagaagcaacttaatccccactgaaacaaacaagagttccttgaagaaatggccagggaatgttcaaggaaaggatgtgggcttcaaaaagaataaccataattaattgaaacccattaaataaatatttcatataaagatacatgtatatgaaaagggaggcgggagtgcttcacagacgaatgctagctaataaatggattgacagaataaggtcaacatttgctaactccagtgtaatcgctgattccgtcaaggatactcacaaagtgctaaaaccattaggtgaacagatttttggtaacaggatatttgcatgggtttttaattgaaagcgagaagcgtatctttacaatggcaagttctggcagtctccatcttaacccagtgatcaaagttagcgtcgctaatggtagcacaatctgacgtatgtgccttccaatgtgataaaatttgaaatccacatcgtctagaagtatttttgcccaaaatgtttaacctaaattgaatcaggctcctagaccagcacatgtcaatacaaatatatgtaagccacttatgtaattcaaaattttctggtaactgcatttggaaagtaaaaacaaaagagaaaagcccggggtgaaattagtttaaaaacatactttagctaacccagtatatccgaaatattacgattttaacatgtaatccatattttaaaattaatattttatattcttttttgtactgagtcatgtattttcagcatgtgtttttacactttaagtacatttcaattcagatgctaaatcttcattggaaatacttgatctgtatttagatttcataaaatttgcaattgaaaaactagctccaagttgttccacacatacatttttcctatcactgaattgagtatcagtttttcagtttaaattcaacttaacaaagatgaaatgaaatttaaattcagttcctcagctgtattcaccacattgcaagggctccagagctacatgaggcttgtggctatgatactggattaggcagccctagactgaacttccagtttagaggaaagaaagggatagtagacagacaagttaaatgacaccaagagacaatccagaatgtgggacattttacaaaacaatcgccttagacttcctaaaaaatcaatgtcataaaaaaaataagatggggagattgtcctagactaaggaaacccagagatatagcaaccataggcagcagcatgtctgaaaacaacaaaagcttagacaattgggaaaatttctttgaacacttggggaactctgaatatgtactatatgctagatggtattctggaattattgctagttttcttagttgtgataacagcattatggttatgtaggagactgctttatatctaggagggataatcattctggtggagaataattgtagaaatgcaattttaaccaggtattgaagttgaaaggagcaaaaatattgtgggcatatgagatcttaaaatatataccttctctgcaaaaagttctcttcagtaacttccaggaagttgctgaaggatactcttctccaaaatgaaggagtaagccaagaaaagaatgatgtggaatggaggagcaggtggttcagcatgagtttacaagaccctccaggacaacaagtgggaactagtcttagaaagcagccatcattgactggagcaggaagacaaaaactccaggggaggccagtcgtggtggctcacgcctataatcccagctactcgggaggctgaggcaggagaatctcttgagcccgggaggtggaggttgaagtggcctgagatcatgccattgcactccagcctggacgacacagagagactctgtctcgaaaaaaaaaaaaacaaaaaaaaaactccaggggtgatgtttccaagaaaaaaaagtactgacaggtggatcatgtgatacatttggccatattgtggagagttttataactctgtaggagaatttccagggaaaaatggataggtatgttcagtggtgtattggtaaaccacctctctgaaaaataacaacaaaaagcccaaaaaacaagaggccctgatttgtagcattgtttgatttctgtggcataaatacttccaccgtagctgatttcaaactaccaacatttgcacgcagagttggcaaaggatgtccacaatcggctctcaagggccagtaagagttggcttcaacaaaattcagcaaataaacaaaacagttattaactccaggaacaataaaaagttttataagcaatgaaatcatagtactatgcatggctcagctatgagcaatacttacaccatcacgacaatgcacacactgaatgctggtttaactttttttttaaatttattttatttatttatttatttatttttgagatggagtcttgctcttgttgcccaggctggagtgcagtggcacaatcttggctcactgcaacctctgcctcccaggctcaagcgattctcctgcctcagcctcccaagtagctgggattacaggtgcctgccaccacgaccggctaatttttgtattttcagtagagacagggtttcaccatgttggacaggtcggtctcaaactcctgacctcgtgatccgcccacctcggcctcccaaagtgctgggattacaggcactagccactgcgcccggcggttttaacttttttaaaatgtgatgtaaccacactgagaggatgagggtagagaagggtgcagaaaatggagctaaatattcattatcaatagataacacctcaaatgaaaaaaatcaagaaatagcagaatgaacattttatttagaaataagaaggtaaactggcagaagaaagggccaaaagagaccaaagttattacctgcagggtgcagaactccagcgtagagagaaatgtgcagaaagaaaagagctggctttttttttttttttttttttttgagacggagtctcgctctgtcatccaggctggagtgcagtggcgtgatcttggctcactataacctccacctcccaggttcaagtgagtctcctgcctcagcctcccgagtagctgggactacaggcatattccaccacgcctggctaatttttgtatttttagtagagacggggtttcaccatgtcagccaagctggtctcgcactcctggccttaagtaatccaccctccttggcctcccaaagtgctggagttacaggtatgagccaccatgcccggccagctggttttctttacaagccctgtagtactattagacttacacatatgcacacactcatgtgagtactcacatacacaaatactactgaggcagacttctggttatagaagactgaacacaaacttttatcactctttcctccaaaacctattgaaatgacagaaagaatataaaaggcctggcacggtgactgacgcctataatcctagcactttaggagggcgaggcatgtggatcacttgagctcagcagttcgagaccagtctgggcaacaagacaaaacccttctctaggctgggcatggtggcaggcacctgtagtcccagctactcagaaggctgaggtgggaggatcacctgagcccgggaggcaaagtttgcagtgagccgagatcccaccactgcactccagcctgggcaacagagcaagacctgtctcaaaaagaaaaaaagaaaaaatatatataaatatatatatttgttattgattatatataaacttgtatatgtatatatttattatttatataaatttatatatataaataagctggtaactgctgggaagccaggagaatgcagcagcagcaaaccaagacagttaaaattttctgagtacaagacacttggaatcacattgatttctaatcccaacatattaaaaacaaccccagacaagccaaagagagaacctcaaaaagtaagttttgccagcaaagcccccatcccaaacccctaaagtgacgtccctgtttcccttcagcccatcctgtagcctgcagataaccgcacctctaggatgcgattcctgacactgcacttcctcccacaggagggaatgaaagcggaaactccgggcggggtcccaggggactgacagccaccggagggaaggcacccctttaagagaacagttttcactgggcgcggtgactcacgcctgcgatcccagcactttgggaggccgggccctgtggattgcctgaggtcaggagttcgacaccagcttgactaacgtggtgaaaccccatctggactaaaaatacaaaaattagccaggcgtggtggcacatgcctgtaatcccagctacttgggaggctgcggcaggagaatcccttgaacctgggaggtggaggttgtggtgagccaagatcacgagccgagattgcgctgctgcactccagcccgggcaacgagagtgaagctctgccttaataaatcaatcaatcaatcaatcaatcaatcaatcagaggttctgctctgccactaagctaaatggccacctcactcccggcttctagaatcattacttttcttttttgagacagaatctcactctgtcgcccaggctggaatgcggtggcgtgatctctgctcactgcaacctccacctcccaagttcaagcgattctcctgtctcggcctcccgagcagctgcgattacaaacgcgccaccacgcccggctaatttttgtccttttagtagagacagggttttaccatgctggccaagctggtcttgaactcctgacctcaggcgatccgcccacctcggcctcccaaagggctgggattactggcgtaagccaccgcgcccggcctggaatcataacttgtatcgaccgccagacacacagggagtcagtctcacaagacaacatgataaaaacacaaagcacaatataaggcgtcagactggagaggccacggccatgattcctagcagggaatcctgaagagccactcattttgttcttgccagacgtgtcctgaatgctgtccctttccagacctggttcttcggctttctcttcaattcggtaagtttctccacatcttcccaacagagggaagaccttttcttcttgttcgtgataactagagtcagagtctgttgcttgcaatgaaaaaccattacaatacaaatatggctgaatgataagcttgaccgaatgctattatattttacatacttatatataacgataatatacaacatattacaattgataagcttggtttaatgctattatagagaatgcacattctttccaaatccccatgtaacaggaacaaaacgatatctttttttttttttttgatacggagtctcactctgttgcccaggctggagtgcagtggtgcgatcttggctcactgcaacctccacctcacgggttcaagcaagtctcctgcctcagcctcccgagtagctgggactacaggcatgcgccaccatgcccggctaatttttttgtatttttagtagagacggggtttcaccacgttggccacgctggttttgaactcctgacctcaagtgatccacctgcctcagcctcccaaagtgctaggattacaggcatgagccaccatgccaggccagaaatgatatctcttaggtaagaccacacacacaccccacatacaatcaataaacccccaaaagtagaaataaacaggccacagtataagacataataagacaaaaaatagaaatgaacaacaaaagcatatccaatcatattcacttgtgaaataaaagctgaaattatacaaaatttaggaaagattaacaggaacattacctctatgacaatctgatataatgaacaataaaatgattctcagagggaattttatagtcataacgacattcattagaaaccaaaaaagacggagaaaaagtgaatgaagtagtcaattcaaaaagctaaaaaaagacaatagaatagatcaggtaaattttttaaaatgtaaaatagaaaatgaaataaaaaatagtaaaaccaaaagttggtctttttagaagaaaaaatattcaaaattatgaatgagaaagggagtatagaattattttcaaaatcatgaaagtatgttttcattatgagtcaagaatgcctacttaggcaagacacaagatcaagcaccataaaaggaaatattgacatatttgactctgcaagaaaaaaagagttaaaacgtttgagaaataaaagaccccataaacaaaaacaacaaataagtgaacatgcagaaaatattcgttacatatataaggactaaaaactatgcttgtaaagagctactttaacacgaaaatcacatacacaaccaattttatttatttattttgagacagagtctcactttgtcgcccaggctggagtgtaatggcacagtcgacttactgcaacctccgcctcctgggttcaagcaattctcctgcctcagcctcccgagtagctgggactgcaggtgcacactaccatacctggctgatttttgtatttttagtagagacggggtttcgccatgttggccaggctggtctcaaactcctgacctcatgtgatctgcccacgttggcttcccaaagtgctgtccccaaatttttaaacacacaaaagctatacaaagttaattcttagagaaagaacggtcaataaacatttggaagaatgctcaaccacagtagcaatcaggaaaagtttaaagcaataagataccatttccgcccccatgagattcagcttagagacagggtcttgctctgtcgcccaagctggagtgcagtggcacaatcatagctcactgcatcctcaagctcctggactcaagcaatgcttcctcctgcctcagctacccccaaaactccccaaaagctgggattacaggcacatgccactgagcccagctaattttgtttttttttttggtttttttttttgttttttttttgttttttgttttttgtttttttttgacagagatgggtgttgggaggagtctcgtttgttgcccaggctggtctcgaactcctggcctgaagagatcctcttgctttggcctctcaaattgtaaggggatcgcaggcctgagccatcacgcccaccctcccccaaattaaaaaatgtgaacatatgcagtgttgaaaaggtgaggaaacaggtaactctcccatacagttggtggggaatgtagattgatagtatttttggaggacaaattagcagtatgtattacattttaaattgtgtatacccctttaaatcagttattccacttccagatatttaccctacagaaatacttgaacatgtacacagatatatatgtatgcataaagatgctgattgaagcatttttggggattagtaaaaaatggaaactttcagaaatgtcaatcagaggccgggcgcggtggctcacgcctgtaatcccagcagtttgggaggccgaggtgggcggctcacgaggtcaagagatcgagaccttcctggccaacatggtgaaacgccgtctccattaaaaatataaaaattagctgggcgtggtggcgggcgcctgtagtcccagctactcaggaggctgaggcaggagaatcgcttgaacccgggaggcggaggctgcagtgagccgagatcacgccactgcactccagcctgggcgacagagcgagacgctgtctcaaaaaaaaaaaaaaaaaaaaaaaaagaaatgtcaatcagaaagaaaagaaaggattactaagcagtcattaaaatgaatgagtaaatctgtagtacataaatcaaacaagttcccagatatatggcaaaaagtaaattactgaatgcaaatgatgtggtacagtgtcatttcagcgtgtatcacatacagatacatgtatacataagcgtggaggcaagtgtgacatagagcctttcattatttaccccatatattccagtgttgttttaattaagacaaaatataggtattcgtgggataatttttttttgtttttgagacgaagtttcgctcttgctgcccaggctggagtgcaatggcacgatctcggctcaccacaacctccacctcttgggttcaagcgattctcctgcctcagcctcccaagatgggattacaggtgtgtgccaccatgcccagctaatttttgtatttttagtagagacagggttttgccatgctggccaggctggtcttgaactcctgacctcagctgatccacccacctcggcctcccaaagtgctaggattaccggcatgagccaccgtgcccggcctcgtgtaataatatttaattaagaaaaagccgggtgccatagctcatgtctgtaatcccagcactttgggagggtgagacaggaggatcactttagtccaggagtttgagaccagcctgggcaacaaagtgacacaccatcccccacctcccgtctctacaaataattgtttttaagaaggataaagaagagtttgaaaagagagacatcaaactgttagttatatttaccttaaaaaggagagaaagaactgagatttttactttcctttctataactgttaaacaattaaaaatggaaatattatatgcaattttgtgaaaataaaaattttaaaataggccaggcgcagtggctcacgcctgtaatcccagcactctggaaaccagaggcaggcgtatcacctgaggtcaggagtttgaggccagcctggccaacatagtgaaaccctttctctactaaaaatacaaaaattagccgggtgtggtggcaggcgcctgtaatcccagctgctactcaggaagctgaggcaggagaatcacttgaacccgggaggcagaggttgcagtgagctgagattgcgccactgcactccagcctgagcgacaaagtgagactctgtctcaaaaaaaataaaaaataaaaaataaatcatccttatgaaaatacttttcaaagacaaatgaaatagaccccaacaatgtctactctagcaaattttcaaagtcataataaaaataaaataggatgactcggtggtgttttagctggtacttttccagttttccttttacaacataatcaacaatgacttcaaaaggatttccccctccttcatggaatattactaccttcaacacggcctttcagatccggagttcaaagcatagttagcattataatttcagcagagaatccagaattggcaggatatcaccagtagggtgactttttttcttttccctagcaaacagtagagcagtatgtagtttctccccccgcccagacggagtttcgctctttctcccaggctggagtacagtggcacgatctcggctccctgcaacctccgccttccgttttcaagctattctccttcctcaggctgccgagtagctgggattacaggcgccccccaccacgccaggctaatttttgtatttttagtagaggcgaggtttcaccaagttgaccaggctggtcccgaactcctgacctcgtgatccgcccgcctcagcccccaaagtgttgggattacaggcgtgagcctccgcgcccggcacagtatgtagtttctaactacaatttcaaaaacaaaaacaaaaaaaccccccccgcccccgcaaaaaaaaacctcaaaaaaaaaaatgtgacacataaatacacaaccttaactgtgtattttactgggattgtagaaaggtatcaaatgggcatgcaagtaaggtccttacggagtaagaaaacgcccaatgaacagtacttaatatgaattcgacatcgttaacactgagcgcttgctgtgtgccagcgcgcagcataattcgaagcagcatgactttgcacaatgacatattctacaagtccagtttcctaaggagtgcccttaggttacatataacctaaacgtgaaatgtagaagtacataaaggaggcataaagttaaaggggaaaaattataaatactagaaaaaattgcattgtattattttgatggctgaaaaatgggctcgaccctgcatgcacgcgttctccattgagctcgacaatatgcagtattttgtttcacgttatgtcgcagtcttagggaggagtgaaacgtggaacacgacttcacatcaaaaatgcacgttgcagaggcatttttccttcggggacgccggaagacttcgccacacgcgcgccctctccgcggacaccaacgtgctgacgcatgttcattagcgagctgctccctccattttgtccccagtctcctttaggcgaactgcgcggttctatgttaaagccacttagtaatgaaactataaaagggaggaagtggggtgggcgtgggagccccgtttgcgcaaggcaggcgcgggggactaaatggctgctggtgcagagtggggctgccccggcaccaagggctcgtcccgtggccggaaggacaaaggacacttaggggacgagggccgccgagccagcgcggagcgccttccgggtcggtgggctggggcgggctgggggctggggccgggccgacccccgcggtggggcccaccccgcaggacaaagcagcggccccgcccctcggcgcgcgcccgaggctcgtgcgtgtgagcacgcgcgccggagacggttagaaatggcggttggggcggagcagggggctggcgcgggaagcggggctgtctggctcggttacgcccccacctcgccaggaatctaggagtcggtttgttttccgaacccatctccttccgctctcccgcccctgcaggctgtgtgccgagcttggaagaaagtgtgacccgttcgacggaacaaaggacatgacagcccggccccgtgcggccactgcggagcgttaggaacattccctaaaatggcggccggcgcgtcggaacagggcgggaggcggcggcgcgtgggggcgggacggggaggggcgcggccagccgggcttctgcttccgcgaccccggcggtgcagggcgggtggagtcgcggagtagtcctcatggccgccccgccggagcccggtgagcccgaggagaggaaggtaacctgggggtcggcggggcgcgcgccgcgggtgggcggtgggtaaggacgttctccgcggagctcctaggcccggagcacgtgtcactggcttctctgccacccatgggcttgaaactattttaactgttcctagtccttatcccaagcctccaacattttaatctaagtggccgggacaaaattgaccaaaactagggggaggaggggaccagtagtactaatgacttactacaggtcattatgaaataagctaacaatactgaatctttggcgagaaaattttgctgctaagggcactgcactgtaatttgttagtaaaggctaatagtagagattaaagctccgttgaggacaggtgccttgtctttaacacgttgtattcatcacatttaacataggagtaattgctgagggatgacttgattgtactacgatgagatgaagggttaagatttcttccccatcaccagtagcctccctagctggtgtccctgtctccatactctcctgaatccaccttccactattgtccgctggccctttccagcctgtaaactggacagttttcattcctctgcctaacatccagtcgtagcagcccatcctatctctttaaggataaaacccaaattcttggtatagtaaagctaaaccaagcgctctccctggaagggctcctgtgtttcaccaaagctgacttacgtactttccccatcttcccaggcatcttgtacgtcgttacatttatcatattggaaggtaataaatgatcttgttttcctcttttcctgggctccttattaagagcagggaacctaatttatatcctcagggcagaacaggtattcagaaaagaataatgcaagaggaaaaaagtttaatataaactagggagatcgtaacattggctaatcacgagcaaatatttatagaagacccactgtgtgctaaatggctcctaatatatacttaagatattctcccagcttggaaattctgctcacttcttgctcttgcttgcttctctggtgggcttccatccaaatttggccatgacatcagatcatatggttaatattaacaaatattgtataaattgttttcatacttaatatccaacaggttgtcagtttacgtactactggtgccttatctgtttttactgtcccatacactgcccatctggaataagcttagtgtttaaaaaaaaaaaaagatctttgcatacacacagtaaatcctagattcagttttgtgataaacactggaatcctgaatgggacttttggtaggagataactgctgtttttaaaggtcataaaggtggtttaatccattggaaattaaaaaaaaaaaacttaaaagaggatcaacattgacctatttaactggcccatcagtaagtagcaaaacaatactgtagttgttgaaatgaagatagttataagcctcaaaccgagcacagtcagaggtgggaggccaaaaaaacaaaaattgctcatgaaacagtagtacctatcagagcccatcaaaaagctaattaaattaatagaagctatgatgaattaacagcccaaggtgctgtcagaaaggaagcctgcggttattttttttaaaagaatttgtcagtgatcattccagcacaacccagggaggattattttattataagaattagcaaacctaaagtaaaaatgggagttaccaagctggcataccttgatagaactagcccctaaaaactgtcctctgccacattcttgtcctttaagaaactttaaaatgtgaaatttggtacatacaggtaaattcacattcaggtaaattcttaattcacccattcaaaaaatatttagagtacctactgagtattagacactgaacgaggtactagactgatcaagacaggaaaaatccctttaaggagctgacattctactggaggaatcaataagcaagacttctactgagccagtcatgcaaagatccaggagaaaggcagcatgtgttcgttcggtaataaccatctcggcttgttagaatggcaaggccactgtacctggactagtggacaagagtaggatatgaaagagcatgggatcatgtagggcctttggagcaatggtaaggattctgagcataatcggaggctacagaggacttattatagtcatctgatacacatttttatgagtagaatcaagatctgaaaggtactgttgatagatggtaatttgataggacaggttgagcttcccaattcaaaaaaaaaattgtcttttgatgtatcagtttcagatttgggatgctcaacctgtattagcaatgaagttggtgggcagtggtctggctcaggatgtatttagaatgtggatccttccagacttgctaatatatttgatgtggatttgatgaaggaatcaaggatgactcttagtttttgggtctgaaaattggttgagtagtgtgccattaagaggaaggtttggaggtgaaaatatattttgcaaatacgaggttcaaggtgctttttatacataaaagtgtcattcattaagcagatgaatgaggctgaagcttgggagagattagggtttgatttagaaatctggagtcatcatataatggcatttaattgaaagccttgggatacctaggaagagactagattccaaaggagttaagagtggcacttcagaatcaggtctgtagaggagggaacagcaacaaaaatgtcaatgaaatagaaaaccaggagacgtatttgaagccaagtaaaagtaaaaaagtttcaaaaacaaatgataatttgtgccacatatgctgagatgcggatttagactgcagtggatgtcttttagaggtcttgactggtgtcaagtgaagttcagtggatagatgcctcactcaagtgagttaaagggagaatgggaggttttaagtagaaaagcacacctacactcagaagttttgccccaaaaggatggtggtttaggtggctgatgagaggagaggggtgtatagaggatttttgggttttttttttgagatggagtcttcttgctctgttgcccaggctggagtgcagtggtgccatcttggctcactgcaacctccgcctcctgggctcaagcgattctgcctcagcctcccgagtagctgggattacaggcatgtgctaccattcctggctaatttttgtacttttagtagagacagggttttgccatgttggccaggctggtctcgaacttccgacctcaagtgatccacccactttggcctcccaaagtgctgggatgacgggtgagccactgcacctggccaagagggctgatagtaaattattgcaagtgaaaaaactaacgatgcaaatgaaaggggtagctatagaagccaagcccttgagtatgcaagaggggaatcaagtgcccaagtgggaagactagcattagataggaatagggccaattcatcctttgcaaccagaggaaagaaatacgggcactgaagcagatttagtggtggaaaatcaactgtctctaatttgatcagatctatttctatacattattgacattctggcttggaaatctcttgagctttccttagattgatcagggtgagctggtaaagctgcttttctaaatctaagcttaaaaaatgtctgacatttccttaatttatttttaagggttcccgtttgttagtggcaaagagttaaatcttaagtatgcaggctacttaaggaatagaagagaaatgttaaaggcatgtatattatgaacagaatatttccgtatataaatagaatacttcaaagggagttatgcccgggatcctttattcatctccacttctgagcattttacagttcagtgtacttaactgtaaaggtatacaggctcaagtcgttgcatattcttcctgttttgatagaaattgcagggatttatgtactgaatcttattactccttagatatgtgacaactggaaagctccccaccaaaccctccagccttggttacttcttaatgatgtggtttggcacaatgaaaatgtcataggctttgtggtgaaactgacttctgcctccactcctgccaacacttattattagcctcttaagtccccgagcctgtttcagaggtaatctcacacaaaggctagagaattaaaaaacatgtagagagcctggcactaatacctacctcccccaccagcagctcttaattatgagatcaaccactattattttagaccagagttttgttggggattgggtttgtttcagaaggcactattttaaataagatgtgtagcttctatttagatatttgcctttaaagtcagctgagctattttcctattgtttgcaaatttacttttatttaaaaaaataaaatttcctaaagcagtgtttccccaatatgacagtcatcagaaaaaaccacctagagttttctaaacatagattccagtgattgtaaatcagaatctgagagtgggactagaaaatacttaattctatcctgtggtacaagctggtctcacacttgcatctttgcacctaagactagatcaaactggtactaatcctctggccccagcatcccatccttggggaaatagtctagtttagaggtagtcctggactggagcgctaagtccagcattcctcacctgcataacactacccacatgatcatatgtcccctgggctctcaagctgataggaaaaagtcgtcttgctaaatgaaatcccccaacctcttggtaatgtgaagaactgtactgcaaagctttgaagcaatcctatgttaggcatgcgggtgggaacggggccagacagagggaaaaaatggaatagaatgatccgagagtaaataattcttgctttattatgaaccaagtcacattttgtctcttccaacagatgcttgagccaaaaaagcaaacataggcagaaatacaattgagaatatcttcatgtttcaacctttaatctgacttgccttttactatcctttccccatttcttctaatctcttttgccttacaatatattaccttctaggtatcacctcatcctatagaatcccttctagtttaatgtcctgccccaaacaatactaacccattgaagataactatgaaacctttaaatggacagtggttccttttaaaagcagccttactgaaaattttatatacacttaaatcaagtaacagttaccgtgagttttctaaacttttgtgttaacagaaatgccagttcagcagtgtgactgttacttttaaatgtctgtcttgccgccctagagtgacagacatcccagttaaacatattaggaataagaaatacataaatccaatgaagactgtagaaaaagaattttagcacttgaaggaacttcagtcatttaacccaacccattcatgttatagattgagaccatagaaataaaagtagcctataggatacaaaagttagcggcagatctgagataaaaatccagctctttggatccccgcgtttttcaccacacttagctgtcgttcccatgtattacgaacaaagaatcaaatataatcaagtgcagcctcacttcacaggcaagaaaacagactagagtttaatatattgcccatgtttatcttaaggtgaaacatttactcttacaaccacagttgatgttaacctagttaataaaatatgaaaggtaattactaggggaattttaaacggcactacataagcaaacatgactcaaattactttttccatttctgcttcccaaattattggagttactgaagcaagctatgctgctttcaattccaatgataggcatattcccaaataaactcatttaaagagctcataaaatgaattatcctatttccaagtcagttgattagcaaattaagatacagctccaagttaccctactgcttaagggttttccggtccaatttgtaaggttttcggatttaaagattcagactgcataccaaaggtggacaaagacaacgcaagctgatttaggttgtcacgtggcacatactctagtttaaaccctcaactacaagaaaagaaatggtgtattgtcatttttgccaaagcaccccaaaatgaaatactttcttactcaatctaggttcttttttttcattctagtcccttaagctcctaggatttttagatgttgaaaatactccctgcgcccggcattcaatattgtatggttcattaggatctgttgtggctggctttggacattttttgttcactagtgagtatctgtattttttatttctctatgtactaaaaaaagcatttctctacataatgaactatttttttttctaggtggagtaatgtatataacgtaattatattctaattaattgttatgcttatttttacaggtagaattagaagatcatgtgatgttggagtaggagggtttatcttggtgactttgggatgctggtatgtttgctaagtattcaagaacatccatgattatagtaggttatctaattcaaaaagcacatgctcttttcagagcagtctcccattgggagatcctcaccctcaatgaagaatcttgatttttcaggacattttcatggaaatcttaaaatgcttgaacagataaatgcatattagacatcccattaaaaagaaagctgtggtttttacacttcacttaggaaagcctcaaccatttcccttaccctaatacttatttcatccctgcttattcatatctgaaaatgctactttaagaatgtgtttacaactactgatgagtgaatataaaatatggatgaacctcaaatatttgccagacctaagagtatgatatgtatgtactatatggttccatttatacatgaatttctacagtgagctatttaaggtggtagaaatcattttatgtagacatagcattattatcccgttaaaaacgagagcaaatacttgtttcttataatagccaatgctatcagaagacttaaaaactaatggattttatcactttacaaattgttatgtagacatcctttttttcctaataaaaaaagaatgtgttgataggtattctgacaccaaaactgcccaaaaatagcactataaattagaacatatttttcagtctcagggtagtagtcatctgtatttaagttttgtgtgatttagagaaatttcataaattaatttctgtaggactttatattaacaatttattcatattcttttcttctaaggtttcattgtaggtataattatgcaaagcaaagaatccaggaaagaattgccagagaagaaattaaaaagaagatattatatgaaggtacccacctcgatcctgaaagaaaacacaacggcagcagcagcaattgaacaatcttgagcatagaagtcaatgtaaacgaagttaagatcaaccacataaaacatttcatgtgcaataagctctcaatcaagtaaataaagtttaagttgtagtcatttttttcccacacttgtgtggaatgaaaacttgccagtttattctggccctgtgtctactgccaggatagcattcttacgtgttacatatagtggacttgtcatccttaaaatgtgaacagaatttattggcagtgtggcaaagaattataaaacatagtgtttaatgtacttggagtttccttgtagtagtaagtatagagtttgatgataagtaaacgtcccttaacaaaaacctcaaccttattactatcccattaaaaaacagcaaatacttactgagttcttgtaagagctaatgtcattgtaagatttaaaactaagggcttttatcactttgcaaattattttttaaatgcattcatcatttgacagtgttctctcatttcttaaaatgcgagtcatcttccaaaagagttgtttttaactgccctaaacatttttggggaagtatgcagggtttaaatttttaagtataattagttctgaattaaaatatgcacatggaacttgtctggcagactgatgcaatagtaaaacaactgcagaattactattaatgtaaacaatccatttgaaagtcaatcagctgctcccattaaaatattatttaaaatacaatacccacagcatctaactaaatcctcaggatttattctccgggagaaattatccctttctaggaaaatgaagttatttctggttttaattcatacaatactttaagaaaatctgttaaatataacaaaacacaagctagatgcttaagaaatgcttaaagaaatattggggcgaaggtaacagcagtcaacaggattgtggccattactggtcctattattttgatgtaccatggaaggcacagaaatcgagcaaggaagaaaatattagttattttgatctacatctttttctaaagaaaagtggagcttgcctccagttcaattcacaagagcattttccctcccatgcccaccttttcttgtggctgtcgctaggaaggatgcagaggctgtgtggtttaccaaatgccttaacttagcagtgaatgacaactgtcaaacacatgttgagggaaaatttttactgattcacaaaaaggaagacagtttgcccactcttagtggcacaaatcaaagctgcatgcactacattatccaaattagtcgtaaccaaatagttaaaaaattctgctgggcacggtggctcatacctgtaatcccagcactttgggaggccgaggcagttggatcacctgaggttaggagtttgagaccagcctggccaacagggtgaaaccctgtctcgtctaaaaatacaaaaattagccgggcgtggtggtgcatgcctgtagtcccaggtactcaggaggctgaggcaggagaatcacttgaacccgaggtggggcaggcggaggttgcagtaagccaagatcgcgccattgcactctagcctaggtgacagagtgagactccatctcaaaaaaaaaaaaaaattccataggatgttcaaccatgttttcagaggccgcactgcatgaatgcgggaaaatgttgatgatcactaatcaataatctgatatttaacaaaatatggacaggccacttatgctcagttttaccttagttattccttggtatccacaggcccaagtccctttaaataaaataccctcatatttccatataatctacatacattctcccatatactttaaatcatctctagattacttataatgtctaatacaaaataaatgctatgtaaatgtaattattatactgtgtatttttgttgttgttcttcattgttattttttgtctttttacctccagtattttcaacccacagttggttgaatccaaggatgcagaactggaggacatggagggctgacgtgtaacatacataacatataaaacaggtcccttccagcgctagcacactgcaattacatcttaccctgaataagagagaaactctgttttggctggtaaaatttccaatgtcttcaccaataacaaagctcattttcacagaagtttgcataaactggaaacctggataaaaacaaagttgtaacatatttggttggattattttttaaatgtttcatgtatttacatgatcactaataatttttattcttatgctattaagattttacaagtgtattaataaattaccaaagtctgtaacacccaccctcaataaggagagactggtagaacgaaagtctctcctatcaatgtctaccctaccatccaacttcacgtccaaactatttagttttttgccaaaccttcaatgcactatgaccttttttttttctctcttgagatggagtttcactctcgtcgcccaggctggagtacaatggcgtgatctcggctcactgtaacctccacctcccaggttcaagcgattctcctgcctcagccccccaagtagctgggattgcaggtgcgtgccaccacgtctggctaatttttgtatttttagtagagagggtttcaccatgttggccaggctggtctcgaactcctgacctcaggtgatccgcctgcctcggcctcccaaagtgctgggattacaggcgtgagccaccatgcccagtgcactatgacctttataccatatccatgctgccactcccaactttttcatttcatttggaatgccttttttacctcctctctgtaactttccattcttttgctcactagcttctgggaattacaatcaccttttcatttaagttctcactattttgtgtcttataatagttggtgcttttcttggtcaccagtatttggtacaatcacatacagcctaagtttctcattggcaaaaaccttggccatttttatctttacattctcatccaagtatctggcacaagatagtcaataaatgctagacaaaaagaaacagtccaggttcctggccaggtgcggtggctcacgcctgtaatcccagcactttgggaggccaaggcaggcagatcacacggttagaagttcgagaccagcctggccaaccatggtgaaaccccgcctgtactaaaaaaaaaaaaatacaaaaattagcctggcatggtggtgtgcaactgtaatcccagctactcaggaggctgaagcaggagaattgcttgaacccgagaggtggaggttgcagtgagccaagatcacgtcactacactccagccttggcgacagagccagactcgtctcaaaaaaaaataaaaatagtccaggttccccttcccctctatccagactttcacactttacaatttcaaactttaagagtaacctaccttccatgaccacctggaacctccagtgtacagcttccttcattgttccattaattccgaaatgtcacactaggtgatatagcagtaggtaccagctaaatagctgattaaaatagaattatggttattagtagtcttaaaaacttcttgtggcttatctatcatacctacttttaaaaaatctttaagtgctttatgcactttccccttccctcacccctccctctttggttttccttgactgtttgtgcttttccatctcagtaaaaggacctcggggaatttaaaattaactagctcttctctggacttgtgattatattgtctgagtttggcaacaagaaaatgtgactatccctaggtaccatcatttgcaagcatctctttagtctacgtacctctactccatcgctggtttccctttgcttcgattatataatgcgaggaggtctatataataaattcaggattcctgtttatgcacttttcagcaaagagctagggatcaaatagggtttcaatccttctattcatagataaaaatctgtgatggggatcaagatacccctttaaaagtcatgttaagatatacactattctttgggtaagcagaagaccttaacaaggaaagtagaaaaattaaaatgattgctgtaattctgatttttagtggtcctctagaataaaataagttttggaagtaggtatcttaaaatagtccagtagtcatcaacccaggtcaatataatataccaatatcctccaccacccaaatactggtattttacacaacttattttgcacattaagttccattttaaaatgttttaaaatgttttcttaaaaaggaagctgttagaacaaaaaaattatgaagatggttttcaaagtattacatttaaagttcataatgtgagcactacagatgttttacaaatatttttcagtgctttcaaccgttgcatttgccgtacgcttccatgttctagaataaggacatttttatgttgagaaggctacactgattacattaataggcaaatactaattctgagagaggtttctattgttcactttagaaaaatgtaggtcaatgtaatgggtgatatctgttcttaattattctaagaattaaatcctgtatgttatcagtcacctattatatggcacaccctcagggggtatcaatcattctttgcatatactggtttcttaaagggtaagtttccatagaaatgtttcttcatttgacttctaccctgaagtcatgtgaaataaaacatatatgccttaccatctaaattcaaagcttatttttgaaatgaatgtttccttttctgtaattttatgatttttctcaaatgaacagaaatggtaatgaaaccacaagttgcctactctttcgaaaccattaaattgctttatttgtgagtagacccatatttcattaagcaaactctgatagctacgtctagaatcagaagagcccaagccctctcatttcaccgaaagacattctggagcgtatagtggggaaaataaatttcctctgaagtctttttcagggaaatggaaaattacatattctggactgatacaaccaaaactcacacaagctctcccattccttcagtcttgaatttacttcctagttgattttatatacttcaatatatgaactaatcacttcattatccaaaaggatgtcaagctattttccaaattttcataagctagtaaaaatatgtatttctgaatttagtagaaatgaaaaagattttgggcaaccaaggacagaaaggtctcctatgcactgttttacattagaacattgtaaggaagtacttacactctaccaagtagggtggatatcaaaacaaatgtattgccaaaagttaaaagatgaaatcagaaaaatgatctaactttgaaaagactcaggtctattttcacatacacctgtaaacctaagcaagaggactgccaattgctaagagcacacagaatacacacttcacctcagatatgcaagagaaaacacccttttttttctgttacagagactctgtccatctgattaccaattactctcttcccccatcttttaaaaagagtcctatttaaagtgattctggaagcctaacataactattaaatgtacaagcagcaattaatttggaatacctattggaatcactggaacatttagttgggccctttaactcttccacacagcacattcacatggacagactaaggaaaaggagatgaaatgtaaatcaacacatttgtttgctttacttttcaagaaaaaaaaaaaaagttatgttggaatctttttttcttgtacgtgaccatgactctcccaatctttaactacaaacaactgatacaggatacaagctgcctcaaaaaattcctttgttagttgacatttaaataagccccaataactctttaggtatctctatatatgctttaacttttatagcattaatgtcacacttataaactggtgtctgtactagccacgtctattcttggtgttttaaaatttttaaaaatgtcttggctgtcaccaatttgtggcaatgctttaagtgtttgcaacgtatattttaccagacataacttattttacttcctgtaaggttcagaatggaactgttaaaggaatagcaggaaagaatatgccccaatagtgcagcacttctctgtcagatgtaactctccagcctgtgatctctgcattatccttcattaatgtagacagactggacatgctcatgagtaactatgtcattggcacagtatggtgatcataatggtgcaaaaaaaccctgaatctttatagaagacatttctctagagactagcctacattgacatttacttcactttcaactacagtacatagcttcttatgcccaggattcagctttaaaagcaaagcccctgctcaagacctaagtatatgctgaatcctggcatgaaaaataaagtatcctaatcaataaaaattaggtagctacaaattgacatgattacaatccctgtcctaattacttgcctaaccaagtagtgattactgatgtcctggcccatcatcaacatgtttgcctaccaacactaggcttacaatcaatagattctactacataggtgttatattttctgaataattctaggttaacattatgaatatccattatgaatatccattatgaataacccatctatctatgtccaatctactatcccttaaaactattattaaagactcctggggcaactaatgaaaattacttcaatcatttatatttttagtcaattggttaggatgtgaaagcatagtcctgctcaataatgtaagcatatcatctatttcccacctaacctcttttctgagactgtgctatttctgcatgacttgagattgacataagtgtgacgccaaataaactagcacacatattaagctaaacataatgaaaactaaatattaagatgaattgtttctgttcaatttcaaaaatatacccttggggacccctggtttttcatctactccaacacactcaagagatatatactacattagtagtatagctcacttccaaattctcaagggcttattctaattaacaagtttagtaacaaaggttagtaagacaaaggtcactccaacatgagttagctggacaaagtacttttaatgcttattttacaaatatgtacctgtggtgctaatactaggcaaagaaaacaggacgattcaagagcagcctatgtaactaccaactcaagcactaacactagctagatcaccttcatgctttaaaatttaaagttatggagtagctgtgcccacacccccccccaaaaaaaagctttaataaaggcactgcagcgttaactaagttttagggtaaatttaggcaattaacaattcgaagagacttgtggtttatgtattagtaattcaaattactgttttagagatctcaggtagttaaccaattcttgctcaaagcactaatgttcagtccctcaccatttatgctgggtatgagtcccaatgcatgggtattgcaacctattgtcaggccttaacatgtatgtgtttgcttttattattactaaaatgttaaaacttaaacccaattattcaccaaactctgaacacctcaacctcagagctccagaattaggaatgaatgacaaagtttagactctaatcattttaagaatgttaggtgggaagaaatggcttcagatgcagtattgtgttcatctttccaggggaacatctcaaatgggtattctgaagcaggttgagaagtagataaaattctctgctacaagttccatccactttttttttttcaagagaccaggtctcactatgttgcccaggatggtctcaaactcctgagctcaagtgatcctcccgccttggcctcccaaagtgctaggattacaggcgtgagccaccacacccagccaagttccatccacttttgaaaacaagacatttatgtataggaagagaattatggaaacactttgtaaaacatccatttattatatccaatgctaaacactaccacttggactctaagatatgtttatgcctctctgtttattctagttttttaaaaatcaaatatacaagatctacaattatttatatccaagatgtctacaccactgcctaagaagctattaaaatatttgtatttgtgcaatggaacccattattcacatggtcctagaataaaaagtcaatttatattgtgaataaatttatcaaaaaacatgtcatccaattcccacaaatgagacattttaaatacagaatacactctgttcatgaatataaaatccccaggtgaaagtcccttaaaacactattatggttatgtttcctagaataattttataactttttcagagaattcctttaaacttgttaaaataccttgttgctagtgctcagaacatctaggttcagtctttatttttaagacagtatctatcctaggcaaatgagagcttgtttttatgtatttaagagtttcctcttgtcatttcaatgtcaaattgatttgactcaatttcatgatttcatctcgctcaaggccatcaaccggtcagagccagagcccttcaaaggctgtatgtgagtatatgagggaaaactttccacataattttacatcatttctatctcatagcagttttagttttctcatagctatctcatagcagttttagttttctcaaattctatgctgtttttgtactactgcagctgaccaatccaaagccagtttacactcagcatgtgttattctactttaaaatataaccttagtgaaagcacccttcaaatcaacagcaatctcacagtgagtttcctctgggtagtcaggatttgtccagaactacatccttttcagatgttcagagttttgcttgccattagggaggcaagggaaggatgagcaataaatcaggtttctcgttcgtatcttacttcttacctaattttctccctgttgcttatttggtacattcccttctctgaattccttaaacactttataaggttatttctgccatacaagtgtagacaattgtattaattctagtcttgactaaagattttaacatttttctgggtgccatttttatctattctctctccccccaaattctctgggctaaacaggcatgatagtctacctagtgttacttgaccattactttcccactgcaattataaaatgaattccttaataagcaattttaaactagaagatatatccaaaactttttaaaggcacaaaggacaactttaggacacaacactgattagcatcaaaacctgaaactgttcctctagtaagtctatgcaatcctaataatgtatactgaagagtagtagctcaggccagtggttcttagcattacttgctaaaaaagataaaaatccatgacactatcttcaactgttaaatatcttatgttaactaaggatttgcctgttccaaaaatgtctcaactgaacctatacatcacctaaactccagcttatagcaagaaaattccttagaagtatgaattcatatttatgatctgattttaaagggctaaaacaaaattctaagcaatcagaaatatagcaaacctaaacttaccaaagcaacctaaaaacaccaaggaaacgctagactgaagtcaaattttagttctacagtttgactcctgattcctcacttcacattggtgaggggaagattaaagtgttctgtgcaaacccaatataattacaattaggggatctaatgttattacatagctacagtcaagttagcagtgttgtgtagcagtgacatcaatgactggcttgcatgatggcttctaaaagcatctgatcccagagtttcatgtatcatatatatgtatataaaataatcagttgaggacagcattagcattctgtaaagatgataaactcagtgttaacttctcccagccagtaccttttcccctcattaaatatgttaaaagttgtctgggggggaggggaagggaagaattcaactttacttcataattatgtatcaattgtcagtatacatttaagtttttaaaacctaaatgttctatgcagagtaaagaataagctgtccagaaagcacacacttaataaatttctcctcttgggagttatataaagggattttgaaccttgatggcgagaatcccaaaacaagagtaaaatgaattctttttattgcaaacaaacgtctaaattaatttctccacccactttctttagaaagaaaaagaaatcagcaggctaaggagatacccattcaagaactgacatgattaaaaattaagatataaatgggtgactcacaatttcattagcttacaaagatggtggagttaactactacaagcacactagttatacagtattttgtgggagaagggcatacagacatggctaacttcatatagatcccattagacaactggatttacaacaagtttttttaataagaaatgggcaaagccagctttcttttcagaatcaaaatgcagaacaaatggaaaaattatggtattaaccttcacaagtttgagcctccacaaataatgcaaccaagttttacatttttaacagcccttctacatacactccatcttctctatcttagttccaagttttagttttcaatcccaattataccaattccattgttattttaagaaaaaaccttcccagttattgtcagaaactatgatttagcttaccccctccactacccagcaaactacagagaggatggagtgtaatatgagcagtacagagtcttaatgcaattcatgaggaccacttagtccttacatgaatctggttgctaacatttctattatattgtgacaatgactcccgactgttattctctgtgagaaatggggggagtaaattcttaataaaagacaccaggtacaaagcaacattttacttctgttgtgataaaaaaaaaaaaaagtcacattttacagataaaatgtagaaccctgaaatactgacacattctcttatcgtgcacaatgctgaggttctcttacgattcacttttaaactgcaattaaaaatgtacaaaaaagaaaagaaaaaaaatcaacccacaaagcttctaaaaaaggaacccgcaggcacttcctcttgtggaatgtttaaaaagttagcctactaaagaaaacagtcgacttcttgtgaaggttttggagaaatatgtatcagttcgttttatttgggtattcaataatatccttggtgataatgctgactccatggcttctgaccccagaattgctgtaagagaaaattttgtttttaaagaaaaaacatcaataagccactcaaactgtttttaggaaatgacaatgaatctaattcagagtaatttgctggaaacaaatttatacctgtcatacctctgatttctaccaaaccagatttagttttaatatcccataattatcaatacacattacaaaacgaaacatcatgactttgttagtttacacaattaaagctagcagtaaaagaactgtatatattaaataatattactttattaaaaaaatttaacttatagcaatcttcaacctattttgccttcaaaaggtagattatggctactactgcaagacgattcacactttaccctattaacacttataaacacttcaatccctgaacaagatctttttcaagactgataaatcttaggaactcaaaatacaattaatgtacataaagcacataagaaattacttacaccctgctgccactggttgtagccctgagattgatttttgtagccacgattgtttcctcgtcctctgaagttctacaaaaaggaaatactctctaagagctctgagcccaattgcttgttaggtttgtgggggtgagagagaggagcagaaatggacaggttgctagcccctaatcttaggtagcaagcaatacacaaattctggataccctctgctggtttcttatgttttaattttttattcattatgagaaatgcatctgacttgtttagtacacctgaaaaaactcaaaagtaagtagactcatttcaccattactagttcaattttccttatgtcaatgcctatcatgttccttacggattactaagacaccccaacataaagctcacacctttccagactaagctacagttatcaatcatgcttccagggatcttgaatcattacctggttgtagttccctctgttgggcattccacctctgttgtagttccctctgtttgagtaactaccacggccaggaaaaacaggggcacgagggtatggatagccgattccaccacttcctccaccgccaccacctctctgtggcatgttgcccctcctattatatccgccacgattcccaggggctaaaagacaagagctgttttagtttcattgtatattgtaccctacttatacagaagacttaggattcctctagattgttcctttttctccaaaaataattgtttaaagacaaaagaaatgtttaattctaaccattaacataacctaggtgtatttaatatcaaatcacatgaatactttagttactgtgacagtataccattaatgaggaagaaacttcagctacatccaaactataaaattatcacttgtttcgatcctgaactaaatacagaacactcaaaattaacttgcctcctcctctgaaatttccaccacgcatattgaatcctccacgtcctctatggccaccacctctgttaaactggttcttgccactcttatttttattgcttttctttgagccagtgttctgtttcttttctggtggaagagcctttttgctttcttccttatattgctccaagagtttttgggcttcttccttctgaagttcaacataggttatttcatcaaagcactcagctacctctgggagggtaaagtttcctgcaggaaacaaagtcatattattaatttagaaacccaccacgaatcctcacaatcctaaagctgacaattcttgaggtttagtaacatattttcctaaaaataaaaacagaccaaacatatatgcatatgtaacaactgcaattttaattcctgaagcagtattgctggaaaaaatgttaactttcaggaggcctaagtcctaatagatttaacatagttacacaagcagaatatgtaggaaaaacattcttttaaaaagaagatttcacacagtaacagaattaaaattccatgcctttcattttgaggaccgcatgttctggtaggtctttcccctctacttctgctttcttctgtgttctttgcttatagtcttcatcttttgggcaaactacaacagcttttcgctggaagcctgcaaacaggcacatttttctcctctgggcagcagcagacacatttgtctttaaaaaaagaaatttatgtttacaaccctaaacattaattctacaccaatctatctaaattatcagttaatatttttcaatttcaaagctacagcgtacctgatccagaataaaatttcgcttctttcgggcagcaatctcaataaatttcccaagacactggggggctctctgcaacagtgtgttcagttttccagtatctgccatttgcttcttaaaacctgccacctatattcaaaagttaaaatttccccttgaacttgtgaattttaataagttatgctttttaaaattcaactcatatctatatgtaaagcaggcaacattttataatttaaatattacctttgtccattattgctacaaaaacagggtcacttaaactatgtaacaagaccttacacttactcaattctttttagctgctagatgttaagagctcaaaaacactacggaaaaaaacagaagcctagccagtggaaggcagtttaccctcagagttgaaagaaccaacttaatcttgcctttcctcccatctctttaagatactaacaaaatggatagagacaaagacaaaaagtttacctagaatacctcccggtctataatttttcttttcttttttttttttttctgagacggagtgttgctctgtcgcccagactggagtacaatggcacgatctcaactcactgcaacctctgcctcccaggttcaagtaattgtccctgcctcaacctcccgagcagctgggattacaggaacccactaccacacccagctaatttttaaatttttagtaggaacggggcttcgccatgttggccaggtgggtctcaaactcctgacctcaggtgatccatccacctcagcctctcaaaatgctgagattacaggcgtgaaccaccatgcccagcctctcccagtctattttaaacactgagatcaggccctaaacattttacttaccatcatcttatccataatagtatttgtgccaagaatgttatatttccctggattttctgctgcatgtttagtaacccaggtagtttttccagctcctggcaagccaatcatcatcacaacctagtgaaaagaaaagaaatgtcatttcactgtcagtagacaccacctaataattctttaaatattgttaaggccaatttaaatatctaagttttcatagcccttacactaacggacaaaaatttgtttatggaaagattaacagtcaacataagggggaaacaattacttaagagcaatatgcacagcacaaagtaaatgaaacagactaatcatctagttcttctaaatgtcattttgtgccaggcaagcaatattcaaatgccacagttaaaaaaaaaaaaatcccttacttcacaatctttcttctcttcaggcccctttggtcctctaactcgatcctctaaggggacgttctggatgaaagtatactcttcaggtattggaaaatatggcttttccttctgaccaaaattaaattcaactgcacagttgtggcagagaacatgcgggaacagtggccgtccagcaagaacttccttactgattttgaaggcaacgccaagatcttgtccattcttagcatacgagagttctacttcatcactttcaaagttctgttacacagaaaaaaattcaacagttaaaatctgcttccttaaactttctaaaaaactaagaattaaaattaggagcaaagcttatcctgtggaagctacaggttaaagaactattaggtggcctttaagggctacacagttaagaaatctgatggttgtaaaccatgaagcacgtatctccagaaccagaaacaatactgacctagaagctagactgaattttctaggtcaatttcatgttcactgttttcagtcaaaatgaattagtgagttcctcaaaaatgtcctgtgttttcccaattcaactgctgaatgaagtctttacactaatccagggactggtgtattttgttgctcatattgaaaactgacctcagtaaagcttctttaaagttcctagatatagctactaactttgccatttatacatagaaagttagctttaacttacagcaaaacatgtaatcacatcattttcatcaaacttttctccataatcttcagtctcacagttgcatgtttttattccttttagagaatacccataagaaaattcttcttcacctaagaaaataattaatcttcatgaagtagatgtttaaaatagtccaaagactcatctattttactacttaagatgtaggctacaagagaaataagcatataacctaatcacctgtcactgacactattacttttctatctctgtaccagaattgatggaagttaggagggatatatacgcagagaccaaattagttgacgatttgcatatcacgggtaagattttatttcaaccattggtcataaacttctaataaaggaacaaaaactaaaatgtagcctgtgcctactatgtgctaatattacctgtctgaagtattaacagaatagataaaaacagacaaaaggcttagaatgccctctagttaaaaaacactgaaatcagaccctcctgaacattcatgagcccacatcagtcaaaaagaagctttaccaagtaacattccacttgtagttagtgaccagccaatacgaacttcatgtatgtcaatatcttttgtatataaatgccttactgggatcttctctgtaacctgaaagtcaaatcattaaataattaaaataatacaccaaggaggtaaccccttaactctcgcatatttcattgcgccacgggctaatcttcctctagctataaatacaaagaaggcacactctagcccacccccaatatttgtaagaactttaaactgatgtgcttataacttgaaatttaaagagttaaatacttatttgacccatatttaaaagaatacttaatatttttaaagttcatgttgtcagtctttaacttaaagccaattaaaggatacaattaatgtttttctcaccaacaaaagcagtaatgtaaccaaattttatttttaactctttggtggccctttcaaatgcttgataaaaatgaagtaccctaaataaaaaatcgcctagctctgcatggcaagttctaacataacaaccgtgattaactgtcacaacaaaatgaaggttccaagctcctcttttaatttacaggaagcttcaaaaataagtacctttgataacttagcagtatgaagcacctgtaattccagcattctgagaggctcaggcgggcagatcacttgagcttaggagttcaagaccagcctgggcaacatggtgagaccttgtcactattttaaaaaggaaaaaaaaaggctgggcacagtggctcatgcctgtaatcccagcactttgggacgccgagacagtggatcacctgaggtcaagagttggcgaccagcctggcctacgtggtgaaaccccatctctattaaaaatacaaaaattagccaggtgtggtagtgtgtgcctctagtccgagctacttgagagactgaagcaaggagaatcgcttgaacccaggacgcggaggttgcagtgagcctaggtcgcaccacggcaatccagcctagggaacagagtgagactgtctccacaaacaaacaaacaaatcataaaattgcatttaccttcatctcaaaacacactttgccttttgacacaccataggatgctcttcctccagcccaaagaaaagcaaaactctccattgtaagggaagaagcactgagacgatctcttgatattttaaaatgtagatcacaattatctgtaattatatcaaatactgtgttacttttgacatccaatgtaaacatatctgctatgtagacaaaacttggttacttaatttttgcatgtacttcttaatgctgcacaacttttctccacatcatgctgttgttccaattttcagtttaaagccccactcccaccaagtcactcctgttaaattatgtactgaaaagtaaactgcctgtgaaactaataccaaggtttaacatgtatattttaagtatttaaaataatcaagacaatgtgacattaatacatacctgctctgctctttaccttgatttagaggcaagcagtagaggatagcaggaaatcaaagtgaagcatgccagaaccaggtagatttaccagtgccacattaaaactgaagggaggccacgaccaaattattttaaaataggagtatgagctgctgttgatcctgcaccagggctctagctcctaaattctttttctaaaacttgtgaagaagacagcctaaaactatgaagtacaaacctggccgtctaatgctgttaatagtgcagcattttaggtcctctttacccaggactgcctgttcaacaattagggattaattgcttcccggattatccaaatccaaagtgtctttaacccagctacctatgggtcactggctcattaacatgcacttcctcagacttctcacttgaacagctaaagtcaagctggaactcattttctttttactgatcagagaaaaataaatctacagtttggaatttttcttaaattagagttattctaatcaacagaatttaattcaacagattgtttgaattcaacattgtacttatattgacatattcctgatttgctaaaaaatctaacaattacattacctgtgtgagtcaccacttcactaccttgccaattcctagcaacttatttatacaacccagaatttcactaaaactttcacatcaactaactcctttttcacctgcagttttttcttttaaaaaggctcagatgactatctcaaccttctgtaaaggatattccagtaagaaagagttttacattgacactcttacaaatctgaataaagccaatttgtacaagaaaacatgagaagctaagctccaatgccttccatctaacacagcaggctgacaccatagctgatacttttgaaacagttatttttatcctttggtctatttatcacacccagagttgtacattctcatcactaaaccaactacgtttttttgtaacaaaaaaaaaaaaaaaaaaaacaagtctgacagtcaaagcccacttagaggtttgcaatactttctcactcaattgcaacccaactgggtaaagtagcagtatttacagtgctgcactgccattgataccattcgctgctgaagaaagctagtggcccagtgatagcccactgctgctgcctcaggtctttggaagaaatcaacttatgtttaaagcagcagctactgaactggaattgagaacaaaagagcagttattgaaaaagtaatattacaatcttttaaaatagggaatatacttgtgtgctaatgggagaagtcattagtaaatatttaactagcccaaatagctcacttaatataattccacaaaaaaatgaattactttattgtagaagcctgtaaggctaaattataggtagtgttacaagtttccgttagctagtcaaaaactggcattaattttacatttcctaagaatgagaactttcaagtcataaaaatacgaaactcctagagcctgtaaaataatccacttaatacaactgatgacgtgctaaatattaaactactaggttctgaatgtaaaccattatcttcctgcttttaaaaaaactaacccaagttttgctgcacttaagcattaagacttctaaaaaaaaaaaaaaaaaaaccaccatcaccgcatttcataattggggagaaacagcttcacttacaagtatcaagacaaaccactgtgtcatcgaagtgttcatcttcttcttcaacaggtggctgaggagatttggctctgaaagacagaattgtctcctgatacagctttccgatcaacgaacgaataagggatgagtaaaactaggtgagcatcctatacctgctatacttgttctcttcaatgtactcaaaatatccacggccatgatcttctcgtggtcttttaacacccctctttttatctccgcctttctgttctgttttgccgtcccctaaaacacacacgagccccataaaggccaagcctctaaacaacaaaaaaacgcttttccgttccgagaaccaaagcagctcgactttatcctgctttttaactgaggttttaaccgaggactcaaatgtgaattcaaagaacaatcaactacgaattcgattggcgctagtgacgcagtctaaagacattactaattttgccagtctcctcgatgattcgagaaagccaaagaaaaactgcgcggcccaggcccgaagcccacgtgtatcccgaagagagcgcagagagggggaggggccgagcccggcgcggcggcgctcccctcccccgcgggcccgcgctccccgcggccgcattgtactgatcttccgccccccgccccgccccgcccggctcctcccgccggaagtgacgtcacgccgagcccctgcgctccttgcacaatacagcggcgaggagccgccaaagcgcgcccgccccgggacctggggcctctcccctccccccgagacatgtgcccgcaccgcgcgcacgcagcgcgacggcgccaccgcgggccgaccgggctccctcccgccgcccgcccgcggctcctccccctacagcggcagctgcagctccccccggctctcgagccacataatggaggcgctgccaccgccgacacacacacacacacacacacacacgcgcgcgcgcacacacacgccccgagcccgaggcctctcggctaatctgggattccccgcgccccctcccccaccctcaccgcggcgccctcccgcccggggctccctccccctgcggggctccggcaggcctggggcacggtccccaccccgcgcgggcctcccgccgcgcgcaacgtacaacgcagcactcacccgccgccggagccccggggcgaccgccgcctccgccgccttccgccttcttcttacctcccgcctgctgctggccctgcctcgccccgggcggcgccaccgtcaccgcgaacagcgaggtggggccgctgctcttccccgcggcctccttggcggccccgcgctgctgttggggctgttgctgctgcgtcgccggcggttgaggctgctgctccccgtgcccgttctcgtcgcccgcgccttcctcttcgtccccgagctcatcttccccttcctggaaaccctgatcgtcgccgttctcgtcttccgaggcggcctcctcctcctccatcgggcccgagtcggccgcccccgcggccccgttctcctctcctagctccatctggtcgccgtccagagcggagattccttcctcctcctcttcctcttcctcctcctcttcatcgccgccggccgcggcctcctgctcgaggcctgctcccgagcgcccagcggaatccccgcccaggtctaggctgccgttcccgggctccatggcggggcggcccccggcctcctcgtcgtccagcgcagcctggagtcgctccatgagctcggccttgagacccttgtcagaaaggcgtcgcttcttgagctcctctttcagctccgacaccttcagcttttttacattaacaggcgaggaactcatggtgagggccccgattcaccgctaggcgctgcctcaaactcggctccgctcactcggccactggtggcggctgctgcggctgctcctcggcccgggcggcggctgcggctgcggctggagatgggttcgtgctgcagagcggatccgcctggtgtcgaacggcgccaattcctttcaccgagttcgcgagggagacgcggagactcgcctggcgcgagcgagcacgcaacgtcctctcgcaggagcggcgccgcgcacgtaatataggcgccccgccccctgcgctgacgggagcactgcgcaggaggaaagccggagcgcgcccgcgctcggccccgcccattaccgtacttacctccccgcccccacgccgaacccgggccgagagcgcggtggaggccgcgcagtgcgcttccaattgggactgagcaaatggaggaaaaggaaaccgcctttcagttcaaccgactcactgcatgatatattggcctttctgggtctttggtggctatactcgtttggcttttctccttcccagcttggaggctgctttatccaaatgctttcttcagtcctcaacttggcgtttcaacccgaatccgccttttcttccatcttagatctgccttcttatgtgtttctccagctcttcgtttaaaactccttcaaatcgtatttcagttttgactggtatagcatacattggcaactgttacacgcagcggctcttttcctcataataccgtatttggtttaatttgtgtaagtcctgccttgcgaattggattttaagttcgagaagggcaagggcagaaccgttcttttgtctgttccacaccccgggtgcggggcctgggaagtagaggctttgcttactactccatactgcaaaccttagtgtacctgcctttgcagggcagctattctcatgctcttaataaccctgaataaacctcagaattgcatttccaagttttctgtagctaccacaaagacggacctccagtaacacttgttctgtccactttaggacctggtcatcagctacgaagtcccagtagctaaccgtgagggtgagacccaactaggtctttgattataggcccacttgattctcttcctattcctgtagaaatactcttgaccaaattattctgaaacttaaagtttacgaaaaatcaagggctgtgattttgtaaaaagaaaaatggactatcgctcttgaaatccgttattttatatgttagaagtttactttttctctttaaagaaaagatgtgatgtctcgaagttttagatagggaagtcagaatttagattcgtgatagaagttaacattttaaaccctagataatctgcagtgtccagccagtgttccatctgactaaggagatggtttatacccactgtttggtgctctaggtggcacaataatattgccccattattaatttgaaatttggaagtaaacacattgaaatttctcccataggctaatatgatttaactaattgatacattttatttttgaagtttattttcggtagcttttatgaagcattctaccataccttgcagtcatgtatacgtgaaatattaacacttgtgaaatgatttgacttgaaattaatggactatgtacagtactactgataatccccagttcaagttaagtggtgaggatagcccccaaaatagaaacttccaaacagtgccagaaactcattttagcctttggttataattttgaaggttatgaataagccacaaactggaatttgaaattttgtcttcgttcagaaatgggaagagagctacagggggtttacatgttcacaaactagataactaatcccttaatgaatcagagttaaatacaattatgatggttccttaaatttatgtgtcctagatattatttacacctttaaatattagttatatgaaaacaaatttcatttactggaaaacactaaactatgaaaacaaagattgtatatctacatatagtagatctgtaacagtcactcttggaacattaagtcagttgcaaaaataaacatgaaatacaacttttgatgctcacaagaaagttctatggctttatctccaaaagttttggagaactttagagctggatggggcctggagatcgatctgcagtcctgttcattttactgcccaggaagctgggaccctcaccccccacaccaatgggctttctattacattgtgctgtcttagacaacatttgaaagaaaaacaatttctgctcaaagaaccatcatcatactatccttttcacaaacagaggaaatatgccattccatagtcttatgttaccacttcaaagtacaaatggtgacatcttattgatcatttttgcttcttatatttttaatgctatcatgatagtcctgctctacagagacctgttaaagtgcaggtcacttcctgtaaatctctgaaggacctctaagacaatttaaattccccctgtgtcaaatcctagaggctaccaagaataccgcgtgccggaggagacaagttaattctcaataacaaaaaatgattcaagaatgacctatgaataattgatctgtgagaggtaactacaaagttttggtgctctgcatgtctagcttacatttttgaggtttaagcaaaggaaatgctatactttgtcacacaatttattcagcaaatattttttcaatactttctcaaaaacattttatagtcataacgatgaggcagttccagagatctacagttaacaaagtatcctgcacttaaaaatttgctggccaggcccagcggctcatgtctgtaatcccagcacttcgagaggccgagatgggaagatggcttgaggccaggagttcgaaaccagcctgaggaacacagtgagactccatctccacaaaaaattaaaattaggtggctgtggtggtacgcctgtagtccgagctactcaaggggctgaggtagcaggatcacttgacccccggcagtcaaggctgcagtgagccgtgattgtaccactgcactctaacctggaccacagagggagaccctgtctcaaaaaaaaaaaaaaagaaaaaagaaagaaaaagaaaaaaacccgttaagatcttacgttaaatattctcattcccccccgccccccaaaaaaaacaaaacaaaacaaaaaacaagatcgggagtggtggctcacacctgtaatcccagcactttgggaggctgaggtgggcagatcacctgaggtcaggagttcgagaccagcctggccaacatgttgaaaccccatctctactaaaaacacaaaaaatagccaggcgtggtggtggccgcctgtaatcccagctactcaggagcctgaggcaggagaatcacttgaacctgggaggcggaggttgcagtgagctgagactgagccactgaactccagcctgggggacaaagcaaaacttcgtctcaaaaaaaaaaaaaaaaaaaaaaggccgggcgcggtggctcacgcctataatcccagcactgtgggaggccgaggcgggcggatcatgaggtcaggagatcaagaccatcttggttaacacagtgaaaccccatctctactaaaaatacaaaaaattagctgggcgtggcagcgtgcgcctgtaataccagctactcgggaggctgaggcaggagaatggcgtgaaccctggaggcggagcttgcagtgagccgagatcgcaccactgcactccagcccgggcaacagagcgagactccgtctaaaaaaaaaaaaaaaaagaaagaaagaaagaaaaagaaaaagagccgggagcagtgtgggctcaagcctgtaatcccagcaccttgggaggccaaggcgggcggatcacctgaggtcgggagtttgagaccagcctgaccaacatggtctctactaaaaatacaagattagccgggttcggtggcaggcgcctgtaatcccagctactagaggggctcaggcaggagaatcgcttgagccttggaggcagaggttgcggtgagccgagattgcgccattgcactccagcctgggcaacaagagcaaaactccacctcaaaaaaaaaaaaaaagggaaaatgaaaaagaaaaaaaaggacaaaggtacacaaggaaactgttggaggtaatggatatgttcattttcctgaatgtggtgatggtagcatgcgtgtgtatgtctgtccaaactcaccaaatatgtatagatttattagttatatgcagggttttctttttttttgagacaaagtttcactttgttgcccaggctggagtgcagtggaaccgtctcagctcactacaacccccgcctcccgggttcaagcaattcttgtgcctcagcctccctcgtagctgggatcacaggcgttcaccaccaccctcggctgattttttttttttttttttttttgtatttttgtagagacagggtttcaccatgttgcccaggctggtcgtgaactactgagctcaggcaatccacccatctcggcctcccagagtgctaggattacaggcgtgagccaccgtgcccggcctatatgcagttatcgtataccaattatacctccataaagctggggaggttgggggaggaagacaaaagaattcaggcctgcggggaatgatgggagtgggtaggagaggagagaggggagagaggaaaacacagatcaccagcagcctcgtgggtggttttgtaaaggactttggcttttgctttctgctatggactgaacgtttgtgtccccacaaaagtcctgtgttgaaacctaatcccccatgatattaggagctgaggcctttggaggcaacgaggtcatgagcgtggagccctcatcaatgggattagaaaatttatacagagctgaagagaccagcgttcgtgtcttctgccctgtgaggacacagcaagaaggtgccctgggtggggaggcgggccctcaccagtcactgaggcgctgggcttcttagcttccagaactgcgaccaataagtgtctgttgtttataagctactcggcttatgatgtttgttagaagagcccaaatggactaaaacacctccaggaggagggaagacatagaacgttgttagcagagtgacatgaggggacaagaatgctaaattaaaaggactcgagaggctgttctatttaacttggtttttgtttgtttgttttgatctggagtgcagtggcgcaatttcggttcactgcaacctctgccttccgggttcaagcaattctcctgcctcagcctctctagtaggtggggttacaggcgttggccaccacgcccagctaattatttgtatttttagtggagacggggtttcaccatgttggtcagactggtattgaactcccgacctcaagggatccacccgccttggcctctcaaagtgctgggattacaggtgtgcgccacctccagctaatttttgcatttttagtagagacaggggtttgccatgttggccaggctagtcttgaactcctgacctcaactgatccacccaccttggcctcccaaagtgctgagattataagcatgagccaccatgcccggccttaacccctttttttgtttttgtgttttttgtatagcacgatcaagcccaatttaaattaatcaaagatgcataaaatatactgagatacattttccaatgtattttacaaaagatgtaagagtcagaaacacctccaaagtattctgtactaaaagtagacattttcacatagacaaacaggaaagcccagctgcaagggaggaggtaccaagttctggttagaagtgcaaactttcaactcagaaagtcgaagctgtaccacatagtcgctgcgtgattttgcacaagctatttttctctccatgcctgagtttactcatgtataaaaataatacttgccacctgaagttgttggggaaattcaacaaataactgaatacagtgcttggcacacagtaaaagctcaaaaaatagtagtcttcatcagacacactgaacaattttaggcagttaaaaatctatgattggctgggcgcggtgactcacacctgtaatcccagcacttggggaggccaaggtgagtggatcacctgaggtcaggagatctagaacagcctagcaacatggtgaaaccccgcctctactaaagatacaaaaattagccagcgccttagtcccagctactcaggaagctgagacaggggaattgcttgaacccgagaggtggaggttgcagtgagtcgagattgcacgactgcactccagcctgggcagcagagcgagactccatctaaataaattaattagttaaaaaaaaacctacgattgagtgattaatactaaatcttatcaaggaaattataactacatgtattttgtaagttatcaatgaattgtttgtggtaagatgtcaatctgggaataagtgaagcaaagtctaaacataagtatgtaggttgggtacagtgacccacacctgtgatctcactattctgagaggctagaggtgggaggatctcttgggtccaggaggtcaagaccggcctgggcaacatagcaagaccctgtctctaaaaataaataaataaataaataaaaataaaaagtattttttaattagccaggcattatggtgagtgcctgtagtcctagctactggggaggccaaggtgggaggatgacttgagcctaggagtcgaaggttacagtgagcaggctgggtgtggtggctcacgcctgtaatcccagcactttgggagatcaaggtgggtggatcacctgaggtcaggagtttgagaccagcctggccaacatggtgaaaccccctgtctactaaaaatacaaaataattagctgggttcggtagcaggcacctgtaattccagctactagggggactcaggcaggagaatcgcttgaaccctggaggcagaggttgcattgagccaagatctcgccaccgtactccagcctgggccacagagtgacactctgtcttaaaaaaaaaaggttacagtgagcaatgatcatgccactgcactccggcctgggcagcagagcaagagcctgtcttcaaaaatacatttaaaaaataaaacacaagtaccagacttgacttcgaggcccagcgctgttatgataaccaactgtgtgaccttgagcgaattgcatgacttctctggatattagttttcttgtctataaatgaagcagatcaagccaggcatggtggctcatacctgtaatcccagcacttcgggaggcttaggtgggagaatggcttgagctcaggagttcgaggtcagcttgggcaatatagcaagaccttgcctctactgaaaaaaaaaaaattagccaggtgtggtggcacatgcctgtagtcttagctacctgggagcagggaggtgggaagatcgcttgagcccaggagattgaggctgcagtgagctgttattacaccagcactccagccctggcaacagagcaagaccctgtatcaggaaaaaaaaaaaaaaaaaaaagcggagtaaactagatttgtagaggccccctcaaggggaaccttccatgagtttcgtttttgctgacctgaagaaaactataaatgggcaagcttcgttaaactttgaaataatagtttattcatatttagcttttacttgttaaaactttgctctagagtctcacagtattttataattaattagcagacatgaaattttttttttttttttgagacggagtcttgctctgtcgcccaggctggagtgcagtggcacagtctcagctcactagaagctccgcctcctgggttcacgccattctcctgcctcagcctcccgagtagctgggactacaggcgcctgctaccacgcctggttaactttttgtgtttttttttagtagagacagggttccaccatgttagccaggatggtctcgagctcctgacctcatgatccgcccgcctcggcctcccaaagtgctgggattacaagcgtgagccaccgcgcccggccagcagacatgaaatttgaactactgtgccatagttcagtactataggctttgaattttaaatggtacaaaatattcctatttacatgagatttgtgtaccacaataggctaaaagttttaggtttttttagagacagtgtcttgcaattttgtccaggctggacttgaattcctgggctcaagtgatcctcccacttgagcctcccaagtagctgagacttacaggcgcacactgcacccggcttaataggttaaaagttttaaagtaaatggcatttatttgagtcatcttatctttgatgttatggatctctgtcttcgtgtaaattatgtaacttctataaaataagatgtgccaattagaaaagaaagtggtaggaaaactggaatcatgtggttgatagtaagatgtcagggctttcctgataattaaaatatttaccaggtgaagactgctaacgctcaccaaaactcaacttccacaaaggaaataaccattctatcttcggattatcaaattcacaggcgtccagtacattgaccattatacattcatacatgacaaactgttgaccttcttgtgacagatgcttccgtggaaaaactaaacactgtgacactgctccctttgcacctactgtaccgttttcaaactgttgatgttactatctcccccattaggtgataaactcctggctcccagcaccgactcacaactactcagtttatttatttattttattttatttttattttattttattttattttattttattttgagacggagtttcactctgtcacccaggctggagtacagtggcgccatctcggcccactgcaacttccgcctcctgggttcaagtgattctcctgcctcagcctctgaagtagctgggattacagatgcacgccaccatacccggctaatttttgtatttttagtagagatggggtttcaccatggtggccaggctggtcttgatctcctgacctcaggtgatccgcctgcattggcctctcaaagtgctgggattacaggcatgagccactgcgcccagccactactcagtttatatttctttctttttctttttcttttttttttttgagacagggtcttgctcttgctctgtcatccagactggagtgcaatggtgtgatcagggctcactgcagcctcaacctcccaggctcgggtgatcctcccacctcagcctcccaagtagctgggtccataggcatgcacgccaccacaccctgataatattttttattacttttgtagatatgggtttttgccatgttgctcaggctgatctcgaactcctgggctgaagtgatcctcccactttggcctcccaaaatgttgggatcacagggatgagccaccgcaccccgccaatttatatttcttaagcccaaatgaaccacttttcttttttctgactttgatcctatctgacataatgcttagcccaatgtgaacaagcaggaagtttccataaagcaccagtcactgaggaaaaagtgctacctattcataagaaacttcggttcagattaccatgaggaagaatttaaattcctgaatgaaccagcaccttcgcaacttgataaactgggctttgctgaactaaaaagctttgcaagcacataaaggattttttcctcaaaacaattttattgtgttaagaatagtgcatgtaggctgggtgcagtggctcacgcgtgtaatcccaacacttttgagaggccgaggtgggcggatcacttgaggtcaggagttcgacgccagcctggccaacatggcaaaaccacatctctactaaaaatacaaaaattagcagggggtagtggcgggtgcctgtaatcccagctacttgggaggctgaggcaggagaatcgcctgaacccaggaggtggaggttgcagtgagccaggattgtaccactacactccagcctgggcgacagagcaagattccatctcaaaaaaaaaaaaagtcttccaactccagatacaagcgccatcaaaaagtgttatctgtgatctagcagatgactgttatctggacaagcacatagaaatgtcagagattctagactggcactgaccaatacagtagtcacatgtagctatttgaatttaaattaattaaaatgaaataaaatccaaaattcaattcctcatttagactagcaacatttcaagggcctccatggccattggtctcatactggataatgaatattttcatcatcacagaaagttctttgggatagcactgttatagactgtttcaaaggtctaatttacaccaaggatggaactatatagtctatatgtgactcagtagccagactaaatggaaagttggccccaggaatgagagaatgggagtaaaagtgtgtgagattgtatgtgcgtgtgtatatacatatatataaaacacaacataaatatataatatatatggaacttatatatatggaacaacataaatgtctataaatatcatatattcatagatacgtacatagtcaactcccaattcatccatttatctatataaaaaatatttattgaacatctgctatgtaccaagtattatactacgtgcaaggaaagcagatgtgaatgaccagtcccgggcctccaggagtttgcagtttgcagagaaggacaagccttagctagatgctgtggaacactagcatggctgcaaggggagctagccgtcctgaccacctgctgagctattgtctgcaggactcccatggtgtaggtttgtaggcacgcctccccccacacaaacattcacatgtgcaaaaacaaaacaagacaaaacttcacacacacactcaagaagccagttgtacgacatttgcaagtaaacagtaattagctaagattatcttatatcatattcattattctatacacagagctgcctatcatttgcagacttctgccagctgataattaagcaagtcttccatcaaaagctgtcaggttaaggggaaaaaaatcaaactaaaagtgtctcctgcatcgtcctaattgccaagacactgtgcatactcataacttttccgcctttttcctgctttcactttgcttcatctaagcccacattaaataggctattttttaagtctggtgtgttttttcctgatctgtttatttgtgctattaactgccagttattaagtgcctgtgccactgtaccaggcatttatacaaaatacctctaatcctcatagcaattatgtgaggtaggaattattattctcaatttatagatatggaaacggaatcagaggggttaaggaacttggtcaagatagataaatggtaaactgagatatcaaatcagggctgcctgactttcgtgcccgagctctttctcctgcaccaaaaagttggaatcattagaatttcccggccgggcagggtggctcacacctgtaatcccagcactttggaaggccaaggcgggcggatcacgaggtcaggagatcgagaccatcctggctaacacagtgaaaccccatctctactaaaaatacaaaaaattagctgggcgtggtggtgggtacctgtagtcccagctacttgggaggctgaggcaggagaatggcatgaacccgggaggcagagcttgcagtgaaccaagatcacaccactgcactccagcctgggcgacaaagtgagactcgatctcaaaaaaaaaaaaaaaaaaaaaaagagaaagaaagaaatcattagaatttagaatttcagagttataaatggcatactctgttccagccaaattttatgctatagagtcctgaagaaagagacaggcaaatcaatgattaaattacaagagtcatacgtgatagaggtacatattcagtacaggagatggagcaaggggcttattgggggcaaagggacttaagttgagtcttcaaagagtgagcagggctgagagagagggaagggcattccaggtaggaggaaccacctttacaaatgcatagaggcgaggcgcattcctgtggctataattcagtatgaatggacatgcttgcaggagcagggctaggaaattattatagtggacaaagaggtcgattaagaagaacccagccaagctaagaagttggagcttcatccactaataaagaggtgggtagtgaggggattaaagaatgttaagctgagaagtagctcgatcaggtctgaattttaggaagatcatgtaggcatcagagtgttgaaaatgcacatgttcacatatgtcgtaagcaggaaacataaataaatagcaacaggtgtaatagctgccatctaataatacatgacaaggtcatgcattggctccaggtcagtggtgccagagggagtgatggagattgtgagctggagtgagggcctctatggaaagggagcagtcgcctaggaccatctgcaaatgggacccaggattgtcggttttttgtttaagggaagtgggaaaatctttatttttatataatagctactgaattttagagatgaccaaacttatgtaggccaaaaacaaaaaaccacctttggtgatatgtttgtaagccttgggttaaagaatcttgaagggggcatgggccggaagaccagttaggaagttatttaaacaggtgagggccgggcatggtggctcatgcctgtaatcccagcatttttggaacgccaaagcaggcggatcacctgaggtcgggacctcgagaccagcctggccaacatggtgaaaccccatctctactaaaaatacaaaaattagccaggcgtggtggcacacacctgtaatcccagctacttgggaggctgagacaggagaatctcttgaacccaggaggcagaggttgtagtgagctgagatcacgccactgcactccagcctgggtgacagagtgagactgtgtctcaaaaaaaacaaaaatacaaaacaggtgagaagtactaaaggccactctgactcaggtcaaatggatcaattaatcttgagaagggtaaagagggctgtgaagaaagattacttaagattgctagggttttcttaaattccagtggtgttttggaccctcacatgaccatccaatcttggcaactataaccatttgggttaattctctaaacagtgctgccattagaaaggaaagggaggcccagcacggtggctcatgcctgtaatcccggcactttgggaggccgaggcaggcatattatctgaggtcggcagttcacgaccagcctgaccaacatggagaaaccccatctctactaaaaatacaaaattagccaggtgtgatggcacatgtctgtaatcccagctactcgggaggctgaggcaggagaactgcttgaatccgggaggcggaggttccagtgagccgagatcacaccattgcactccagcctgggcaacaagagcgaatctccgtctcaaaaaaaaagaaaggaaagggaatgttttgtggttgtgggcaccgtgcttactaagaagaaaaaggatgtacaatgtgcagatttttcagctttttggacaaatgtatatgaaggtattgaaccatgaagcagttcctttcatccccctcaaccaaaaagtggctgattcagatgaaaaggcacatgaattaagtcacagaaccaaagcaaaccttagcaacacgtgaggcttaggaaattgtttcttctcccctgcatctttataccattgaaataagattgaacggaacgccaaggagtgttctgaaacagagtgtagtcacaaagggaaacgttagtcccagaggagatgatgtgtggaaggaaggcacagtctcattaggtggatctggagagagagaaagagaattttacaacttttttggttgtaagcaagaagtagtgatgccatattctccactcaccatctccccgagtcactgcccagctgtatcatgtgttaattaattgtcatatgtataatttattattattattattattattattttgagacagggtcttgctctgtcacccaggctggagtgcagtggcacaatcatagttcacagcagccttgaactcctaggcttaagccatccttctgcctcagcttcccaagtagctgggattagaggtgtgagctaccacacccagataattaactttttttttttttttttttgtagagacaaggtcttgctacattgcccagactggtcttgagctcctggcctcaagtgatcctcccacctctgcctcccgaagtgccaaggttacaggtgtgagccaccatgggccatttatcctttattaaacatagaaatatctcattatctgatcccacagtgattctgagattgtatgaggataggccttacttattctattctgttttaatattcagtttagctactcaggaggctaaagcgggaggattgcttgagcccaggagttcgaggctgcagtgagctctgattacatcattgctctctagcctgggtgacacagcaagaccctgtctctaaaaaaactaaaaaaaaaacttctaaaaaaagattttgtttaggtgtcacctcctctaggaagattttccgaattacccccacgcatcctcaccgcccctgagtggattaggtgtgccctttctgagctcctaaaatctcagaatttttttttttttagacagtttcactctttttgcccaggctggagtgcaatgacatggtctcggctcactacaacctccacctcctgggttcaagtgattctcctgcctcagcctcccaagtagctgggattacaggcgtctgccaccacacccagctaattttgtatttttagtagagatggggtttcaccagtttagccaggctggtctcgaactcctaacctcaggtgatccacccacctcggcctcccaaagtactgagattacaggcatgagccaccatgcctggccaaaatctccaaagttattcttgccctgtggtttcattattttctctctctgtttctatttctcctactgattgaccttctaatgggggctcaagctagatgtctagtttgttttgtatccttatcgtttcctggagggtaagcactcaggacatgaaacatatggaatgaatgagcctgtgtagatccgacattgcttagtaaataactataccccttaccagccaggcaaagttgctcctttctctcagtctcagtcttttaacctgtaaaatgataattaccactgtcctgtctaccctgggggtgtaagaatcacatatgtaaaaattctaacctgtgaatgctatgtaattactacctacttataaacatatacttttggagaaaagggaggcagaagatttttttggtttttgtttgtttgtttgtttgtttgtttgtgtcagggtctcacccccatcgcccaggccggaatgcagtggcacaatcttggctcactgcagccttggcttcctgggctcgggtgattctcccaccttggcttcctaagtagctgagactacaggcacgcactaccatgtctgtctgattttttgtattttttaagtagagatggggttttgccttgctgctggtctcaaactcctgggttcatgagatccacctgctttggcctcccaaagtgctgggattacaggtgtgaaccaccatgtctggtttaggaagtttttttgttttttgtttttgagacagagtttcgctcttgttgcccaggctggaatgcaatggcacgatcttggctcactgcaacctccgcctcccaggttcaagcgattctcctgcctcagtctcccgagtagctgggattacaggtgcccgccaccacacccggctaattttgtatttttagtagagacggggtttctccaagttggtcaggctggtctcgaactcccgacctcaggtgatccgcctgcctcagcctcccaaagcgctgggattacagccacaagccactgtgcccggcctagaaagttcttttattgccaagcgtggtggctcacgcctgtaatcccagcactttgggaggccgaggcaggcggatcactgaggtcaggagttcgagaccagcctggccaatttggagaaacccctgtctctactaaaaatacaaaaattagccggacgtgatggtgcgcacctataatcccagctacttcagaggctgatgcaggagaattgcttgaatctgggaggcagaggttgcagtgagccgagatggtgccactgcactccagcctgggtgacagagcgaggatccatctcaaaaaaaaaaaaaaagaagaagaagagtgtagtgctttaaaatatgaagataaagtcactgactgcccatcaagtgggacagcttttcttctggtaatggggatacacctgtgcatcccactgtcacctgggactcctcagtgatccatgatttgacatgaagacactatcagctaaaaagcagggcagtctcagggtgcactttggaagtgcttaagggatctatattttgaactccagaaacggaacttccaaacttggactttatcacacctcctcaggcagccccacacttctataacaaacgagcttgaagcacactctctctcaagttatgatggataatattgcctaggcaatctaattaagcgcttggtaaacagaatcttaatttacacttagtccagaaggaacggcaggaatttatctcccttcccccagggaagacttgaattgacaagttgagggaggaaggccagttatattttaggcttatacattgtatctatcagagaagtgctatgatttcttcccaacacaggggaggtttggtgggctgcaaaatgggactaatttccaattttttccatttgtcagatcttcagaatctggttatactgttgtggtggtcgtggtctcaaactcctgggctcaagcgatcctcccgcctctacctcccaaagtgctaggattacagctgtagctgtgagccactgcgcccagcctggttatatcatttacttaagagaaatgtgaattcccagaacaggaacttcagacataaaaccaaagattttacaatgtaactactagtgatttttctatcacaggtggttcaaagttagtgtacatgccatcaacatgataataaagaatggcagagaaatgaatcatttgttaactaggggcagagtgattgatcttttaaaggctctgcttcacgctctgcagcggcttcccacggccctggaggtagagcaggaaccctcccctgggccctcctggagggaggtgtctcctgctacctctccagccttatcccaggcttctctgagcttcatcagggaagggatgaagggacccacttgttcccagagcctgcgttggtgtcctgcctgccatggaaatactcttggcctcctaaccctgactcagcctttagctctcagcataaccctgacggcccagaccaactaatgtcctccagactgagctttcctccccagtcacagcccacagctccctttccgtcgtgcttgttatactgggaactgttgggaacgtacacctacctcaaaggagtgcatcagtgcaaagggcctgctcatgggagcattctgcaaacattagctcttcaccatttgtttgtttgtttgtttgtttgagacaggatctcactctgctggagtgcagttgattgcatggcgcaatcacagctcacagcctcaacctcgcagactcaggtgatcctcccacatcagccttccaagtagctaggactacaggcattccccagcccgctaatatttgttattgtttttgtagagcaggggtctcactatgtttccaaggctggttttgaactcctgggctcaagcgatccatccgccttggcctctcaaagtgccgggattacaggcatgagccaccgcacccattggttatgtttgtctttctccctagattgtaccctctcatttattctataacccagacctcccacagtgaggactgtgctgaatcgcaggtgctcaataagtacttgttgaatgaaggactatataaaaattggttggccgggcacagtggctcatgcctgtaatcccagcaccttggaaggccaaggcaggcagatcacctgaggtcaggagttcgagaccaacctggccaacttggtgaaaccccccccccatttctactaaaaatacaaaaattagccaggcatggtggtgcacacctgtagctacttgggaggttgaggcaggagaatcgcttgaacccgggaggcggaggttgcagtgagccaagatcatgcgattgtactccagcctgggcttcaagagtgaaactctgtctcaaaaaaaaaaaaaaaaaaattggttgaatggggagtggggagttattatgcaatggtacagagtttccatctgggaagataaaaaaagttttggagatggaaggtggtgatagttgcagaagagtgtgaatgtctttaatgccatggaactgtacacctaaaacgggttaaaatatctattggacaagagattggtgtaaaaaaaaaaagaattaaaaaaatttttaaatggttcaaatggcaaatttcatattatgtgtatttcaccataataaaaaagtggctcatgcctgtaatcccaacactttgggaggccgaggtgggcagatcacgaggtcaggagattgagaccatcctggctaacacggtgaaaccccgtctctactaaaaatacaaagcttagctgggtgtggtggtgtgtgcctgtagtcccagctactcaggaggctgaggcaggagaatcgcttgaacccgggaggcggaggttgcagtgagctgagatagcaccattgcactccaaaaaaaaaaagtgctaaataaatgtataaataaatttgaaccagctcctatccgactctaatatttcaattcaataaacattcatagggtgcctgctcttggtaagacataaagtccactcttggacttatttaatagtatataaaatagactaaaaattgaaatccgattgcccttcgtgtgtaaaacatgttttaactagatagccaggtcttatttatctttataccccgagcagccagcacttaatatgtgcttaatatttgctaaatcgaaaatagtgcacagacaaaaattcagtatttgttcaggcctttccccattacaaaatgctcccacaaacaatacaacatttcctgttaccattaagattctttgactttcaccctttcttctctttccccttacttttgtgttttttttaatttgttttttttttttgttttttttttttttgagatggagtctcgctctgtcacccatgctggagtgcagtggtgcaatcttggctcactgcaaccaccacctcccgagttcaagcgattctcgtgcctcaggctcctgagtagctgggattacaggcatgtgccaccacgcctggctaatttttgtagttttttaagtggagacagggtttcaccacgttggccaggctagtctcaaactcccgacctcaggtgatccacccgccttggcctcccaaagtgctggtattacaggtgtgagccaccgcgcccggccttcatgttatcagccacgtcttcctgactttctgttgcctgaatcaacacatcttcttcaatttctttatcccttgtgttactattttcaactgcccatttctggctctcattccctgacatctcagcaaatgtttctattttatacctaaacagttacatttgactcggaggtggaaggcacattactagcgtaaaggtcagtttggcagaagccaattaggtcacatgcctgagaatcctgagagccatcgcccacctgtcgcaaaaccttctgggcatccttgacagcaagtatcactcatccagtttcaaaaaggaattgcacactgcttgtctactatctgtagtttaaatggtgatcatgtttcttcccttataatcaacttcaggctttttataaagaaaggaagtatagtttagataagcaacatactgtataataaaaaattaggaggcattataaaaagaagggaacaccaaaagtatgaggttaatcagagtgataaataatatttctgggcaggtgtggtggctcacgcttgtaatcccagcactttgggaggctgaggcgggtggatcacttgaggtcaggagttcgagacctgcctggccaacatagtgaaacctcatctctattaaaaatacaaaaattatctgggcatggtggcacaggcctgtagttccagctactggggaggctgaggcaggagaatcgcttgaacctgggaggtggaggtcacaatgagctgagatggtaccgctgcactccagcctgggcgatagagcaagattgtcaaaaaaaaaaaaaaaaaaaaaaagagagagagagaaaaagaaagaaagaaaaaaaggaaataatgttccttattttcaaggtctgatgtcatatggtagctactatcaggaggaaggacccctttaaacccagattttcaatgatagacaaggctatagtttgaatatgacccccaaagttcatgtgttgcaagcagaatccccaaagcaacagtgctgagtggtgggaactttaaaaggtgattaggtcatctgcgttcatgaatggattaatgctatgatctcaggactgggttccgttaaaaggatgagttcagcctctgtcttctctctctctcacacacacactcactctctgccccctctcttctctcttctctttctctcattctctcttgcccttctgtgataatgtggcaagaagtacctcaccagatgcagacctcaccagatgcccttcaacgttggacttcccagcctccagaaactatacccagtctcgatatctgttacaggacacaaaatggacgtagacaaaatagaaacaagtagagaggagacaatagtttcataagaagctgggagtctcatttggcttccatatgcctgatgcctttgacatctaggcaaaggtctcattctaatatccctagtagatttgacacagcacagcagttaagagcacagacttggccgggcggggtggctcacacttataatcccagcacttttcgaggccgaaggtgggcagatcacctgaggtcaggagttcaagatcagcctggccaacatggtgaaacccagtttctactaaaaataccaaaaataataataataataactgggtatggtggcagatgcctgtaatcccagttagtaccagactctggcgctgggctgccagaggaagaaacctttttcttttacttactagctttgtgaactcaggcaagtttcctagcctgtctatgcctcagttttctcctcattcaaaaaatgaaaacaacaagatataccatagagtttttgtgagcattaaataaattaatattcgcaaagcacttaaaacgataccaagttcctggcattgtatcaatgtttgataagtaaattacattacaaatatagttatctcacatcttagcaccctatagtttacaaattaattttggtatactagcctcatcaaattctcacaattccgaggaaggtattattaccttgatgtgtggatcaagaaataaagtttcctaagtgttttgtgaggttaatgatttgggacaaagttgaccagaaagaaaaataatttcatctattttatttctatgcttagttcaagggaaaagggtcagcaccttttctcccattttcatagcagagagcacggtggttaatcacttactttttctttggttaccgatatggtttggctgtgtccccactcaaatctcatcttcaagtgtagcgcccataatccccacgtgtaatgggagagacctaaagggaggtaattgactcatgggggcgggtctttcccgtgctgttctcatgatagtgaataaatctcatgagatctgatagttttataaagggtagttcccgggcagatgctctcttgcctgcgccatgtaaaatgtgactttgctgcttcttcgccctccgccatgattgggaagcctccccagccgtgtggaactgtgagtccattaaacctctttttctttataaatgacccagtctcaggtatttcttcatagcagtatgaaaatggattaatacagttactatgataataagtagaataccttccattgaaacatagtttgtatatgtgtatctgtgatatgtgacatattgcatgtatctcttccaagaaagttttcctattactaagtcctttattactaaggacctttggggaacaatagtaatttcatacatattagttttaatggtgagtgttacacttatgctcaacttctcggctgaagttcagtctttgcctgtagagggaagctcactgtagactctggactgagtcttcctcttctccaacacacaccagagttatggaagaagtttgttttctgctctgcagtattggtatttcctttttccctttttttcttttcttttcttttttttttatttttatctggagacaaagtctaactctgtcacctaggctggactgcagtggtgcgatgtcggctcactgcaacctccacctcccaggttcaagtgattctcctgcctcaccctcctgagtagctgggactacaggcacgcgccaccatgcccagctaatttttgtatttttagtagagacagggtttctccatgttggttaggctcgtctcgagctcctgacctcaagtgattcacctgcccctgcccccaaagtgctgggattacaggcgtgagccaccacgcccggcctcttttcttttcttttctttctttttttttgttttcaatagagacagagtcttgttatgttgcccaggctggtctccaactcctggcctcaagcaatcctctctcacctcagcctcccaaagtgctggaattacaggcatgagccactgcacccagccagtatttcctattttaaacaggatactatgcatgggcaaaggttctcagggtagctggacaaaccggagaggcaggattgccttcctcctcaggtcttgggtgctcctagacacagcagagtggtgtcaagcacacaggtttgggaatgaggagctgaactgtctgggattgaattccagccgtacaattttctagctgtgtgactttcagcaagacaatcattctctctccatttcctcatttacgacgtggagatattgacagtatctaccttattggattattgggaagattacgtggttaatgccagtgaagcccttagaacactaggcccagctggctcatacaaacattccgtaaacgttatctattagtattatgtcctattttgcttaacacactcatcatcctgtcgtctaagtcaatagctttcaaacatttttgcccgtgacttccagtaagaaatatattttggccatgcacggtggctcatgcctgtaatcccagcacttggggaggctgaggccggcggatcacaagatcaagagattgagaccatcctggccaacatagtgaaaccccgtctctactaaaaatacaaaagttagctgggcgtggtggcatgtgcctgtagtcccagctacttgggaggctgaggcaggagaatcatttgaacctgggaggcagaggttgcagtgagccgagatcgtgccactgcactgcagcctggcaatagagcaagactctgtctcaaaaaaaaaaaaaaaaaaaagaaagaaatatatttacatcacaatcgactacatacacacataaaaaaactagattgaagtttcacaaaacatgaatactcttactaatacattgtactgtcttaatttctattccccttttaaaaatggtggtgcattattaaattgatttcacgacccgataatgggtcagttagaaaaactgggctctttgataggctattcactaggctgaataatgacccctgagatgtccatgtcctaattcctgcaaaagggactttgcacatgtgattatggttacaaaccttgagatgtggtgattctcctggattatccagctgggcctagtctgtcaacgtgagtccttaaaagtggagaaccttttctggctgtgatcagatagagaggtgaccatgaaagaagggtcagagatgcagaaggaaaaggactcagtcggccattgctggctttgaacatggaggaagggggccacaagccaaggaatgtggatagctgctagaaaatggaaaaagcaggaagacagattccttctgagagcccctagaaagaaacacagccctgcaacaccttaattttagcccagtgagacccctctcagacttctgaccaccacaattgttagataataaatttatgttaagacactagatttgtgataatttgtcccagtagcaatagaaaactaatatattatgtaagccagaagccttgactttactgtttccctagacttttcttttttcttttatttattttattttattttattttgagacagaatcttgctctgttgcccagtctggagtgcaatggcacaatctcagctcactgcaacctccacctcccaggttcaagcgattctcccacatcagcctccggtggagctgggattataggcatgcaccagcgtgcccagctaatttttgtatttttagtagagacagggtttcaccttgttggtcaggctggtcttaaacttctgacctcaggtgatccacctgcctcagcctcccaaagtgctgggattaaaggtatgagccactgcactggcctagacctttaatttaatggtctttaatgtcattaaatttaatgccacctagtcctcttgcttctatctttgaatatctctgaaaaaatccatatgtttccccaattttcatggctcttgccctcattcagttcctatttatctctattttgaattattcctacttctgggcccctatctgtgctacatcctcttccttctggctttcagagttaagttaataaactaccaatatgattacctcttggcactttttttggggggttgggggagttggagtcttgctctagtcgcccacactggagtacagtggcgcgatctcggctcactgcaacctccacctcccgggctcaagcgattctcttacctcagcctccgaagtagctgggattacaggcacacatcaccatgcccggctaatttttgtatttttagtagagacggggtttcacaatattggccaggctggccttgaactcctgaccttgtgatccacccgcctcagcctcccgaagtgctgggattacaggcgcgagccaccacgcctggccaggcactttgttttttttaagagattggggatgggggcaccttgctatgtcgcccaggctgatcttgaactcttaacctcaaaccattctcccaaagtgctaggattacacgtctgagcctccacgcccagctcttggcacttctgatgcctcaacatgcttccagaataaaatctgaagtcttcagagcaatcgccaaagctttgcggatgacccagttcaaatctatgaggacacatttctctgctgccattttccccattctggcctcttagagtattatatttataaagttagttttccatgtcactttattatagttggttatctatttttttggttttaaaaaatgtgcttcctcagggccaaagaagccacaaagaatatgccctgcctgccagtcagtcagctccacctgtgtgcccgtctaaggcctcatttattatgtatatagagtatggctctccaatcacaatgtgctttattttttaattagggctttagtggccaagagaactctcttttccatacttgagcaaaataaataaatcaatcaggagtgcattttttatctgcatcttttattttaataaatctcatcaaaaatttgtatcaacctatgcatttgaacggtcttgctagacctaacatcaaaacgtggatgataaatgcatgaaggagccgggcacagtggctcatgcctgtaatcccagcactttggaaggccaaggcaggcagatcgcttcaggccaggagtttgacatcagccaggtcaacatggtgaaaccccgtccctaccaaaaataaaaaaattagccgggtgtggtggcgctcacctgtaatctcagctactcaggaggctgagacaggagaatcacttgaacccaggaggcagaggttacagtgagccaagatcgtgccactgcactccagtctgagcgacagagtgagactccgtctcaaaaaaaaaaattacttctttaaaggcactatctccaaatagagtcacattcttaggttcttggtgttgggatgtcaatatatgaattttggagagacataattcagcccataatgaatagtgaggatatcacctcctaactcagctttgcgcatacacagagttctaacaaatctcttctaggtgcatcttcaagcccctgttacgatcctcctatttgggtactacatttccattttcctatctcaaggctgagttctaccctgcagccctaatttgggctcaaaaggaattccgtcttttcctatggtccctcacacacccatcccttgttctttggttataacccctccacctgccacagcctcaccaccaactcagcttgcccagcactgccaaaaaatttttccccttctttctgacgtttcggacttggattcttttgaaaactatcctgagcccttatatttgcaatggaattttttttcttttttttttttttttttttgagacagaatcttgctctgtcgccgaggctggagtgcagtggcgcgatctcagctcactgcaacctctgtctcccaggttcaagtgattctcctgcctcagcctcctgagtagctgggattacaggcacctgccaccacacccagctaatttttgtatttttagtagagacaagatttcgccctgttgcctaggctggtctcaaactcctgacctcaagtgatccacctgcctcagcctctcaaaatgctgggattacaggtgtgagccaccatgcccggccttgcaatggaatttctgagagatcgtgttccactcttgcttcccctttcttccctctatgccctgcatttttaaataagtaactttaggccgggcacggtggctcatgcctgtaatcccagcactttgggaggccgaggcgggcggatcacgaggtctggagatcaagaccatcctggctaacgtggtgaaaccccatctctactaaaaaatacaaaaaattagctgggcaaggtggtgggcgcctgtagtcccagctactcgggaggctgaggcaggagaatggcgtgaacctgggaggcggagtttgcagtgagctgagatagcgccactgccctccagcctgggcgacagagcgagactctgtctcaaaaaaaaaaaaaagtaactttaatgttattaatattattattttttttgagatggtgtctcactctcacccaggcttgagtgcagtggtgtaacctcagctcactgcagcctctgtctcccgggttcaagtgattctcctgcctcagcctcctcagtaactgggattacaggtgtgtaccaccatgcccagctaatttttgtatttttagtagagatggggtttcgccatgttggccaggctggccttgaactgctgacctcgaactgctgatctcaggtgatccgcccacctcggcctcccaaagtgctgggattataggtatgagccaccgcgcccggccaaaagtaagttttagaattactcaactcctgctaggcacagttatgtagattccactaatggtcacataacttgagtccagattctcaggtgcattatctgtccaattagaaagttgtaaagatcattttcaacgaagccagcaggaacacctttcattaaacatttcaagtatgtaatgtggggaggctcttcctcttcttcctcctgtttctatttgcagtttatgtttttttgcatgaggcattcttgcttcatggaccaggttcaaacttgaccaatatacctgaccacccagaatctgtgtcctagtcctcggctgtggtctgggaatagcggtagctcctcggaaggagtgagtcagtggcagagtgatgcgatgtgctggcaatggggatggatttgaagaccagtggctcatgccttgagctatcacaggcccaagttcagtgtcctctcctgggaaacttggtggtttgtgcctgtgtatgttgagagtaggcaagggtagcattcctgatctaggcagagccttatttgaaagacttctgttttcatttttgttttattttagtttggagtgtgtgtgtgtttgtgtgtgtgtgtgggtgggtgtgtatatgtgtgtgtgtgtgtgtgttttaagtggacattaaaaattccaagcctggctgggccgggcacggtgactcatgcctgtaatcccagcactttgggaggccgaggcgggcggatcacgaggtcaggagatcaagaccatcctggctaacacagtgaaaccccgtctctactaaaaatacaaaaaattagccgggcgtggtggcgggcgcctgtagtcccagctactcgggaggctgagggaggagaatggcatgaacccgggaggcggagcttgcagtgagccaggatcgtgccactgcactccagcctgggcgacagagcaagactccgtctcaaaaaaaaaaaaaattccaagcctaaggcagaatcaccctgaaggatgctaagtgcaactccaattccaggatctgctgtctaaaaatacaaattccattttcagacacacgaagcatcatattagacagcaacagtgtctgctttgatcttggttagttgagattgatcatttgcattcaaagttcatattaatattcaggctaacaggtaaagctagcatgctgaggttggagagccagcccacttgttaactattataattgagataggctgtggtcattaatgtaaatgacagtgactccccttggtcttctggttagtaataaagaaaagagctctgaatgaagatcaatggatctgattcaaatcccagccctaactcaaacattctcttaacctctctgacagcattctcctcttttgccaaaggatcataagaatagcttctatatgcactaaacttgtatttaagatttttttatcattttataaaaatgatacacatacactgtttaaatagtgagatagtactataaggtttattacaaaaaacagcagttccctgcctgtgacagattgtattttccaaagatggctacaatatctcccagctcacaatgcttttcttccaatgagaccatgacatttctcccacagaatggagtagggggctctgtgtttcctcccctctaacctgggtggatcttggtgactgctttgaccgatagagcatggcggaagtgatgctgtattcatcagggttctccaaagaaacacaaccaataggagatagctacatctctctacgtatttattttgagacagtgtctcactctgtcacacaagctggagcgcagtggcacgaccatgcttccctgcagcctcaacttcccgggctcaagcgatcctcccatctcagcctccttagtagctgggactacagacacacaccaccatgcctggctatttttttttcttttttatttttttgcagacagggtttagccctgttgctcaggctgatctctgaactcctgaacccaaggaatccacctgcctcagcctctcaaattgctgggattataggcatgagccaccacgccagccaggatgaaggtattctactctctttctctttcttttttttttttgagacgcagtttcactcttgtcgcccaggctggagtgcaatggcacaatcttggctcactgcaacctccgcctcccaggttcaagcgattctcctgctttagcctcctgagtagctgggattacaggcgcccgccaccatgcccagctaattttttatatttttaggagagacgaagtttcactatgttggccaggctggtgtcaaactcctgacctcaggtgatccacccgcctcggcctcccaaagtgctgagattacaggtgtgagccaccgcgcccggcctctactctcatattatcccagcctgccacttctacttcctcaaccctgcaaacataattatatcaagatattggttaagccaatatttattattgaccctattatttctatgtgagtgttgttcactgttgagctaagtaatgcattcgcattacattctctttcttatactatttaatttcccatttgctcaatttcccatgtcattattactatttctttccacattctccaactgaattgcaaaacccccgcataagattttctacgtggtcaaacacacatgaaataatgtagctatcagtgtccattttcccctggacttcagggccccagttcctttctggactggctctctctgggtgtagctgccgtctggaggcccctttcacctttctcctgggtcagatccctttgtcctgactgtggtcctactcttcagtgggttatcccctcattctggtggagtgtagcctctggtggctctggaagaaggtgcccaggaagtgaaaatgtcttttttttttttttttgagatggggtctccctctgtcacccaggctggagtgcagtggctccaactctgctcactgcaacctccacttcttgggttcaagcaattctcctgcctcagcctcctgagtagctgggattacaggtgcgtgccaccatgcccggctaatgttttttgtttttagtagagacggggtttcagcatgttggtcaggctcgtctcgaactcctgacctcgtgatccgcccacctcggcctccccaagtgctgggattacaggcgtgagccaccatgcctggccaggaggtgaaaatgtctttattttactctctcatttgattaatggtctggtgaggcagagaattctaattcaaaaaattattttttcctcaaaatattgaaagcattgttttgttgtctgccagtttccaatgctgttcttgagagttccactgccattctgattccagaatctttatgtgtaatatttattttttgccttctatggattaatgttttctcttcatctccagtgttccgaattttttttgttgtttgtttttgagacagggtctcactctgccacccagactggagtgcagtggcacgatcatagctcactggaacctccacctcccaggctcaagcaatcctccgcctcaggctcctgagaaggtgggaccactggcctgcaccaccacactggactaactttttgattttttgtatagatgaggtctcaacatcttgcccaagctgctctggaactcctgggctcaagtgatcctcccaccatagcctcccaaagtgctcggattacaggtgtgaaccaccgtgcccggcctcttctgaaatattatgaagatatgacttagtgtagatcttttcattaatttttctggataggccctttgaatctagaggcccactctcctgagtttttttttctttggtaattttctcttctctatattctacttattaaattcctggccgggtgtggtggctcatgcctgtaatcccagcactctgggaggcagaggagggcagattacctgaggtcaggagttcaagaccagcctggccaacatggtaaaaccctttctctattaaaaatacaaaattagccaggtatggtggtgggtgcctgtagtcccagctactcaggaggctgagtcaggagaattgcttgaacccgggaggcagaggttgcagtgagccgagatcgcgccattgcactccagcctggggcaacaagagtgaaactctatctcaaaaaattaattaattaattaattcctattagttggctattagactatctggataatcctttattttaaattattttcttgcttgtcgtccatttatttctatattatgggaaattgcctcatttcccataaaatttgctgtcactttatcttatctctctctctgagaacagcaatttcatctatttctggaagtgtttgtccatgtcctgcattgcctttttcttcaaaattttccccatcattcgtttgtttattttagtccttgtctttcatacgggatcatggaatgcccagcaatccttgtaggaccattcacattaaacagtgactcactacaaagctgagaggaaacatgagcaaggcttggtaatgttgaacttcactccagggtgatagggtcatgcctgttcagagagttattttctttttctttcctttctttctttctttcttttttctttttttttgacggaatctcactctgtcaccaggctggagtgcaatggtgcgatctcagttcactgcaacctctacttccctggttcaagcaattctcctgcctcagcctcccgagtagctgggattacaggcgttggtcaccacacccagctaattatttgtatttttagtagaggcggggtttcaccatgttggctaggctagtctcgaactcctgaccttaaatgatcttcccacctcggcctcccaaagtgttgggattacaggcatgagccaccgcgcccgggtatttatttatttatttatttatttattttagagacagtgtctcactctgtcacctaggctctcactgcagcctccatctcttggcctcactcaatcctcccactttggcctcgcaaaatgctgggattacaggcgtcagccaccacgcgtggcccagctatttaatattttaacggaacagtttttccaagaaaaactcattcttctacctgagaacaggggtggggctaccatacactctgaggacaagcagggatagggcctggctgcatttcatgtagcccctcttgctttcagcccagtgcctcgtccctgccttccagaatgtcagctgttcccgaatctggacccctgcagttccatttccccaaaaattagcttctggactcgtgccggcagggcgggggcagggtggaggggaggagtgttcacctggctatgtggagaggtggagggaacatgatgggaactcttccacaggtttggaaccagtttccctgtttccagccccacttggcagaacctgtctctcgcagtccgagcctttaacggttttttgtgtacatcagcatcctcctctgatctggtgccgcttccctgctatgtgagttactcgcttcttatgacttccgtagtctcaaaatatactgctgtcattcactgtaatattctcttctgttctctttgatgctatgggtttagactcattttatttcttttctgtcattttagtagaccccaggaagccatggagacaaacattgtgttgactctgctgtgtttaatcagcaatctccctacctacttggtaagattatcatcagtatcaacttggacaatatatgcaagtgctttgcaagctctaaaatgtcatccacgtgtgatttactatcatttgatccctaagacacctcgagagatttttttctgctgtgacttttctcttgctacttttgacaaaacgagcacttcagtgctggcagctgtccatctagcaataatctttaaggtcccaaacaagatgaaaatgactaaaacgctcacaattgtatgtgttatacaaaagaagttgaaaatgccatactgaatggtaggctaaatgaaatgtactatgctagaatttccagcaaaagtctcttaaaagctgggtgcagtcatgtattcctgtagtctaagctacttgggagattgaggtgggaggatcatttagggtccaggagttcaagaccagcctgggaaacatagcaagaccccatctctaaaaaaaaaaaaaaattctttctgctccgctcacccacaaaacccccaggtaagtgcgctacttgcccctgtgctccacaggccctgtgcacagaactcttacaccactgcccactctgtggaaattgtttatttcttgttggttgcaccctctggttatgggttatgtcttactcatctctttatccccagcacctagtagagtgcctggaatacagtagctcctcaatatttaatgattcgaaacactgcagacaaccgcattcaaatagtatcccgtttttttgggaaaatgcttctaaaggggatgaccagatattccacttgaaatgttaagaaaacaaaaattggaaattctttctcctttttttttttgagacagagtttccctcttgttgcccaggctggagtgcagtggtgcgatctcaggtcacggcaacctccgcctcccgggttcaagccattctcctgcctcagcctccagagtagctgggattacaggcatgctccaccatgcctggctaattttgtatttttagtagagacggggtttctctatgttggtcaggctggtctcaaactctgcacctcaggcaatccgcctgcttcggcctcccaaagtgctgggatgacaggcgtgagccgccgtgcccagccttctttctcccttataaagacaaaggaggctgggcttggtggctcacatctgtcatcccaacactttgggaggccaaggcaggtggatcacctgaggtcaggagtttgagaccagcctgaccaatatggtgaaactccatctctactgaaaatacaaaaatcagctgggcgtggtggtgggcacctgtaatcccagctactcaggaggctgagacaggagaattgcttgaacccgggaggcagaggttgcagtgagctgagattgcaccactgcactccagcctgggcaacagagcgagactccatctcaaaaaaaaaaaaaaaaaaaaaaaaagacaaaggagaacattttggatctgtctgacagcttgcttcatcttttcatgcaatgggagaagaaggatagagaaataaaactccagttctggcagcaccagacagcccagacacaagtgttaagcacaaaaggagaggcagcatggatcctggcagctcttgtgttgcatgaaaaacacctgctctgttggcagccaggagagaaaaaccagaatagcacaggctcacccactcacgaaaacacaggaactcccctgtatgtaggcaagaggggctggggagcatcagcagacaggcctagtgaagcttacctggaaaatgtaccctatactctttaaaaggacttgaatttccttcagaatgagaagagaatgaaattcaacacctttctttcttagaggcagctaggcctgatcagagcccacaaggttgcaagcttgccggaagcttgactcagccaggactagccacacacgaatgaggcctggggccagaatcgcccctgggggaggctccctcggccacactgtgaggaaattgctgaggaacatgccatccactctgctgggggtaccccacagtgggcattgcactcagagttctgggggaatggggcaagatttggagataacagtattgagaacactgagggcagcaaccaaaataagcaagcaaggagacctacaaatcaggaaacatggcgacagggaaggcctgagccatgaagaccacggtattaacccgcgaggatgaccctcttgtatcttcaacatcatgtgtccaaaatagccctttgagatgttccttaagaaaagcgttcatgggcccggcacagtggctcacacctgcaaacccagcactttgggaggctgaggcaggaggatcacttgaccccaggagttcgagaccagcccagggaaaataaggagtcccccatctctaccaaaaaaaaaaaaagacacagagagaagagttctaccagaaaatcaataccacatgttttcacttgtaagtgggagctaaacactgggtctgtacagacataaagatggaaacaatggacactgggcactccagaaagagggagtggggaggcagacggggttaaaaaccacttcctgggggccctgtgtccacagtttgggagacaggttcaataggagcccaaacctcggcattatgagtatatccatgtaacaaatctggacatataccccttgaatctacctttttttttttttttttttgatggagtcgcactctgtcaccaggttggagtgcagtggcacaatctcggctcactgcaacctctgcctcccgggttcaagtgattctcctgcctcagtctccagagtagctgggactacaggcgcgtgccaccacgcccagctaattttttgtattttttttagtagagacggggtttcaccatgttggccaggatggtctcgatctcctgacctcgtgatccgtccgccttgggctcccaaagtgctgggattacaggcgtgagccactgcacccagtcctaatttttttttttttaattaaaaagaaagggttctatggtcacagaaatttgggaaatgctgcctgcaataaacccccatagggatttacaatgaacagtaacctctggaaggccctgagcagttcttcaagaaaggaaaaagacaaaaacagaaaaaatgacacctggatttcccactttccttcaagcaaggcctgttaacatcctgcagaactagtgttccagggaccataaaatggtaactgctgttctacccagccttgacagttgaagctcgtctttagcaatgacacaactttcagaattttgtagtgaaagatacgttttgttataaacattagttgtgaatttttaaatccttttttctcaagtaacatctcacagcggaaaatccaccatgtttctgaaatgttgttttgtttttccaattaacttttttttatatagactcaatttgtttagcactgtttgggcaaaactgagcagaaagcaatgttcccagatgcctcctccccacccctccccctcagactcccccatatcaacacatagagtgccccacagtggcacattcttacgaacaatcaacgaacctgcacagatagtcattatcacccaaagtccgtagttcacattggggttcactcttggtactgtgcattctatgagtcttgacaagtatatgatgacacgtatccaccagtgcaataatatacagagtcgtttcactgccctaaaaatcctccgtgttctgcctgttcacccctccctcccactaacccctggcaactaccaaactttttactgtcatcatagttttgccttttctagaatgtcatataattggaatccttataatgtttttgtttttgttaaatcttatggtatttctgtgtaaaaggaaattaaagagagagagagagaaataacaccccttccatggaagatcactggctcattctttactttataacagggtttctcaaccttagcactattggtgttttgcaccagataattctttggtgttgggcagggaagggggtgttgtcatgtgtggtttatttttttttttttagatggagtctcgctctgtctcccaggctggggtgcaatggagagatgtcggctcactgcaacctccacctcccgggttcaagtgattctccggcctcagtctctcgagtagctgggattataggcacccaccaccacgcccggctaattatttgtatctttagtagagatggggtttcaccatgttggccaggctggtctcgaagtcctgacttcgtgattcacccgcctcggcctcccaaagtgctgggattacaggtgtgagccaccgcgcccggcctgttttgtgtattttataggatgttcagtggcatccccagcctctatccactatataggaaggaccaccttcccaagttgtgaccatcaaaaacatctcagacattaccagatgtcccctggaagcgaaatcattcggactgagaaccactggtctaaaggagacattcaaacttcatcagaaaatctcacaaatattttatatgtagtcatttacctctggtaagcatttggccacctaaaatgtttggtaagggtcgggcacagtggctcacgcctgtaatcccagcactttgggaggccgaggtgggcagatcacctgagatcaggagttcaagaccagcctggccaatgtggtgaaaccccgtctctactaaaaatacaaaagttagctgggcatggtagcaggtgcctgtaatcccagctattcaggaggctgaggcaggagaatcgcttgaacccaggaggcagaggttgccgtgagtggagatcgtgtcactgcactccagcctgggcaacagagggagactccatctcaaaaaaaaaaaaaaaaaaaaaaagccttggtaaggagtaggaaaatgaggtatagagatcaaggagttgcagccgaaatctacaggatgaccacgaatatggacttttaatctcacacaacaaactgtattattctttaagcaaaacagcacataagcaaatcagataataaaagttttttttttttttaaagagattttctccttgaaaccttgttaaaggaaaatacttgaaccctcgttttggggttgttttcatgtcgtctctagatctgaaaagagtttgatcctgttcagatgttctttaaatgttcatagaaggtaaattcttgctctctttaagaattaaaagctaatacttgacataactttcttagactataaaatacatctgataaaagtctactttaaaaaaagcatttgctgggtgtagtggctcatgcctgtaatcccaggactttggtaggcctaggcatggtggctcatgcctgtaatcccagctgcttgggaggctgaggcaggagaattgcttgaacccgggaggtggagattgcggtgagccaagatcacaccattgtactccagcctgggcaacaagagtgaaactccgtctcaaaaaaaaaaaaaaaaaaaaaaaaaaaaaagcattagaggccggctgcgagtttcatgcctgcaatcccagcactctgggaggccaaggtgggcagatcacttgaggccaggagttcaagaccagcctggccaacatagcaaaacctcgtctctactaaaaatacaaaaaattcactcgacatggttgtgtacgtctgtagtcccaactgctcgagagactgaggcaggagaatcacttgaacccgggaggcagaggttgcagtgagccaagatcatgccactgcactacagcctgggtgacagagcaagaccgtctcaaaaaaaaaaaagggttagaaatttagagtgagatacttctgctccaataaactgtggcccaagcgtgtgagaccacatactaaaaacaggccaggccagacacggtgactcatgcctataatcccagtgctttgaaaggctgaggtgggaggatcgcttgagttcaggagttcgagactgacctgagtaacatggggaaaccctgtctctaaaaaaaaaaaaaaaaaattaaaaattagccaggtgtggtggtgcatgcctgtagtcccagctagtccagaggctgaggcaggaggaaggttgcaatcaggagttcgaggctgcagtgagctatgatcatgccagcgtaggcaacagagcagggataccccatctcaagaaaggaaggaaggaaggaagaaaggaaggagcaaacatcccaaaaggtagtttgagaagagggggaactcttacaatgtcacttaccagaatagaccaacagcaattttttagtgacatgcttttgattttagtcccaaatccctagtttttattgaatgtggccagcaaagccctgcatggtgtgatccctgcccacccagacagtctctctcacgtgactcctcccagccccaccccacttctcagtcagattggacttcttgccaccgcagggtttttacctctgctatttccactgcctggcaccatttcttcctctcatccttatcctgtctcagcctattcagtcttagtccattcggggtgctataacaaaatagcataactggccgcttacaaacaacagaaatgtattatctcagaatgctgaaaacagaaaagtccaagatgaaggcgctggcaaattccgtgtctggtgagtgcacacttccggttcggagacggcaccttctcactgtgtcctcacggtggaggggactgggggctcgcagggactcttttttttttttttttgagacggaatttcgctttttttgtccaggctggagttcaacggcgcgatctcggcgcgctgcaacctccgcctccccggttcaagcgattctcctgcctcagcctctcgagtagctgggactacaggcgcccgccaccacacgtgactaattttttttttttttttttgacagaatttcgctctgtcgcccaggctggagtgacagtggcgcgatcttggctcactacaagctccgccttccgggtcacgccattctcctgcctccgcctcccgagtagctgcgactacaggcgcccgccaccgcgcccatctaattttttggtctttgttttagtagagacggggtttcaccgtgttagccaggatggtcacgatctcctgacctcgtgatccgcccgcctcggcctcccaaacgcccggctactttttgtatttttagtagagagtttcgccatgttggtcaggatggtctcgaactcctgacctcaggtgattcacccacttcggcctcccaaagtgctgggattacaggcgtaagccaccgcgcccagtttcctttcaacttttctcaaggatcttccttcagactgagggctgtgtttctggccctagcccttgaagttttgttgttgtttttttcaataatcagtagttctgaacatttcatttcccagtttctgtgttctttctgcccaaagctaaattctaatatttcagtaaatattttcactggttctggcagcatagtattttatcatgtgacaatgccactgtgggtttatagaaccattcgttccctgttgaggggcatttatgttgtttccaactttctgatattatggtgaaatgccacagtggggatactcgtaacctaaattttcccacatgtctgattattttctcaggataaatttctaaaaagaactgctaggctgggcatggtggctcacgcctgtagtcccagcactttgggaggccgaggcaggtggatcgcttgagcccaggagttcaggaccagcctgggcaacatgcaaaaccccatctttacaaaaaatacaataattagccaggcatggtggcatgtgactacagtcctagctactcgagaggctgaggtgggagaattgcttgcgcccagaaggtggaggttacagtgagtggagatcgcactactgtactccagcctgggggacagagtgagaccctgtcttgaaaaaacaaaaaacaaaacaaacaaaaaaaacctactaagttaaagggtaagaacattttttaaggctaaaggcatattttgtccgttttgtcccattacattaggcttgcttttgacacttaactcagtggtcacgagagttttcctaccaactctcctcccactatttactttttctgtgtcagcttcttatccggtttcatctgtctgatttcctgtattcctttttttttttttcttttttttgagatggagtgtcgctctgttgctcaggctggagtgcagtggtgcgatctcagttcactgcagcctcccgggttcaagtgattctcatgcctcagcctcctgagtagctgggattacaggctcctgccaccaggcctggctaatttttgtatttttagtagagacagggtttcaccatgttgcccaggctgttctaaaattcctggcctcaagtgatccgcctgcctcagcctccccaaatgctgggattacaggagtgagccaccatggcagtcctaacactgcttgattttatgtctcattaatcttcgcattgacttgttcattaaataagtgcggagcccccatgctgtgccagcagttgtgcttggctaagtgcagtcaacaagatgatcaaatcataacagaatgtggtcagtactctgtggacactaacataaccctaggaaataattataggggaaaggttgacttccgaaagtttgttaggaaagttattttttatttttacttatttacttttgagacaggggtctcactatgttgcccaggctgtccttgaacccctggactcacgcaatcctcctgcctcagactcctgggtagctgggattacaggcgtgcaccaccatgctccgtgaaaagttctttctgagaagatgaaacctgaagaataagaaggaaccaactggccaatgagcaagcacatgaaaagacgctcagcatcattagtcattaggaaaatgccaatcaaaaccacaatgagatagcactcataacacccactaggatggctataattaaaagaaaagggggaggaggaataacaagtgttggcaaggatgtggagaaataggagcccttgtacagtacttatggggatacagattggtgcagctgctgtgggaaagtagttgagcatttcctcaaaaagttaaacctagagttaccacgtggcccagcaattcaactcctaggtatgtatccaagagaactgaaaacatatattcacacaaaaagttataaacaaatgttcacgagagaattattcataaaaggtcaggtgcagtggctcacgcctgtaatcccaacactttgggaggccaaggcgggtggatcacttgaggtcaggagttcaagacgaccctggccaacgtgatgaaaccccacctctactaaaaatacaaacaaattagctgagtgtggtggcaggaacctgtaatcccagctactcaggaggctgaggcaggagaatctcttgaacccaggagacggaggttgcagtgagccgagatcacgccactgcattccagcctggggaacagagtgagactccatctccaaaaaacaaaagaggaattattcataaaagtcaaaatgtggaaactactcaaatgtccatcaactgataaagaaaatgataaagtcatacaatagaatattcttcagccataaaaaggaatgatgtgctaatccatgctacgacacaggtgaacctacaacattatgctaagtgaaagttgccagaaataaaagggcacatattgggattctatttatacgaaatgtccaaaagggacgaatctgtaaagatagaagtagattagtaggttttgtttgtttgtttgttttgtgacagagtctcactctgtcgcccaggctggagtacagtggtgcgatctcggctcactgcaacctctgcctcgggttcaagcaattctcctgccttagcctctgtagtagctgggattacaggcgtgcgctaccacgccccggctaatttttgtattattagtagagacagggtttcaccatgttggccaggctggtctcaaactcctggcctcaaatgacatgcccgccttggcctcccaaagtgctgggattacaggcgtgagccatcgcgccaggcctagaagcagattagtatttgtataggttgcaggaggggaaaacggagagtgactgcttttaatgagtatggggttttgggagccgggtgatgaaaatattttggaattaatagtggtgacgttagtggatgactggatgcaggaaaaaaaaatagtggtgatggttgcacatcattgtgagtatgctctaaaaaacaataaccactgaattgtacactctaagatggttaaaatggtgaatttgttatgtgaattattattattattatttttgagatggagtttcactcttgttgcccaggctggaatgcaatggcgcaatctcggctcactgcaacctctgcctcccaggttcaagcgattctcctgcctcagcctcccgagtagctgggattacaggcatctgccatcatgcctggctaattttgtatttttagtagagacagggtttcaccatgttggtcagactggtctcgaactcctgacctcaggtgatctgcccaccttggcctcccaacgtgctgggattacaggtgtgagctaccgcacctggccgtgaattattttgtattgagatgcaatcacatgacataaaagtaaacatttctttttttttttttttttttttttgagacagagttttgctcttgttgcccaggctggagtgcaatggtgcgatctcagctcacagcaacctctgcctctcaggttcaagcaattctcctgcctcagcctcctgagtagctaggattacaggcatgcgccaccatgcccagctaattttgtatttttagtagagacggggtttctccatgttgaggctggtctcgaactcctgacctcaggtgatccgcccgcctcgacctcccaaagtgctgggattacaggtgtgagccaccgcacccggccaaaattaaccatttctaagggtgcagttcactggcatttagtatatccacaggaatgtgaaaaaaaaaacaaaaaactacacttaaatgtaatatgcggactgggcacgctcatgcctgttattatcccagcactttgggaggccgaggcaggcggatcacttgaggccagggtctgagaccagcatggccaacatgataaaactgtctctaccaaaaatacaaaaaaaaaaaaaaatagccgggctggggggcacgtgcctgtagtcccagctactagggaggctgagacaggggaatctcttgaactctggaggcagaggttgcagtgagctgagattgtgccactgcactccagcctgggccatagagtgagactgtcttaaaaaaaaaaaaaaaagtaatatgtggaaaggatgtcagtcttccagttactattttactaacttaaaaataaccttccaaggaaaggtattaagaaaaattactgccagaattttcatttcgattacatggacaaaaattgtgacatcacaaaatcaatccctttttagtgattttatacagttatgaagtgtatgatcttttagataccaaaagcaggggggacagtcaccatcaatcataaacagcacaggccaggcacggtggctcacgcctataatcccagcacattgggaagccaaggtgagaggaaagcttaagcacaggagttggagaccagcctgggcaacctagggagacccggaaggaaggagggaaggaaacagtacggggagtccagagtgacgagatcctcatcaccacagctgagctgagaacgggtgatgcagggctgggtgtggtggctcacacctgtaatcccagcacttgggaggccgagatgggcaaatcacttgaggccaggagttcaaggccagcctggccaccatggtgaaaccctgtctctactaaaaatacacacacacaaaaacaacaacaacaacaacaacaaaagacaggtgatgcaggagaacaagacacaagcaaggaacagagcccatccaacactagaattcactggcgcatgtatatcgatattgatactgctgtgtattttctcttttcttaatagtttcaacatttccaatactacatttcccaggacagtctcctaattaagtctacttctttgcacctagagaccactcgtcttttatattctgataattgaccctctcctcaaatcacaaggtacacaaagaagaatgaggttatttatacatccttccatccattcattccaaccgaccatccggacaggaaagtattactgaacagcaactatagagaaggtgcatagtttcattttaataaatgttttaaaatggctaggttgactgctaggttgaagagttgcaacagcagcacctgtgtggaaattcaataccacggccaggcagtaagactttaaaaagcaaccacttgtggtcgggtgcagtggctcacacctgtaatcccagcactttgggaggccgaggcggggggatcatgaggtcaagagattgagaccatcctggccaacatggcgaaaccccatctctactaaaaaaacaaaagttagttggatgtggtggcgcacacctgcagtcctagctactctggaggctgaggcaggagaatcgcttgaacccgggagggagaggttgcagtgagccgagatcatgccactgcactccagcctggcaacggaacgagactccatctcaaaaaagaaagaaaaaaaagcaaccactcacatgaggtgggaacagaggtctccactgttaattatttggaaagatcattctccaggagagaaaaggaagcctgacaaactttttatatttgtgtcaagctcttctaatactagaaaggcaatttggggaaatctgcaaactcctgggtgggtgacctctgccccacataatacacagatatatttttcaaatggaatagggtcttaatttccaatgatgggtttttaaaatacaaaattagtacaagtactttgggtgagtaacacgtctaaagaaactatgcaatctgaaagttgcggccttaaatgtgcagtcatttagcaattgttttgctatggttgttcttatttatttgtttgctttttactataagcaagtggcttttatctctctgtccctcaatttctgtatctgtaatacagaaattataaatgtaactgaagaatcgggttgttgagattatgagttaatgcatgtaaagtgctcagaaagagcagcagctggtacgcagtgaacacttaacacatgttaactgctattatggttattattagtagtaaaatacatacaaagtcacacttaattcaggtctaccaagaatcttttagtgctttcagtatgttattttaaaaattatagtgtgatgatttggtaatcactattttcttggggattaccagattttttttttttttttttttttgagacggagtctccctctgtcgccaggctggagtgcaatggtgcagtctcagctcactgcaacctccgcctctcaggttcaactgattgtcctgcctcggcctcccgagtagctgggactacaggcatgtgccactatgcccagctaatttttgtatttttagtagagacggggtttcaccatgttggccagaatggtctcgatctcttgaccttgtgatccagccacctcggcctcccaaagtgctgagattagaggcgtgagcaactgtgcctggcctgcagattaccagattctttggctagaaatagaaatttggatatttcaatgagttcaattttcatggtgaaaactgaaacagataagaggattcaggtgactaaatataggcaaagcacacagaatccttgcaagaataacttctgatgggaaagctgtattttactctagatcaaggagaacatgaaggaagaatggaaaccgtggtgggtctgcagagaactacaaaaataggttacaatttgagccatgtagaaatcacagtcactgggattcatgcaattacgctgagagatagagatgagagtctgcatcatcgtgacagatacaagaagtgatattggggctgggctttgttatttccatgggatagtcaggtactgagtcaaaaatttgttgagataaaaaaataaaaataatgacaggggaaaaacctaatataattgacaacagcactggtctagtagagagagcacggcaatcccatgagtgttcatggaaatggccatttatttatttatttatttagagactgggtctcactccgtcgcccaggctggagtgcagtggcacgatctcggctcactgcagcctctgcctcccaggctcaagcaatcctcccgcctcagcctcacaagtagctggcactaaagatgcacaccaccacacctggttaatttttttgtatttttagtggagacggggttttgccatgttgcccaggctggtctcaaactcctgggctcaagcgatctgcctgcctcggcttcccaaaacgttgggattacaggcgtgagccgccccacctggccagaaatggccttttaaaggtagccatactgtgcctcagtttctcaactatcaaatgaaaattaaatggaggcaattttactctacaaagttagaagaccgaaggagtaaatgtgaatgttcctttttaagagagacctttgcgaaatttaacattgtatttggatactgccatgcatttagtcttccagattaactttggagtcactttgctaatttccagcaaaatccttttggattttttgtttgaaattgagttaaagtgtagattaatttggagacagtgttttaatatgaaatctttcctgctgggaacaggacatgcctctccattgactgaaggcttcgagtgcttcaggagagattcttagttttcttcctaaagttttcttacacttctcattttgtttgtatttagacttatatcctctttggttgatattttgacttctcccactctattttgtaactggtttataggaaagctattttttaatatcggtcttataaccagctactttatgaattctcttattctttccatcagtgtttcgttgattctcttggggtttctgactacacagacatagcaactgcaaaaaaaagggaatcatttaatctcattttcccaataggctcatttcttcatcatctttttacatgggctaaaactaccagaacaacattgaataatggtggcgatgaggggacacactttgtgcttttgtttcagatttgtaaatgaatgtctatgggattttatccctaagtataatgttagttgctgatttcagttagaaaaatgctatcacatgaaagaagattccttctacattttctttactagtggtttttcttttttctttttttttcctttttggagatggggtctccctatgttgaccaggctggtcttgaactcctggcctcaagcaaccctcccatcttggcctcccaaagtgctgggattacaggcaccagccaccgtgcccagcctcattagtggtttttcaatttattactttactgtattaaggttcctgcttactcaaagtactttccataaagccccacaggactcatttttgtcaaaaacctatgcacccattccaatttaatatataattatgagattatcagttagtactgtcataatttgcataatcattaggacctgaaaatatgaagcccctctttaattaatatgatgaaaattaaattcaggaaataagcgtgatacataagcgcctcgtgtaaggcattttatgagacgctcctgaacagtgttgctcactgaggggcctgcagctcacttgaagtgtctctgtgagaatacagattgatgggctgcactccggaattcctgagacggaacttgcagaatagaggccggtggccgggcgccgtggctcacgcctgtaatcccagcacttccggaggccaaggcaggtggagcacttgatgtcaggagttcaagaccagttcgagagatggtgaaaccccaactctactaaaaatacaaaaattagctgggcgtggtggcgcatgcctatagtcccagcttcttgagaggctgaggtgagaggatcatttgaatccaggagatggaagttgcagtgagccaaagatcacaccattgcactctagcctgggcaacagagccagactctgtctcaaaaaaaaaaagcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaaaaaaaagaatagaggctgggaagctgtattttcaaggagattcccaggtgattcttacacatcttatagtttaaaactctgccacagagaatgaaagatcaagtaaaacatacagaacttaaaaaaaaagagagagagacagaggcctggtgcggtggctcatgcctgtaatcccagcactttggggggccaaggtgggcagatcacctgaggtcaggagttcgagaccagcctggccaacatggtgaaaccctgcctctactagaaatacaaaaattagctgggcatggtggcaaatcacttgaacccaggaggcagaggctgcagtgagcagagatcgcaacactgcacttcagcctgggcgacagagcaagtctcaaaaaaaattttttttaaagagagagaagagtatatttgaacttaccatcagagaggcaaagctaaattcatcatgagatagtgattaaactggttgtgaacataataaaacagctcagccacgctcatgcaccactgtttgtctaggcttagttctgactgcttctaggaattcccttcaatcactgggttttccagctgagccatacagcctccaatgaaggaaaagaaaggaggccaagtcactgggactcttttttttcaactttaaccagagcagctccacttacatctgttacggtgttttagggttctgagcaatatttttaagaataaaagtttgaaaattatcgactgacactctttaaattgtttagattagatttcgtaagattgcacccctgtcttactatcaagtttgatcctttatgttggtacacatgattaaaactcaagaagttcatggccgggtgcggtgactcacacctgtaatcccagaactttgggaggccgaagtgggtagatcactcaaggccaggagttcaagaccagcctgaccaatagcctttagtagagaccaaccctgtctccactaaaaaattcaaaaattagctgggcgtggtggtgcgcacctgtagtcccaggtactcgggaggctgaggcacgagaatcgcttgaacctgggaagcagaggttgcagtgagccatgggcgagccactgcactccagcctgggcaacagagtgagactccatctcaaaagcaaaacaaaacaaaacctcaaaaaaaattgatttgagcaaatttgacaaaatctgttttacatttttcttttcttatacatctctctcaaaagatgaaatatcttctatatcataattttgcatataatatgtaatgcttctgtgaatttgagggcattctatgactattattattattattatttggaaattctctaatactgtgttttaaaagttttggaaagggagaaaaactccagatgaaatactgaaggggtaattgatgtagttctgtcccagtgaagggagcttatgttccccccttcactgggacagaacctgcatcaatgactagggcagcagctggagcttctgacgctcacgctccggtcacctgtttgttttggtgctcgtcctctcaccacgctgggctccagttccttcttggataaactgaaccagttggagcatgagatttccaagattcttcccagctctacaagttgataacttctttgtacgtcaaagaatcccacatagacttagattacggcaggctctctctcataaccaagaaaaaattctggccaattttcagacatggaataatgctccgtatcagtatacattaagattaatttattctaagattaattaattcagcataataagtatctgcttatgtgtaattaaaaggaaattattttaagggaacctgagctaatcatcgtgtttgttttttgaatatcagcatgataaattaacttattgtgttccattaagataaccagttcattgcgggcaaggatggcatatgaaatcaagcccagtatctcatttctccactttaggttttagtttctccttatatttattttttaagacaagtttttattttacaggtaggatttcctctcctcccacagtctctgcagagctgaaattttcaaagctttcttttttctttttagttgtgctccatgatttctcaccagtgcccacttcttataacaaaaaaaatgaactaagttgaaataggagcctcttgtctatttagcaaatactctctgtgcacagcctatagtcctagcagtgttagaacactggaagggaatggggtggccatgaccttgagaagctcaggccttctcaatgccctggaaaaagtggaagccatattcagtatattgatgtcatgataaggatgatacttaacaaataatactttttatcttttcaacaaaaaatccttagcaacaattgcttatgaaatacacatttgaaactttaacaatcacggtattggtttgaagcagagccttagtaatgtcccttagtggttgtcgaaaccaactgaaaaacaagataattagtgaattgaagtaattaataatattttgtgataagcaccactaacaaagaagtaaagacaagtacatgaaatgacagctgccgtacataagaatcacatttcccttcccctcctaaagaatcctagtaggatatcttataaaaagagagcttctggggtaaggtgacttagagggagaaaaaaacatgcagatataacctacaaaaggcatcccagtctattctttgcttagagactgcagcatagacactgttcccatgaggcagggtcccacagggttaaaaacctatctaaaacaattctgcagaggcagcctctgacattgcgttgaaagggtccacgcactctgtgagctcatatttatgacatacatagggttctctttgctgggcagttctttcccttgtgttgaagagacacgtgatagttgaccctcacctcacggctccctcacttgtgaattaaagtcagacactgccgtaaggttcttctggttcctgctttgtggagaaagctttcagcagcaatatctgggatcactggtgtattaaatgtcaggcctcgcatcattattctgccctgagctgatggtaaaccgggcacccagccttttagctttcatccagcacgagggaacttgccttcagatgtgacacgtacaagtcaaaaaagctcagagtcagctccaacgtctattggatcccactctatcgcctttaaaaaggaaaagaaaatcgaattcacagaaccgaggctaaatacgaccgttaagaacggactgcattcaccatatttccatgagagtggcaaagagaacaaagataaatgccaggctacatcttggatcctttgccagcttgtggaagaacttagcagaaaaagatgtgaactctactgtttaggaataaaataacttttaaaaataaattattgaaaagtgttatttggctgtttcttttatgcattcaaaagcaaaatagtaagaatccagtggactttgaaatcttcctatatgttaaaaaataggccgggcgcggtggctcacgctgtaatcccagcactttgggaggccgaggcgggcggatcacgaggtcaggagatcgagaccatcctggctaacacggtgaaaccccgtctctactaaaaatacaaaaaattagcagggcgtggtggtgggtgcctgcagtcccagctactcgggaggctgaggcaggagaatggcgtgaacccgggaggcggagcttgcagtgagccgagattgcgcccctgcactccagcctgggcgacagagcgagaccctgtctcaaaaaaaaaaaaaaaaaaaaaaaaaaaaaaaaaataataataataataataataataataattagagtccacctaaggtaagaatctaggactcatttttgtattgaaatttcattccttgtaattcatattttttcatgtgatccctgaaataaattaaaaaagaaaaaaaaaggtaccagtgctcgtaagtagaaagtggagaactaaacgactccaaaatgtgcaatatgttgggcactggtggccagctggtaaaaatcttatgagagttgcgggttttcgaaatatatgtaatttagttatctgtcaaaatgagatccgcatctacatggctttacccaggaatgcagaatttgagactggagcgtagggagggagaagcctatgggtcttgggttttccggaattggattataaatacgaacaggtttaaagaaataatgaggccggcagcgtgtgcgaggagccccgcgcttcctgggcaccacgcggcgggacccggggaggcaggcggggacccggggaggcaggcggggacccggggaggcaggcggggacccgggcaggcaggcggggacccggggaggcaggcggggacccgggcaggcaggcggggacccggggaggcaggcggggacaggcaccagcccacttgacaactgcgcgcaccggcgcagccggcagctcgggggcgcgcacacccacaccgcgccacgtgcgcgcgggggctgcggagactacccgagccgcgtgggcgcgtcagagccacctccgctctctctcacgtcgccagggattcttgacggatgattccgctgtcagatgccagcttgcctctgtcacaccgttttcctgaacgcagtagccatgtatttgaaagccgtgtcatgtgtgaaacgagtttaccttgtagattaggataaacaaagattctccgtgctcatccaaaagtccaaagccccctccgctctgcaatttccacttgttatatgcagaactattctcacctcgggaatgtgatggttttataactgtgggggcccaaatgtactgactaggactgttttcccgcactcaccatgaggaggtgttcagttggacatgtgcctaaggatttttgttggctttttatttagtatttgctcattttggaaaaaaaagtacaaactaccttcgagctgggagctacacagagaggcttgctcagattcagatttgttttggtatgtctgtttcataggctgcagacttcctactgtgtcacatccagtgcgcatcatacctgctggggtgtctctcagggatgttaagattgatcagtgggctcggatcctgtcaacccgatatgtccattataaagttctccttcagctcttcacctgtggtttcagcagccattgataatcattgcttagatacttcatttcattagaggttgcaaaatggcaatattttaatttatcatttctttcatgtatcagcaggatcttttcccatcaattatttggctaccctaaatacagttcatacaggaagggcaaaataaatacttgatccttactctttatttttggaataaagagttgtttccttagcactctccaaaggtgaccaatccatctatttttggagcattactctcaaccggtggatgttaccatacttgatgtgtcttaatatgctacagtatttatttacttatttatttgatggcccaaataccccactttcagccagggctcctgtagccttctgacacaaccatagaagtctttgacgtattatgaaagactatgtaatattccaggggtcagaggaagatattaaatgacatcatggggaagcaaaatcagcaaaatttagaaagtgagaaactctacagcacgcatcattcagtttcttcaacaatagattgcaagggggtagagaaggagggcgtgaaactcctctagggtcagaagagaccaagaaacttcagacaaaagcaacatccggactttgtttggatactggtatttttttgtttttttttttagattgtaaaaaaaagagttaaggagatggatgatggtaatggttgcacattatgaatggatttaataccactgtttacttaaaaatgaataagatggtaaattttatgttatgtgtattttaccatgataaaaataataaattaaaaaataataatttggctgggcacagtgattcatgcctgtaatcccagcatttggggaggctggggcagaaggattgcttgagggccaggagttcaggaccagcctgggtaacatagtgagaccctgtctctacaaataattaaaaaattagccaggcgtggtggcacatgcctgtggtaccacctttttgggaggctgagatggggggattgcttgagcctgggcgattgaggctgcagtgagccaggatcacaccactgcactctgaatgacagagcaagaccctatctcaaaaaaaaaaaaaaaagcaaaagtaaaataaaataatttatgagaaaatcaaggaaatttgaatgctggctggctttttgatgatatgcaggaattactataaaaatgcgtaggagtggcaatatgattgtggttatgttaaaaaatattctttcgattttaaagacgcatagtgaaatagtatagatgaaattgtatctcgaatttgtttcaaaataacctagtggcagtaaggagagaaagtaattgtggtatgatggataatcattgaagctgggagatgggtacctgggggttcactgtgttcatctgtctggttttatatatgtttggaaattgcataataaaaagtctaaaatttattttaaagtacagattaccctagaaggaagccgaagaggaactgatagtggtagaactacacaaactccataaataaagtcttgcctaattcagacatgtgctaccacctgccagctgcagtggtggagtaagaggaaaagcccagtgactaagcaaggagagtaactgtcttatattatcgagggatgctccgggcctgtgctaggtgctttgtatgcttttaactcatttaatccttacaatagtcttatgagatagatactattatgttagtataatatccacactacaaatggaaaaactgaagttcagagaagccactctcttcataaacagcaaagataggcttcaatccatgtggtctggctttggagccagtctactgataagagcaacataagtagctcttaatagatgccagccctgttttaagtgttttgtgtctattaattcatttaatactcacaataaccctatgaggaagatactctcataggacccattttacagatgagaaagttgagatacaggcaggtgaagtgactgtgtaagatcacacagctggcacacggcagagccagatgttaagctgggagtttgggctccaccccaccctgctgcccctcacattattaaccactgggctacagtgacagctagctatgcaggctctttccttccttaataaacatttattgagcacctgcaagaggcagtctctgttagaggcgctgggatatggtgatgaacaagacacattttgctttaccttccggtgacatacagtctcccagtccctgaatctcttaggagctaatttaggagatgaaggggttaaactcagaagctcaggctaccgtgttggcactttcttgttttaagctgaattggccagagggtgatgcatgcctgtaatcccagctactcaggagggaggatcacgcaggagttccaggccagcctgggcaacagggcgagactctgtctcaaaaaaaaaaaaaaaaaaaaaaagttgaattggaaagagcattggatcagcagcccaagaagggcgcttctgaacttgaaaatgtcagaggtaaggctgtgaaggaagttgcctgtggatcctactgctctacccactgggtccagtaggtccctttccgctagacaccattctcatttctttcctagaatcctctctctcttctgctgggttctgttcaaccccaacttcttctctgcttcggagctcaatgagctcctcttctctgaaatctcaatgcccttgttggttgcactaatcaattcaatacttaattatatacaaagcttgattgttatccaataattttactacgtatgtcttgcctcctcacttaaactgtacatatttacaagacagagactaggtcttatacttcattgatattctcccagcaagccccaagccatggagtaggtgctcactacatattatttaaatgaataagtcatattttcaataatattgtgtatgttagatgacaatacatagaatgatcaagagcacagactctctctcttcatagttgtgtgccaccaggcaagttattaacatcctttatgccttagttttcttatctgtaaaggagggataatagtttctaatccacgcacatggaattcttagcctggcgcccaacgaatgttcaatatatgctatcagtcaatatttttattattactacaactgcctagtaaagtaagattagattgactaaccagagcatttctcctacatgtgacgtcaaattaaatcagaagtttgcttgatgagcatgatttggtgagcatgatttggtgagcatgatttggtgagcatgatttggttggctgtggaggccgtggactgtagcggagcaagaatgggcattaaaatctcacctctgactctggctgtgagaccttggctttcgtgagcttcagtttgttcatttgcaaactgcaaatagtaacagatatatcccattgagctatcgtgcgggccagatttaatgaatgtaaagcacctagcctgacacaaaatggaactttgataaaccattctctaaatatcatcaagcccatagcgtccctccctacagagaccgtgtctgcttagtagatgagacatttgtggttgttcattgactcctttttttctagaaagttctagtcctctagagactcattgtaatacctttgtccctctgaattcttggtatttaactatacctcctcctgttatatgcacccagggtaatatgcctctggcacatggtaggcacttaatgaatttatgtggaataattcagcaacttacttttatagatacatacagactatccctcttctatgaactcattctttctcagtgtatcaaactaccaatctgctgagctcattcacaacattttggtgcttcttaatgttctcagagaataactttcactctagtgctggcttcttccatccactggtaggggtttggatcagataaaagggagaacatcccaggctgggtgcataatgtttggaaagggttaaggaaggccaagtgaatagttcttgactgaaactaagagtacgagatgggagaaaaaatcagagataagattatatagggagggtggagacagattgtagagaaactttaaggtcaggctgaagaatttgacttgatacatcaggcagctggaaaagtcaggggatagtttacacaagttatagtaatttttaaatttaatttgtgtacatgaggttaaagaattgaagttaggacatgggagtcattacatttataatgaaaaaacgcatttcctgtcccaccttcccaacccactgcccagaggcaaccatgatcaactcaacctattgattatttgaatgtaattgtttatttctttctttctttctttcttttttttttgagatgaagtcttgctctgtcgcccaggttggagtggcagtggtgcaatctcagctcactggaacctccgcctcccgggggtccagcgattctcctgcctcaggctcccgggtagctggaattacaggcacatgccaccatgcctggctaattgttttttgtatttttagtacagacagagtttcaccatgttgaccaggctggtctcaaactcctgacctcaggtaatccgcccgcctcggcctcccggagtactaggattacaggtgtgaaccacatgcctggccgaatgtatttgtttctttttgagaagggtaattcccaactcttgctccattaccttcccatcatttttccagtgtagtcatatccttgtttttgttaaataaatagcatttccatctttatatagttcacagctaattacatttttcttgtacactctttttggttctcctaatgtttgttaacttttactttttaatgatttttaatttaaagttttaaatgtgtttttcctggttaataattgtcttgctttaaatcatttaaaaatttttttcagagacaaggtcttgctttgttgcccaggctggagcgcagtggtaccgtcatagctccctggagcctcaaactcctgggctcaagggactctcctgcctcagcctccaaagcagctagaactatagatatgcaccaccacacccagccagtttttctgtttttttggagatgaggtctcgctacgttgccaaggctagtctcaaactcccagcctcacttttttatttacttcattttttgtgtacttactactaaatcaaccctaaatgttccaataaagatgtaaactgatcaaatacatgaaataacccattagttttattcttttcttgaatactttcttaccagaaccttctctgcctattttaaccaggactgactgctctctgagctcaccacacacctgggatttttcttcaccaacaacttggaaattttcttgaactccttgctgtgtgggatttcctgtttcttggatctcatgtactcatctttcttgatttgccatgtgtgcgttgtggtggggaggggtgtacatctgcccgtaacttgctgagaaaaagcatgggacaaataaaatttttgctgtgcaagagcacggtagaaaatgtttttattttactttcttctacaggctgggattatgattttagtttgaaaagcacatttcctctgaattttgaaggcatctctcaatttcttctgttgagaaaacgaatgctgattttatgttgacatagagcaatatggcgttattccaattcctgatcttttatgtgtgacctgttttatctttctagaaagttttagaatcttctctgtaaaatgaggataatatgagtacctacctcactggattagtaccttaattgtgaggattaaaccaattaatatatcaaaagcctttagaatggtctctgacccatggttaattttaaatgtgcttgttatcagcacatttaaattaatccatggttaattttaaatgtgctcattttagtagaattttgggagaggtgatataaagacttatgttcaacttgtcatatgtaacagggattgcagaagttaacatttttaagttttcctcatagcatttttgtggaggttattttcttccaagactgaaaaaataaccaaaagatgaaatgacttaaggaactattattcagggatattgatcagggcagtgacccagctaattataataagttggtaaacacgttaggatatatagaaagaaagcaggatgttactgtctgctgaggcttaatgctaacattaaatcatgttccccaaatatagtgggttcatttctacagtatacctgttcataatgattcatctctgtgtcctcagcacgtaggccactatttgattcctggtaggcagtagatacaaagcacttggcaatgtctctgacaggaagtaagcagtacctattagctctttatatatgtaacacacatcatctacttagaaactttgttttagttctctttcaagtgacctttctcgtgaccttagagaaagaatttgtatgcaattgctaatttccccatatatattcgcattcattattttcatttgatcctcaaagtgtccaaagaattaaactgagttttgaagatggctctagtgcttactagctgtgaacaagttacctaatttcttcttatttttctcaagacattggggatcacctcatgtgaggattaaattagatcatctatgtcaagcactcaatgcatatattagctattgctagtgaggtaaagtattattattattattattatttagacagagtctcactctgtctcccaggctggagtgcagtggtgtgatcttggctcactgcaacctccgcctccaggttcaagtgattctcctgtctcagcctgtggagtagctgggattacgggcatgcaccaccacacccagctaccttttgtatttttagttgagacagggtttcgccatgttggccaggctggtctcaaactcctggcctcaagtgacacccccgccttggcctcccaaagtgctgggattacagatgtgagccaccacacccagcctagctaaagcattattattttacttatttattttgagacggagtctcgctctgtcacccaggctggagtgcagtggtgtgatcttggttcactacagcctccacctcctgggttcaagcaattctctgcctcagcctctcaagtagctgggactacaggggcctgccaccacacccagctaatttttttgtatttttagtggagacagggtttcaccatcttggccaggctggtcttgagctcctgacctcaggtgatccacccgccttggcctcccaaagtgctgggattacaggcgtgagccaccgcacccagccaagctaaagcattattaaccctccttggtgattagactcatcagaacacagaaattaaatgacttgttcacatagttgtgcgagtggctgatcttggcttaaagattggcactgaatgattcacagtgcaaatgttagaggagtttaatttatgttcttgctcactgccgtatcccagcacctaaaatagtatctggtaaataacaggcactcatatatgtgattaataaattaacatgtacaaaaagttttaatcctggaaatggcttcatagatcatttaatgaaatgaaccagtttttcaaattggtaaactgaggcccagatgctttgcttttaggtgcaccgtaggcacgttttgtgtttgtttgttttgtttctttgcatcttcacagtgcttttttttgagacggatctcccactgccgctgaggctggagtgtagtggtacaatctctgctcactgcaacctccacttcccgggttcaagcaattgcctaggattacaggcacctgccaccacgctcagctaattttttgcatttttagtagagacagggtttcactatgttggccagggtggtctcaaactcctgaccttgtgatctgcctgcctcggcctcccaaagtgctgggattacaagtgtcagccaccgcacctggcccacagtgctttttaaaccactgaagtaattgtcaaattaggtttggccacatatgaatagaaaagccaaattagtggcttatataagatggaggtttattcctctcccatgtaaaagacaaaccaaagataggcaattcaagatggtggctccagagtcagccagaacctaggcagccatctttctgctccaccattcttgccatatggctttcactctcagtactgtcttatgatacaaggaggctgccagggttccagccatctgcattcattctatcaggaaggagaaagacggagagagcaaaaggggacatttcccagctgaggtggctgcctttaatttccccatttatcttattatccacccatggtgcaagagagactgggaaatgtattattttatccaggaagcttgctgcccagattcaaagcagtgttctaaggaaaagggggaatggctattgggtaggccgtctctgtcagagttgtcaacattttgcaaatcagaaatttccaaatagaaatctggattttttttagcttttcttgaagaatcagaagatggagctgaggtttggggccagagagaaggaaacaaggagctggattttgaagggagggctggatgaaatggagaaggcccatgaaacagactggcgagggagaagggagctgatgttctaggacttgagaagtgatttaggaatttgcatccctcgtttggtagaagtagtgctttgaaggctgagtacaggggcttacaactgtaattccagcacgttgggaagccaaggtgggaggattgctcgagcctaggagttcgagaccagcctgagcaccacagcaagatcccatccctacaaaaaatttaaaaagattagtggggtgtggtggtgcatacctgtggtcccagctactcaggaggctgaggtgagaggatcgcttgagcccaggaggtggaggttgcagtgagccatgattgtaccactgcactccagcctggacaacaaagtgagaccccatcccaaaaaactaaaatagtgttttgagaggattaaactagtagagagtatgtataacaagagaaggcacaaagaatagttagggaactattaaagagctccaagcatgagtgaggagggtccagaccagcaatgtcaatagaaatatagtatgagccatgtatgtcattcaaaaaattttagtagccacattttaaaaaggaaaacagatgaaattaattttaataatatattttatttacccaatatagctgaaatatcatttcaacatgtaatcaatataaaaagtcatcaatgagatgtgttacattctttgtttttttttgttttagtttttgttttgagacaggttctcactctgtcacccaggctggagtgcagtggcacaatctcggctcactgcaaccttcacctcctgggctcaagggaccctcccacctcagctgcctgagtagctgggattacacaggcatgcatcaccatgcccagctaaattttttttgatatttttagtagagatggggtttcaacatgttggccaggctggtctcgaactcctgacctttagtgatcctcccacctcggcctcccaaagtgctgggattataggcatgagccactgcgcctggcctgatctgtatttagagtgcataaaatttatagttgaaaaagtagattcacataaccaagttattcttcacaaactaaaaaattttccaacaactaaatcaagtgtatgcatttttacatttaagttaaaatgaaattaaaaattcagttcttcagtcatactgaccatgtttcaagcactcaatagccacatgtggccagtgacttccatattggatagcacgttccagacagggaaagaagacagaaataaagggcccagtctgagatgtggctcataaaggatgctcctcagatggaacacttctgacgaaacctgtattatcattgtcttccaaaagcatggaaattctcgcatttcccacatcccttagatttgccagatccttttacacgcctgtgcctttgcctgaaatgcttttccccttctttttgcacctggaaaatgtcaacttacctttccagtctccatttaaatatcatctctgtgaaatccaccccaggtccatcaggacaggctagttgcccctaacactgtgttcctatttcatgtctcatagatccgtcatgtccttgaggtcgaggactatgtcttgattgtctctgagtccttggtacatggcatgcagacttataagaatcgttattgaatgaagaagaccttccgtttaaccacacctggctaatttttgtattttcagtagagatggggtttcaccatgttggccaggctggtctcaaactcctaacctcaagtgatgcacctgcctcagcctcccaaaatactgggattacaggcttgtgccattgcgcccagcctcaacacgcttaattgaagatgtcattgattgtaaggtgaaccattgttttgtgcatcattaaggaaaaaacctgtcagtaataattgtgagacccagcacaatggctcacgcctgtaatcccagcactgtgagtggctgagacaggcagaacgcttgagcccaagagtttgagaccagcctgggcaacatggcgaaacctcatctctactaaaaatacaaaaaaagccaaaaaatacaaaagccagctgatagcttcgctatcagcactttagtcagctacattttaaaaggatatgcttggcctccttaattcaatttttgctttattaacttgaatatcattggacatggccctctaaatagcagacttcgaggctggcttctaactttaagctccatacataaaatttccgtggtgcagccttatgtaaaacattcatcttctttaggttcgatatcagtgcatactgctgccctgcgtcacacatttgaaattaatgtgtgtgtctttttgactgttgtcttttatgaggatagacaccagcatacagcagtacttgaatgacaaccacaaggatttttcaaaatataggaggtattcattccagggtagcttacctgagcgaggtgctgcaaaacagactgacagcccgaacagacgcaccttcactcctcaggtaacaaggaacacattccactagatattcttaacttgggcacaatcaacttcagggggatggggcaactgatctccagtgtagctgaatccaccttggttacatgctctagatgggaagaaaggaaaggaggcttagatgatctcaagtggtagaaaggtatttggcaacatcaattaaaaggttaagtgcagattccctttggccctccaaattccacttttaggaagctactgtgtggaatatttgcataaagacataaatttatgaagaaaagaatgatccttgtttttttttgtttttgagacggagtctcgctcttgtcgcccccgctgtagtgcaatgggaagaccttggctcactgcaacctctgcctcccaggttcaagcgattctcctgtcttggcctcctgagtagctgggaattacaggcatgcagctccatgcccagctaatttttgtatttttagtagagacggggtttcaccattttggacaggctgatctcgaactcctgacttcatgatccacccacctcggcctcccaaagtgctgggattacaggcgtgagccactgcacccagcctatttcaagttttcaaaataacaaccaagaatacaaaggtcagccgggcccggtggctcacgcctgtaatcccagcactttgggaggccgaggtgggtggatcacgaggtcaggagttcaagatcagcctggccaaaatggtcaggccaacattccaaccaatgttttgtaaaagcaatggcaggtaagtggcctcctctctagagctgaagctttttgcgcttgctttggtgtcatgcccacgcagctaactcgtttcctcagattctattccattccatttctttcttttcttttctttctctttctctttctttcttccttccttcctttcttcttctttttttttctttttttttttgagacagaatttctctcttgttacccaggctggagtgcaatggtgtcatctctgcttactgcaatctccacctcccgggttcaagcaattctcctgcctcagcatccagagtagctgggactacaggcatgtgccaccacgcccatctaattttgtatttttagtagagacggggtttcaccatgttggtcaggctggtctcgaactcctgacctcaaatgatctgcctgccccagcctcccaaactgttgggattgccggtgtgagacatcgctcccggccctcagattccatttctatgctttctctctggttcacattcaaaagtcctgaagataaaggatctgattaggtcagttcatcaccattcaatatggattactcctgctgtgtggggagatgcgtgtaccaggccacctcatggacggaggtctgcttttatagcccactggctttggtggagctgtttcagagtacagtctggtgtggccaaggttacagcattatatgatgcaaagtaaggtgacaggcgcgaagcatgctcatgtcttagaaggaaaatatgggcaaggcatatacgtagcactccatggaccatccactctcctcggtttcatttatttatttatttatttttcactttgggatggagtgtcactctgtcgccaaggctggagtgcagtggtgcaatcttggctcactgcaacctccgcttcctgcgttccagcgattctcctggctcagtctccttagtagctgggattacaggcacttaccaccactaatttttatacttttagtagagacggggtttcaccatgttggccaggctggtctcgaactgcagacctcaagggatccacctgccccggcctcccaaactgctgggattagaggcacaagccactgtgcctggcctctctttggttttatacacctaaagagaaagagggaaagcaggataaacattcacctgcagtcactaagaaatccagacaagaacttcctttaaagatgtccttgtcagtggagaggaagttcatcttcacattttccaggtggatcagttggtgttccccagaccaccaggtttgcacttgtgcatgctcgaggacaacagagaaggttctagaagcagcttttctgcactacttggagctttcttttcgtttaaagatgaattgtttggttggatgcagtgctcatgcttgtaatcccagcactttactcctaaagtgggagtaagtgggaggatctcttgagcccaggagttcaagaccagcatgggcaacataggaaaaccctgtctctacaaaaacataaaaatagaaataaaatgattaattgaggtcaggcatggtggctgatgcctgtaatcccagcactttgggaggccgaggtgggcagatcacttgaggtcaggagtttgagatcagcctggccaacatggtgaaaccctgtgtctactaaaagtacaaaaattagctgggtgttgtggtgcatgcctgtaacctcagctacttgggaagctgaggcaggagaattgcttgaacctgggaggcagaggttgcagtgagccgagatcacgccactacagtccagcctgggtgacagagtgagattctgtctcaaaaaaaaaaaaaaaaaaagattagttgctggatgaaaggtaagcaaaaacaagcaaaacaaaataaaaaacagtggtattgcttttgcttttaagacgatgacaaaggtcatcgtatttacaggaatgaaactgtggcgagctgggtgcagtggctcactcctgtaatcccagcactttgggaggctgaggcagacggatcacctgaggtcaggagttcaagaccagctgtgccaacatggtgaaacttcgtctctactaaaaacacaaaaattagctgggtgtggtggcaggtgcctgtaatcccagctactcgggaggctgaggcaggagaatcgctggaacccggaagctggaggttgcagtgaaccgagatcacaccactgcgctccagcctgggcgacagagcgagactccatctcaaaaaaaaaaaaaaaaaaaaagaaaagaaaagaaaagaaaagaaaaaagaaaatgcggccaaaatttttatagaatctgggattcctgtgatgctgtgttcttgaactgtttcagagcctagtctgggcacctatttttaaactttaaaaggcaggtcatcgaagcccttcagaaggagggaaaggaagccagagaataggtgtatccaaaagtgctgtaggaggaacaggcctttcgctatgtttaattcaaaagcagatatcttcaagcctctaggaatatcgtctattgtcattgctggcaaaatgtccatctgtctctgaaaacctccataagatgtatgtgtatttgcaacaattccaagcaaggtaaggcccttatttcctgtggaaagtagtaccaatatggaaggcagcctgtgacatggtttctttttctttccttcttttttttgagtcagagtctcaccctgtcaccaggctggagtgcagtggcatggtctcggctcactgcaacctctgcctcccgggttcaagcgattctcctgcctcagcctcctgagtagctgggactacaaacgcacgccaccacacctggctaatttttttttttctttttgtttttgagatggaatctggctctgtcgcccaggctggagtgcagtggcgcaatcttggctcactgcaagcttcgcctccagggttcaagtgattctcctgtcttagcctcctgaatagctgggattacaggcacctgccatcgcgcctggctaatttttgtacttttagtagaaacgggggtttcaccatcttggccaggttggtcttgaactcctgacctcatgatccacccgcctcggccgcccaaagtgctgggattacaggcatgagccaccgcgcctggacgacatcgtttatttttctatgcctcaaagcaagctgaccaatttgccaatgtatgttgcttaagttgttgggtcactgaagtgttcttactatacaaagtcagtcccagatctttcaatttcggtgtacccctcacagtgtctaatatgatgctatgtactaggatttcaatttacatgaaacaaattgggattgaatatctatcttgtgccaagcacagtggtaagcactgaaatagcaaagtaagttagatatattccctaacctaaagttactcatatctaccagagaaagcagccccaataacaaccaactatgatgtagtacaaggtgtgcttgttagagatattcacagcctgccaccttcacccagttaagggagggatgaccttgtttcacctattctaagatgtacattattgtctctgaagtccagatgcatcttacaatagatggtgtctcacaattattattattattattattaattttgagacagggtctcactgtcacccaggctggagtgcagtggcacgatttcggcccactgcaacctctgcctccaggactcaggcaatcctctcacctcagcctcccaagtagctgggactacaggtgcatgccaccatgctcagctgatttttttgtatttttagtagagatgaggtttcgccatgttgcccaggctggtctcaaactcttgggctcaagcgttctgcctgtctcagccactcacagtgctgggattacaggcgtgagccattgtgccgggtctcacaattattattgacaggttttttccttaatgatgcacaaaacaatggttcaccccacaatcaatgacatcttcaattaagcatgttgaggctgggcgcaatggcacacgcctgtaatcccagcattttgggaggctgaggcaggtgcatcacttgaggttaggagtttgagaccagcatggccaacatggtgaaaccccatctctactgaaaatacaaaaattagccaggtgtggtggtgcacactttggcctcccgaagtgctgggatcacaggcatgagccaccatgcccagcccacttttctagctttctggctagtgatacgcctgctctgcctcaaccctccttcccccaaaaatctttagcaaaaaggaattcctgaatgctttaaaatcttgtagattttctcatactgccctcttaacctgaaaaggctttttccttgcataatataataactaacacttgtgcaatgcattgcaactcacaaagggaggctttcttataaacgctcattttagaggcttcatgtcagcagttaagagctgtagccacacccctgggttttaatttaccacttacttgctatgtaaccaagggcaattaattcaacttctacaggttcctcacctttaaaatggggataataatagtatcttatttcccaagcttgttgtgaagtttaaatgagttaatacattgccagacgtgcagtttacatgaaataagtgttcattgttatttgtctttgcagcacgctcactgttaagcagcaaacagtccaaagtctctgaatttagggtttaggttctgggcttataagagatggattccaccatagcacattgcttttctatccagcaagaatcctactcattcttcagagacccaagctcaagaatcactttctctatgagtctctcttcacctgtgtgtgaccctgctacaaaatcaacaatcaacaatcaacaacatgttttttttttttttttgagacagtcctactctgtctcccaggctgaagtgcattggtgtgatctcggctcactgcaacctccgcctcccaggctcaagcaattctcctgcctcagcctcctgtgtagctgtgattacaggggacagaggttgtggtcagctgaaattatgccactgcactccggcctgggtaacagagtgagactctgtctcaaaaaaaaaaaaaaaaagaacttaagatagaaccaccattcaacccagcaatcccattactgggtatatatccaaaagaaaataaattgtcctaccataaagacacctgcactcacatgttaattgcagaacttttcccaatagcaaagacacaaaatcaacctgatgggcatcagaggcagattggttaaagaaaatgtggtatatatacaccatggactactacgcagccataaaaaaagaacgaaatcatgtcttttgcagcaacatagatgcagctggaggccattagttcctaggcaaattaatgcaggaatagaaatccaaaaaccacatgttctcacttataagtgggagctaaatgttgggtacatatggacataaagatggcaacactagacactgaggaccactagaattgggagggatggagggattggagggattgggagggatggagggattgggagggatggagggattgggagggatggagggattgggagggatggagggattgtgagggatggagggattgggagggatggagggattgggagggatggagggattgtgggggatggagggattgtgggggatggagggatggagggattggggcaagggttagaaaaccacctatagggaactatgctcagtacccaagtgacaagatcagtcataccccaaacctcagcatcacacaatatgcccaggtaaaaaacttacacatgtacccctgaagctaaaataaatgttgaaattataatcaaatcaaataaaatgtctttcaaatataaatcccctattcttcatccttaccactgcagccctccactgcctggcctgcactaaagagccagcttcccactggtcaccctacctttcgtcctgcccacttgaatccagcttctccactgcctcctatcatctttctgaatcacaggtgtgattgagtcactccccagttctagaatctatagatgttgtctataatctatagataacatttgaaattcaatatgagatatacagcattttgcaatctggcattaaccgaattttctagctttctttttttctattttctttctttttttttttgatatggagtctcactctgtcacccaggctggcgtgcagtggtgcaatctcagctcactgcaacctccgcctcccaggttcaaacgattctcctgcctcagcctcccgagtagctgggattacaggcatgcgccaccacacccagctaatttttgtattttcagtagagaggggtttcaccatgttggccaggctggtctcgaactccttacctcaggtgatcctcccacctcggcctcccacattgctgggattacaggcatgagccaccacacctggccaatcttgttaaaatctttgagctatctccaaactgctttccacagtggctgaactaatttacattcccaccaacagtgtagaagtgttcctttttctttgcagccttgccagtatctgtttgttgttgttgttgatgtttttactttttaataatagccattctgggctggcatggtggctcatgcttgtaatcccagcacttcgggaggccaaggcaggcagatcacgaggtcaagagatcgagaccatcctggccaacatggtgaaaccctatctctactaaaaatacaaaaattagctgggcatggtggcgcgcacctatagtcccagctattcaggacgctgaggcaggagaatcacttgaacagggaggcggaggtttcagtgagccaagattgcaccactgcactccagcctggtgacagagcaagactccgtctcaaaaaacaaaacaaaacaataataataatagtaatagccattctgactggtataggagggtatttcattatggttttgatttgcatttccctgatgatggtgagcattttttccatatatttgttggttgcttgtatgtgaaagacattttagatagaaatccaagccaacttagatgaaagcaaaagtacctctcctccaacagctcatgtgaggcatagaaacgtatcatcagagggcaggtcaaccacatagtactggagtccagggcagggatctgacatccatgtactgccaggtaaacttgccttgttcatcatgacattctcatagatatttttattttattttattttatttatttatttattattattattattgagactgagtcttgctatgtcgccaggctggagtgcagtggcacaatctcggctcactgcaatctccgcctcccgggttcaagcaattctcctgcctcagcctcctgagtagttgggattacaggcacgtacgtaccaccacgtccagctaatttttgtatttttagtagagatggggtttcaccatgttggccaggatggcctcgatctcctgacctcgtgatctgcccgcctcggcctcccaaagtgctgggattacaggcgtgagccactgtgcgtggccagattgttgttgtttttatcagatatgcagagcaatgatccagtcatgaccagatattgcctcctgtgttttgcatgctaactagagtggtcatgatggtcttgtgcctagtaaatgacctggaagttatagagtggaatggcctatactggtggccaagacctctttccaggggagtccgataataggttccactgatagtcaatagcaatcgagtgtccactgcgccagaacactcaggaacagtctaagagtaaggaagacagtaagctccttagtcagatgggatgtcagaatccaaatacctagaaaagtaccttaaatagcatatcaaacgattaaatgaaaaatgaataatgtggtataaagcaagcatagaaaatatagtatgcactctggttgtcttaagctggatggaagccgagtggtctttgtggaagcaccggatatcccagggaggttggtgcaggggtagatttgggctaaagcagatccctttttttttttaacttattttttattttggagataggagtcttgctgtgttgcccaggctggtctcgaactcctggcctctgcctgagcctcccaagtagctgggatcacagactcaagccaccgcacctggcctaaagcggattcctgacagtcatcttaaggtctggtccaatcctcatattccaaatacccgtggccaaaaaggtgggggtggggagaggggaagaaaatctctctagaaatgtgtgaatttgggagtacagtatttactgtcctatgacagtattcattaaattccattgtaggctgggcgcggtggctcacgcctgtaatcccaacactttgggaggccgaggcaggtggatcacctgaggtcaggagtttgagaccagcctggccaacatggcgaaacccccactctgctaaaaatacaaaaaaacgagccgggcttagtagcgggcgcctgtagtcccagccacttggcaggctgaggcagaagaatggtgtgaacccgggaggcggaggttgcaatgagtcgagattgcacgactgcactccagcctgggtgacagagtgagactccatctcaaaaaaacccaaaagtaataaataaataaataaataaataaataaataaataaataaaattccattctatcaccctggcagccacagctggcccctcattaaaactagaaagcctttcctccacctcccccttggggcagtaggatggtgccattctctaccactctgaacaggttcctgtcctggggttgcccccgtgggtcccaagggagcttctagggacgcctgctctgtgacgccctatgcaacagcagctgaagggcgccagtcaggcatggcgggagctgggcaggaaggggattgactccaggtcatctgggcaaactcccgggaaggggactgacctgtcaatcacccagagagctggggtaggcaggttcccctctccccacacatttcaagcagttctaagcacctccccaaactgccagagcagaggagagggaaagtggggttttctgggaaactcagtcggcccagacaaagtgctgcctgatagggatagaatgcaagtcacatacgtaatgaaaccaatattggcagtgacattataaaaagttaaaagaaagagatgaaaatattatcatttcaacatatagctgaccaggcgtggaggtgtacgcctgaaatcccagcactttgggagggcaagggggcagatcatttgaggccaggagttcaagaccatcctggccaacatggagagaccctgtctctacaaaaaatacaaaaataagctgggcatggtggtgtgcgcctatagttccagctacttgcgaggctgaggtgggaggaaggcttgagtcgggaaggcagaggctgcagtgagctgtgatcgtgccattgtgttccatccttggtgacagaatgagatcctgtctcaaaacacacacacacacacacacagacacacacatatgtcgccaatataaaaaattattaatgaggcattttacttatttcttttgtactaatcttcaagatccagtgtgtattctacgcttacatctcaatttcgaatagctaaatgttaagtgttcaacagccgtgtgtagacgttggacgacgcaggcctacaggcctgcgcctggtgcagccaaatgaaacaaccaaaagactttcacttctgcactggggatgtacctgcatctctctcctgtaattcccctccactcagtagtcatcaaattctaaaatctggctgggcacggtggctcacgcctgtaatcccagctactcgggaggatgaggcaggagaattgcttgaacctgggaggcggaggttttggtgagctgagatcgtgccattgcattccagcctgggcaacaagagcaaaactctgtctcaaaaaaaaaaaaaatctaaaatctttcctggccgggtacggtggctcactcctgtaatcccagcactttgggaggccgaggtgggtacatcacctgaagtcaggagtttgagaccagcctagccaacatggtgaaaccctgttggggttaaaattctaaaaatacaaaaatacaaaataaaaatacaaaaattaaggctgggtgcgttggctcacgcctgtaatcccagcactttgggaggctgaggcgggcagatcatgaggtcaggagatcgagaccatcctggctaacactgtgaaaccccatctctcctaaaaacaaatacaaaaaattagctgggcgtggtggcagacacctgtagtcccagctactagggaggctgaggcaggagaattgcttgaacccgggaggtggaggttgcagtgtgccaagatcgcgccactgcactccagcctgggagacagagtgagactcgtctcaaaaaaaaaaaaaaaattagtggtggtgggcacccttaatcccagctattcaggaggctgaggcagcagaagcacttgaattggggaggtggaggttgcagtgagctgagatcacaccactgcactccaacttgagtgacagagtcagaatttgtctcgaaaaaaaaatttcctaaactgacagataaatgtttctccattttcagatttgtgatatcagggccctccagtgcagggttcagcgcaggcccccttgctctggtctaaggatggtgttggaggtggtaacattatttcaactctggatcaagccaagctcaaatccagttcctcagaacattgccattatgcgcatcctcttttccccttgaggcagtttatgaagggttttctgccaagtgtaagtaaaagagtctcaactgatgtaggggcctaatatttcctttcaaggatctgggtaatcacagaggccccctcctccggcccccaaatttctctgctgttggtgctatgcaaacaagtttcttttgaattatgaatgatcctattcgtgtttctaattgtatatatatggggtacttgcaagtctgttcagccttttaagcaaatgtgtatgttactgacattctgatttccacggaattctccatttattccaaatggacatcaagtccataaaacaattcctctggagcatcagtaaagaacaaaatagcaggaatatgaaaatttctgaacagaaaagttgtattcctgttttttttttttttttttttttgctgttgttaatgggatgtttctatgcatgaacaatgaacagtcaggaaaagaaattaagaaaacaattccatttaggatggcaccaaaaagaataaaataggaattggccgggcgtggtggctcacacctgtaatcccagcactttgggatgccaaggcaggcagatcacctgaggtcaggagttcgagaccagtgtgaccaacatggtgaaaccccttctatataaaaattagccaggcgtggtggcacatgcctgtaatccaagctactagggaggctgaggcaggtgaattgcttgaacccaggaggcagaggttgcagtgagccgagatcgccccactgcactccagcctgggcaacaagagcaaaactccttctaaaaataaataaataaatacttaggaatttacctaaccaaggaggtgaatgacttgtacactaaaaagtataaaacactgttgaaggaaatcaaagaagacacaaataaatagaaagacattctgcgttcatgaattggaagatttaatattgttaagatgtcaatactacacaaagccatttgcagatttaatacaatccctatcaaaatatcaatggtgtttgtggcagaaatagaaaaatagatcctaaaattcatatggaatctcaagagaccccaaagagccaaaacaattttgaaaaagaacaaatttgtaagacgaaagcatcctgatttcaaaatacattacgaatctacagtaattcaaacagtgtgctattggtatagagagaaacatatggaccaatggagtagcacagagagcccagagataaattcttgcatagccaaatattcttcaacaagggggccaagaccacttgatgaggaaaggacagtttgttcaacaaatggtgctagaaaaactggatgtccacatgtaaaagaatgaagttagacccttattttataccacattacattagttaaaaattaacctcaaactctaaaataccttcaagaaaacataggataaaaacgttatggcattgaatttcccatatacaataatttctcatatacaacaccaaaagtacagttaaaaaaaatatggatgtgagggtgatctggctgtggcacctgtcaccccattgattgccagggttgatttggctgacctggctgactaggcacgtgtccccttcctccctcgcctcccgaagctgtgcgcttggtttaagaggacaaccatcccagatagaggaggactggtctccggtcaagggtataagagtagctgcactccccggctagaaccttcaaacaagctctcaaggtccatttgtaggagaatgtagggtagttaagcttccaagactccagacacatccaaatgaggtgctgcatgtggcactctgcctttcttaaaaaaggaagaaagaaagaaaaagaaagaaaaagaaagaaagaaagaaagaaagaaagaaagaaagaaagaaagaaagacaaatgagactacctcaaacttaaaaacttgtgtgcatcgaaagacacaatcaacagagtaaaaaggcaacctacaaaatggaagaaaacgtttgtaaatcatatatttggtaagaggttaacatccaaaatattcacaattatttaatatataagtaatttctacaactcaacaacaaaatatcaaataatcctatttaaaaatgggcaaaaacctaggcacagtggtgcacgcctgtagtcaaaagctactcaagaggttgaattgggaggatcacttaagtccaggaattcaaggtgagcctgaggaatattgcaagaccctgtctctgtaaaaaaaaagataaataaaataaaaataataaaaagtttaatgaaaaaaagaaaaaaaactataaaaaatgggcaagggagttatatagacatttttccaaagatgacatacacgtggccaacaggtacatgaaaagatacccaacatcactgatcattagaaaaatacaaatcaaaacctcaatgagataccacctaacacccattaggatagctactattccccccaatcccccacccaaaaaaaccccagaagatggcaaatgttggtggggatgtggaggcattggaaaccctgtgaatggctggcgggatagcaaaatggtgtgattaccatgaaaaacagcatgatggtttctcacaaatttaaaaataccgttaccatatgacccagcaacctcacttctgagtacatatccaaaagaaataaaagaaggctctcgaagagatatttgcaaaccaatgttcatgacagcattatccacaatagccaagaggtggaagcaacccaaatatccatcaatgaatgaatagataaacaaaatttggtatatatacatgatggaatactatgcagcctcaaaaaggaagaaaatcctgtcacaagctataacatagatgaaccttgaggacaaatactgtagattccacctacatgaggtttctggaggagtcaaactcatagaaacagaaagtggaaggaatgatggttacctggagctatggggaagggaaaaggagagctgttggttaatgggtattgagtttcagttctgcaaggtgaaagagttctggaggtctgtttcacaacaagagtgaaactccgtctcaaaaaaaaaaacatggttaagattttaaaaatagtccagtgaaacatacaatgatcctttctgttatccatcacccagctcccaaaatcaacagttcaaggtcacgatctgagattactttaggcaaaatctgtgtagaggtagggatagactgatgacttttttcattcattatccttctgctggtaacttaacctcgaatcctaatctttttgtaacctaatttctttgttcttcttttttgtttctttttagacagagtcttgctctgtcacccaggttggagtgcagtggcctgatctcggctcactgcaacctctgcctcctgggttcaagagattctcatgcctcagcctcctgagtagctgggattacaggtgcccaccaccacgcccggctaatttttttgtatttttagtagagacggggtttcaccctgttggccaggctggtcatgaactcttgaccttgtggtcacctgccttggcctcccaatgcattgggattacaggcatgagccaccacgcctggccacaactcacccggctaatttttgtatttttattttattttattttattttttgagacagagtcttgctctgtcacccaggctggagtgcagtggcatgatctcagctcactgcaacctccacctcccaggttcaggagattctcatgcctcagcctcctgagtagctggtattacaggtgcccgccaccacgcttggccaattttggtatttttagtagagaccgggtctcaccatgctggccaggctggtctcaaactcctgacctcaggtgatccacctgccttggcctcccgaagtgctgggattacaggattacaggcctggcccctttttgtaacctaatttgtgaagtgacatcatactcaagggaagggagttacataagggtgggaatctcagcaggagaagatcactgagggccaccccagaggttgcccaccacactatgggactattatttgaaagctgtagctttagcacttacgcttagcatgtttttaccataacttttattaggtgctttgaataaccatttcatgaggtattggtctttccattttacagctgactgtattatgtaatgtgttcaagttcacagaacaataatcataattagaactcatacatctcagactactgttttttattttgcagggtatatttttattactattacatgaaaatcatattatttaacatcaaagtgttctatggcactatatcaataatgggttttggagaaattttctttttggattgttacttgtaaacgtactcttctttgtatgtcacaattggtatgtttgaatcagaatgtacatattacatttgggtgttacaatatctcaagtttcttttgattttgagtcctcttcttccaacgcatctaaaattttttttatttttaatttttgtgggtacatattaggtatatacattcatggtgccctacttatttaaaacatgtcattgacttatagaagatacttgtttaattgatgtataaaatatctcacatcctggatttgcttgtttgctccctcctggtgtcatttaactttacattccccagcattttctgtaaatgaaagctttggaagcttgagtagattcaggttcaatttctttggcaagaatagttcgtaggtcatatagacattagtacagaactccctacaaaatgcaagcaatgttggattattccaggaagcatttggaatctctctcaaaaactcacaataatagggaataaaaatagccctagtgtccagccactagcttcaacttttctctcctccttgctaatgttagccagcattgattacctatttttgtcattgtccaagcagatatcataagccaagaacctcgctgaatatacaatgtgcactgaagaacaagtagatatatatctttcttgttttttatcacaagcgacagaaacaaactgtgcctaacattaaaagtactgtattaaaaggttgtaagatggatttatgctttcaccacccgtattcaacatagtactggaaatcctagcaagagaaatcaggcaagagaaaggaataaaaggcatccaaatgggaaaagaaggagtcaaattgtccctctttgcagatgacatgcttatatttagaaaaatctctatggtgtcagactccttatacaaagaaaaaaaaaatagaaaaacctagactctaccacaaaactcttagaactaatagacaaattaagtaaagtatcaggatgcaaaatcaacatacaaaaatcagtagtgtttctatataccaatgaagaactggctgaaatataaatcaagaaggcaatcccacgtacaataactatgcacacacaaaaactctgcacacaaatttaaccaagaaggtgaaagctctctacagggaaaactacaaagcactgatgaaagaaattgtcgaggacacaaacaaaaggaaagacaccctatgctcacggattggaagaattagaattgttaaaatggccatactacccaaagcaatctacagattaatgaatctaccaaaataccagtgacattcttcatagaaagaaaaacaaccctaaaattcacatgaaaccaaaaaggagcctgaatagccaaagcaatcttgagcaaaaagaacaaagctggaggcatttttccatctgacttctgaacatattacaaggctacaataacccaaacagcactgtactggtataaaaatagacacatagaccagtggaacagaatagagaacccagaaataaatccacatatttatagccaactgatttatgacaaaggtgccaataacatacactgaggaaaggacaccctcttcaataaatggtgctgggaaaactggactgtcataggcgaaagaatgaaagtagacctctgtctctcaccatatacaacaatcaactcaagatggattaaagacttaaatgtaaggccccaaactgtagaactactagaaggaaacactccaggacattggtctaggcaaatattttatggctaagacctcaaaaacagaggcaactaaaacaaatagacaaatgggactatattaaattaaaaggcttctgcacagcacagaaaatcaacagaatgaagagataacctgttgaatgggagaaaatatttacaaactattcatctgacaagagaataatatgcagaatatacaagaaactcaactcagcagtgaaaaatctggccgggtgcggtggtgcacacctgtaatcccagcattttgggaggccaaggcgggcggatcacctgaggttaagagtttgagaccagcctggccaacatggtgaaaccccatttctactaaaaatacaaaaattagcctggcatggtggcatgcacccgtaatcccagccactcaggaggttgaggcacaagaatcgcttgaactcaggagtcagaggttgcagcgagctgagatcgtgccactgcactccagcctgggtgacagagcgagactttgtttcaaaataaaataaaataaaataaaataaaataaaataaaataaagctatgatcagcacaacacaaatatccttattcattcattaatttgttcaatagttatttataagttctaccatattttactcactgctctggtctcaagcattaataagacgttgattagaacagggccaaggacagagccctattgtacctactcccagaaatacgttggctgtgaatcagctctttagagaacagggttattttatctgttatcacttcacctaacctatttcctctagcatccctaactccattttgtttaggaacatgtcttcaggcttttggcacgtgccttaatgaagtgagatccacactgtcaagcatcccacctttttccagactagtagattctgtgtttctaacaacactgtggaccaggatgtgggtgtgaactaggtgtacacctcagctttgcacttcttgctgtgaacctgtggcaagtcacttcaattctcagagcctcaggttcctcatctccaaagagggcaacaaacccaatcttgcaaggctgttatgagaattagacataatatacgtaaaatgtccagtacatactacttgtttttcccccttatttcaggtcagtttctgggagcacagatcatacgtactactttttgaacttgcatataaaaaaaattagaaaagcagcactgaattccagttaggggaaattagatttttttcaattcctatataaattcatgagaagttttaattcaagaatttacaaatcagagaaatagtatatacaaaaatgattatcaaatattaagactattatcttgaatttcaatgagttttgtatttatttaaaatatacaatatatggtcattgtagttatatataatgttagcttactatcattattgtattaatatgcaataaaagactttcccaaggctcagtgaaaactaagcacattttattttctctgtgtttcatatgtaaaataaacaccttgtacaggattctggaaagatgctatgctatgccatttttttttttttgttattctaaaaggaaggtaaccagacactgctcgaagaacttaaatatttgcatctggtttttaaaaagtagagagaaacaaaaagctgacaactatatctagagagggatatcagttcgggggaaagaagggaggcaggctgctttttcactatatagctgttgtaacttttgaattttgtaccttgtgcatatattattattattttatttattatttatttatttatttatttttttttttgagatggagtctcgctctgtcacccaggctggagtgcagtggtgcgatctcagcccactgcaactctgcctctcgggttcaagtgattctcctgcctcagcctcccgagtagctgggattacaggcgcccgccaccatgctcaactaatttttgtatttttagtagagacggggtttcaccgtattggccaggctggtctcgaatttctgaccttgtgatccgcccgcctcagcctcccaaagtgctgggattacaggcgtgagccactgattgaaaaaatagttaatctttttaaatagtggcaaaataattttaaataacactatccttttcactgagtttacttctataaaatctgaaagccttaaatacaaagaaggcaaactaaattccctgaaaagtcccattcaagtctgataatatatggattaaatcagttaaatgaaccacattaaaatagattgactttataacaatttctaatctctgcctgctggacattcaaatgaaaactaaactgtttctacaaagatgcccaattcattgcaaatattttaccaagaacaccaaaattttaaacacggacactttttagatacaatgaacaggatagtaagctatattgattgattgattgattgactgactttgagacagagtcttgctctgttgcacagactggagtgcagtggcacagcctcggctcactgctacctccgcctcctgagtttaagcgattctcctacctctgcctcctgaatagctgggattacagatgcccgctaccacacccagctaatttttatatttttagtagagatggggtttcaccatgttggccagggtggtctcaaactcctgacctcaggtgacctgcctgccttggcctcccaaagtgctgagattacaggcatgagccaccatgcctggctagtaagctagatttagacattaaaattcaaaatctatttttttagaatagtttgggcaactgtataagatttgtgattgtatatttgattgttgctgataaaattgtatatgaacaatcaacaatttacataaaccctgactgcctatttaaggcaaataaaacaagagttttctaaacaggattgtgcacaagagagagatattaaaaattttggccgggcacagtggctcatgcctataatgccaacactttgggaggctgaggtgggaggatcacttgaggccagcagtttgagaccaacctgggcaacacagggagaccctgtctctactaaaaatacaaaaattagccagacgtggtggcacacacctgtagtcctagttactcaggaggctgaggcaagaggatcgcttgagcccaggagtttgatgttgcagtgagctataattgtgccactgcactccagcttgagagacagagtgagaccttgtctaaaaagaaaaaaaagcgaccctcccatctcagccccctaagtagctgggactgcaggcgtgtgccactcactacatccggctaattttttgcatgtttagtagagacgggtttcgccacgttgcccaggctggtcttgaactccggctcaaacaatctgcctgcctcagcctccaaaattgttgggattataggcctgagccattgcacgccagccaggagacatagattatcagtagacactcaatggatgatggctcagaatttcttttcactttgtttagttaaccagaagaaaatgatttatttcttgccatagtcatataaaacaatttgcttttaaactactatgaaaggcctggcgtggtgactcaggcctgtaatcccagcacattgacaggctgaggtgggtggatcgcttgagtccaggggtttgagaccagcctggacaacatagtgagtcctcatcctacaaaaaataaacataaagttagctgggtgtggtggaatgagcctgtagtcccagttacttgggaggctgaggtgggaaggtcacttgagcgtgggaggtagaggctgcagtgagccatgatcatgccactgcactccagcctgggtgacagtgtgagacctcgccttaaaaaggaaagaagaaagaaagaaaaaagaaagagagaaagaaggagagaaaaagaaagaaagaaagagaaagaaagaaagaaagaaaaagaaagaaaaagaaagaaagaaagaaagaagaaagaaagaaaggagggagggagggagggagagaggaagggaggaaggaaggaaggaaggaaaagaaagagaaagagaaaagaaaacagaaataagctaaatatgagatttgatgctaagcaaatatagttgtgttgggagaaaagttcccccaacttgcctggtgcaatggtattacctcccttgtgaagttcctggcactatagtaggtacccagccaaaataagaccccttcctgcttccacgtcaacctcagtagccaaggtttcgtaactcctgcctttaaactgaagaaactgtatcaatgtctcgtaatgtaatagttccatagctggcagtaaagaaaaccaaacttaaagagccacttgagcagaggagatagaccaaatctgttgtattggttggcattcagggaaaactcaaagtcaaaaggcaccatctcaagaccatccagaaaagctcgttgggcccttgatccagaaagcacccagttggtctcctagagagcactgtagggattctgaaatcattacacgtggtttttaacccagccccagttggatgcagatataagaaccaagaatttgccctgtaggtgtatgacgagttgcttcttcataagttgcgttgagacccagcaggcaaagacacacctgttcaaagctaatattctgttaaacaataaccagggactactcatgaagttcctccagatgtctgaagactcccaggggcgaaaggccccaacggaaaggcctggcagttgttcaaaagccacactggattactacagcttccagccgctcaaattgaaactgcccaggtcgaagagttctaggagcagtgtagtgaccctttaactacatgctactttaacctgcatcttccaaactctttgaattttttttttcttttccaggacacgaaaaaaattcagaataataaaaaaaaagaatagcagtaactactttttcctgtgttactgcttgtgccagaccctgtagaagtgcataatatgctacgtcaactccatcaatatttcttcataacaatctgcaaggaagtattattgttcttattttacaaatgaaaaacctgagtctcagagaggtttggtagtttgctgaagttcacgtagctaacaagtggcaaaggtaggatgtgaattcaggatggattggcatgaatacccacgatctttactctcagtacacagcttcatacttacatgcagggttacaatgtgcttggtaaggcaagaaatctctaccaacacaggatttttttgaggattaactaagaaaacataaataagcacacagcctgttgcctgatacacgttaggaactaagtaaatgcttattttgttttaaaatcattaccctacattctggaaaatgtgccatggaatgggacgggcccacaatggtttttctatagagtttttagcgggttctggggacaactattatatattttaaaatagcaacgctcacatgctccatagtaaatcagttggccaagttaaaaatagattctaaacatagcaagagcagaaattcaatctaagatactaagtcatggaaagcagttgacagtggttgcaacagagaaaaggaagcgcaggcacacactgattctacatgtggataaaattctccaacctccatttcaggtttgttctattctctatagcagaaaacatgcacacatatatatgcatacatgcatatacatatgcatgcaaataaataaactaagatgacacattctatttatctgcaatagcaccatttacaaacctattaattttgagattttggtacttattagcacgtactagatacactacaacaatatatagttcctcaacatttttaggtgtaagagagaggatggttaatgtttaaaatatttggggtgcagatacacagatggctagactggtagataactagaaaggatggggacagaagctatataccctctgtgctcagtcaatttacagtggcagccttagagagttgggttaatgctgccattctgtcatttgaaaccccgggaactggtatgccagataaaactgcaatcactgtgccaaggactcaggaaaaggcgtggagcttaggttctccctcagcctcctacttttaaactgttgtttggagcacacaattactttctctcagttgctagggtgggtgcttcagctgtgggtgtcactatttagggaggaagccatgaaatgtatatccttaaatcacatagtcttgttccatgtacgtcaagaagagaatgactgagggatgtctattataaactggagtaatggcacatcacaccaaataaaactttccatgggatactaacataaaagcagatccattataaatataaaagaagaatgatacagagaagatcagcatggtccctgagcaaggatgatacatgaattcatgaagctttccatatttttaaaaacaccaaagcaggccggggcggtggctcacgcctgtgatcccagcactttgggaggccgaggcgggtggatcatctgaggtcaggagttcgagaccatccgggtcaacatggtgaaatcccctctctactaaaaatacaaaaaatgagccaggctcggtggctcacgcctgtaatctcagcactttgggagggtgaggtgggcggatcatctgaggtcaggagttcgagaccattctggccaacatggtgaaaccctgtctctactaaaaatacaaaaaattagctgggcgtggtggcacgtgcctgtaatcccagctattcgggagggtgaggcaggagaattgcttgaacccgggaagcagagactgcagtgagccgagatcgcgccactgcactccagcctggtcgacaaagcgagactgattctgtcttaaaaaaaacaaaacaaaacaccaaaataacaacaaaaaaacctacagaaagacttatgacacaattgataatttaggatcaataactttctcctttttttaaaaacaaaagcttgaaatatatttatttgtaaaacaccatgtgaaatagaataattgaggataaaaacacaggagagtggttagcagtgcaggtgttggagtcaggctacttgtgtttggtcaatactaactgcaggtctttggacaagaagtctcgcttctctaggtcacggtgtcctaaaatgtcatagtatacacttcatagagtcattgtggctgttaaagtcctatatgctagccatgatcctagcacatagcattctaaacattagctattaccattttctaaaagtaacagaggcaagagattactaaatacttgagataagcggattactgtaattgaggactgattttcctagaagctaaggaaaaaaaaaaggttttactttctgacaaagaaacaatcagcatacatcagtgaagactgcccaaacttaaataggagattagtaaaggaatctttgaatacaggacattgcatcaaatagcaggtatcgcaatgacagctttgcacaccgcagaaataattgtttacgtgtagtgcctgctgtccactctctaaaagagctgagggggtagggcactatattgtaactcatgtagaggaactgagacatatgctccaaattctttgccttctgacttcttatggttaggacacggaaaaatccagaaaactgaacatatgaaacttgcaaatgactgatatcttaagtgtatgttcggcagaagcggatcatgctttattcataattaagttatctaaatttttggctcaacaagtatttgtttccgacattgaacaaaggtatatggcttataaggatgaataagacgcattattctttttgcccttatatggtccacatgaggattaaagaaacaccacatgctggtcaggcgcggtggctcacgcctgtaatctcagcactttgagaggccgagatgggctgatcacctgaggttgggagtttgagaccagcctgaccaacatggagaaaccccatctctactaataatacaaaaattatccgggtgtggtggcgcatgcctgtaatcccagctactggggaggctgaagcaggagaatcgcttgaatctgggaggtggaagttgcagtgagtcaagatcatgccattgcactccagcctgggcaaccagagtgaaactctgtctctgaaaaaagaacaaaaaacaaaaacaaacaaacaaacaaaacatgctttagatacttgaggtaagggaaggaaatctcaaatggaaataagagtcaaatttctaagctgggcacggtggagcacacctgtaatcccagcactttgggaggctaaggcaggaggatcgcttgagcccaggagttcgagaccagccagggcaacagagtgaaactcctgtctcaataaaataaataaataaataatgaaaaaatgtaaaaagaaatttctgctgtcctcccagatgcaaggccagttggtgctgcagggaataaggttgcctaaagatagaatcatgacagcattttacttaggaaagagctatggatgaacttgaatacttggataagttcatggttaatatgtcagattacatatgccacataatataaggaaattgttataccatgaaaaaagttaagaccggttaattcagcccttctctttatttgcaaattggccctgtaaactttgtctagtttcaggaactgttggagggattttggaatcagatttaatcgctcctggtctgtgctacttaacttgcaagcatttctctgatatagtattaggttggtgcaaaattaattgcggtttttgccattacttttaatggcaaaacagcaattacttttgcaccaaccgaatacttttcttattgtgctttctttcacctgtagagtccaaggtacttgttcattaattgagccaaattatttaggtttaaaaaaagagttctgggacacagctctcttcgacgtggagatggatgtcttggatggatgaatatattaattaatccagtatttcctgaattttttcagttatacattatgatatggtttggatttctgtccccgcccaaatctcatgtcgaattgtaatcccccatgttggaggagggtcctggtgggaggtgatgggatcatggaggtggatttcccccttgctgttctcgtgatagtgagtgagttctctcgtgatctggttgtttaaaggtgtgtagtccctccccctgctccctcttcccctttctccagcctcatcacaggtgctgcttccccttcaccctctgccgtgattgtaaatttcctgaggcctccccagccatgcttcctgtacagcctgttggactgtgagtcagttaaacctcttttctttatacattatccagtcttgggtagttctttacagcaattcgagaatgaactaatacactttacttcttttttctctctctctgtctcctcccaggctggagtgcggtggcatgatcatagcttactgcagcctcgaactcctggactcaagccaccctactgcctttggcctcccaaagcgctgagattacatgtgtaagccactgtacctagccacccttcacttctgatttttgtcaggtccatgttacttgtactattagataccaacattttctttaatttgacataaattgtccaatttttaaaacatagtctcatcgtaagcaatgatatctgtgaaatctgagtttgaggcagatgtttaaatataccttaaaataaaaacaactatataaataaattaaaatcatgagccacataaaatagccttccactcactttggaaaacaaagtattaatcaattaataaaattttgaactggaaaggtctcttttagattttctaatccaactcagagttccacagagattcagccaaagtcaccagctgagggaagagttgggagtagagcctcagtctacggtttagtgtgaaaagtttagggctttctttaccatgtttgttgcaaattatgcccccaactagctgaacagctatttaaatataagcattcctatcaaatacaatgattttagtttgggtataaatggtgccaaagtaattcttctgttggtagctaataggtctgactgcttaagctcactaaaatacttattttcttatttgcggaagcaatagctctctctaattatttaaaaattatcaaataaactggattcagtggtgtgtgcctgtagtcccacctactcaggaggctgaagtgggaggattgcctgaggcctgaagtccaagaccacacccacacatacgtgcgtgcacgggtgagtgttatagaataaaaagaatgggttacactaattcatttgtttatttttttttgagagggggttcttgctctgtcactcaggctggagtgcaatggtgtgatctcagctcactgcaacctccatctcccaggttcaagtgattctcttgcttcagcctctggagtagctgggattacaagtgcacaccaccacgcccagctaattttttgtgtttttagtagagacggggttttgccatgttggcctgcccgatctcaaactcctgacctcgtgatccgcccacctcggcctcccaaagtgttgggattacaggcaaaagccaccgtgcccagcctacactaatttaaaatgttactaataggggagaccggtggggaggcaggcagaaaggaggtataggggaactctacattttgcttaattattttgtaaagctaaatctgctctaaagataaagtctaatagtaaaagcaaagatagaatgatattgaagcatagtcctctttaaaaataggaatgtgtctagctgagatcactctcttctactttatcttagcaatagtgttttgctacggactatgatgaagcattaagggccaggagcggtcaaggttggacagtttggcccatttatggtttagtacagatatggagggcatgtaggtgtctaggccctggattggaagtgaaatttgcccttaacattatcaacacagtgatcctatttcacatttttgatccccaaattctttttttttttttttttttgagacggagtctcgctctgtcgccccggctggagtgcaggggcgcgatctcggctcactgcaagctccgccacccgggttcacgccattctcctgcctcagcctcccgagtagctgggactacaggcgcccgccaccacgcctggctaattttttgtatttttagtagagacggagtttcaccgtgttggccaggatggtctcgatctcctgacctcatgatccgcccgcctcggcctcccaaagtgctgggatgacaggcgtgagccaccgcgcccggctgatccccaaattctattagtgttattactaggtgatacttacggaaaatagacaatgattatcctaagatttcaaagcataagtattaagtggtaaaaatgtcatacccgttttaaagaaaggggggcgtagaggcctaacattcctaaatgacactggggcaaaaatagaaataaaatccaggtgtctagggcctggctttcccatcgttgccgttcattgttaaagtgatcattaaacaataacaatacaaagaaagacagggtcatagtcttatgagcactcatattttaaagagaaaggcgttaaaaagaagctatacaggagcctcaattctgcataggcatggttttttaagatgatttagggaaggttttgtgtttgttgccattagttttaaaagtattaaattcttggttatatcctttttttaaaaaattgtatttgccctaatcatataacatgaaaaacgtacgatcaaggcaaaaaaataaagtgctaggtttagttatttggtttcaaataagccacaactagtatgaaatttctagttaatattctacttaaaggtctacaaattcaaaggccttgagacccacttaaggcaccgaaataaaataacttagtgaataaacttagccaaattacttaaatccctaatcccttgctttttacaaataggaatacctcaccacttgtctcctgggaaagatactattagtctattctgatgacacttctatggcattttggattgccagttgataattttcaaaaaaggtagatacaaaccattgctgggtatgctgtggccatgatgagggcatagtatacatgctgtatactatttgaaggagaatgtagttttggtgggtgagtgtctcaagtttgtgggtcattgttaccagctgtaaaaggacctcagcaactgcagagcagttatcaggtttgtgtactccctgttggacctagaagacagtcctgcacctagtaggtgctccagaagcattttctgaatgccgagtgaatcgtccccctccaagactggagagggaggctaaaatgaacaagagcccccccaggagtttgtgcctgccttccttttactacttggtgaggaaggattacgaatatgtaagaaatgagaggcactagagaatgaagtaaacccttcaacagttacccagctgtcccttggcctgacttcccctagctccatgccccaaatgcaactcacttttcccttccatccaagccttcctaaaaataacttccttttctaacttctcactcctgtcaccactattcatttccaagtctcacaccttcccttacctccttgaaaatatagctgacctgaaaaaaaaaggcggggcggggggtaagggtgggggaagagtgtagagaaaaacccagccaaactgtgaagatgttttactgttacgtgtttgcactgcattgcgtagtgacgttctctgttgaaaatggggctgcagatgcttgttctagggtagttactaggtaatgtgggactttaggaaggagttagcttccaactcacaagaatatttagtctcaactgatttttattcttaagcatcttattaagtgtaagtgtccataacccaggcctgcacagtcaaggtcaggtactgcattgagtcattctctgctcaatttttttccttgccccacctctactgtaaccttttaaaaaaataagatacaaggtttcactgtcacacaggtacgcagtacagtggcaagatcattaacctcgaactcctggcctcaagcaatcctcctgtctctcagcctcccaaaggaggcatgagccaccgtgtctggctcaattttctggtcaattttaaggctcaaaatagtattgtaattgctcataatataaaacatagtacaaattcagtttttactacttatctgcttgttgaatgcgtattgcaatttaaaaatccacatactgccgggcacagtggctcatgtctgcaatcctaacactttgggaggctgaagagggtggatcacttgaggtcaggagtttgagaccagcctggccaacatagcaaaaccccgtctctactaaaaatacaaaaattagccaggcatggtggcgcatgcctgtaatcccagctacttgggaggctgaggcaggagaatcacttgaacccaggaggcagaggttgcagtgagccgagatcatgctactgcactccagcctgggcgaaagagagagactctgtctcataataataataataataataataaaataaaaataaaaatctacatactgtatacatataactgtttattcagacccaggatatttttcctttgtcctgtcagagcctcatggactaccattcatctggggaaactctgggaaggaaaattaattatagtgctggcagcattggaatggtcaggtgacagagaagccacgtgtgccacgtgtcaggcatctcctcttaccatctcagagggactcacgaactttctgaatcaggagccatgtttgtaaaaattttctaacattccagaacctttataatatttctgcttgctaattttattatcctatctctttccccatagctcagcagtaaaactctttaaataattttttttttttaaaaaagtacatgattacattcaagggtaacaaggagggtggaagctagaaagattgggggactctagcccccttcacagtgcccctcatctgtcaccccattggatggtgtatgcctccctccgggggagaaaagcaggctaagcccctggggcttgatacacggaggaaaagaaaaaatccagagtaagattctgaggcacaacctggaagagactcttggggctgagcagtagagaggctttgcctttcagagaagcaatttggggatcttaactcttggtttcctcatgtttcatatggaaatattagtatatttcttacagggctattgtgatgattacataagatagtccatgtaaaatgcttgacatacttcctagaacacagtaaatgctccaaacattaccactattggccctcgagtcactggagggtgacacggacatagtccagaaaaagtaaatcaaggcctggtgcggtggctcacacctgtaatcccagcactttggaaggccaaggtgggtggatcatttgaggccaggagttcaagaccagcctggccaacatggtgaaacctccatctctactgaaaatacaaatattatctgggcgtggtggctgcatgcctgtaattccagctacttgggagcctgaggtatgagaattgcttgaacccaggaggcagagtttgcagtgagccgagatggtgccagtgcactccagcctgggtgacagagtgagactatgtctcacaaaattaataaataaattaaaattaaaatcaaatcaagccacaagtaagagagaactatagattgcctccatgtccaaaatggtgaatcaaggccggacacagtggctcacgcccgtaaccccagcactgtgggaggctgagttggatggatcacttgaggtcaggaatttgagaccagccagagcatggcggcacacgcttgtaatttctgctactcaggaggctgaggcacaagaattgcttgaacccaggaggcagaggtttcagtgagccgagattgcaccactatactctagcctgagtgacagagtgagactgcctcaaaaaaacaaaaacaaaaatggtgactcatcttcttatctccattttacagatggggaaactgatgttacagagaggaagtaacatgtccaaagttttctagctaatgagtagtggactgagattcaatcctggacccctttacctcctaagaccatttccttgttcttctatacagcattatctcctgatgtaaatgttaacataaatgaaacctaatttcaaagatttatttttggagctggaactaacaaaacattccaaaatcaattagcagcatatttttacacttttcctctatttttacacatgaggacgaagaggtcgtgtgagcaaccataaacacgtattgaatctttggatcagctaccatccttcacctttaaggttttattttcaataaataaagaacagagacttagcctggcaataagtgtgcctgaaaaatgctggttgggataggaagtgtttaagtaatgaattaaatcgtgacttgctgtgtcaaggtctatattaaagagaaacataaaggaacatgtgcttttgagagaaacagggccagcgtgtgatttttccaaatgctttaagagctgtggtttcatgtaagtgttactcgcaagctgcccacaaatgctgccacccgggcttcctgtgccgggtctccctggaaagcctgaacgagctttggcactgaaaatgatcttgtccagggccaagaatttaacacaattaaatttctccctcttgactgagaggcctgaaacctaaagctgcagaaaggcgggaaggaaagagaagtatgaaggcgagagcccactactagctcatggtagaggagtaaatttcgcctccactcctgccttccaagagccagcatccggccagacgtttagtttccctctttgtctttccagacgaggacaaagtgcatgccactatctggttctttcaagtctctaagagtctctgccagatgcttgggttgatattttgaagcagtaaaaaagaaagaaaagcagagagagaggtgactaattctgtggagaatgtttgctcttaacattcttctctaaatatttgggttattgaaaggatctaacaatatcttattttataaagaagcagaaaaacagtgatggctgggcccagtggctcatgcctgtaatctcagcactttaggaggctgaggtaggattgcttgaggtcaggagttcaagaccagtcaggacaacatagggagactccatctttacaaaaaataaaaaattagctggccatggttaatcctggttagcacacctgtagtcccagctacttgggaggctgaagtgggagaatgacttgagtctgggaggtcaaggctgcagtgagcccaccactgcactccagcttgggcaacagagcgagactttgtctcaaacaaagaaacaaacaaacaaacagacagacaaaacagtgactctgaaatcagaactagattcctaaccagctctcttatttactggctgtgagctttaaccaagccatttatgtgaagatgtggtatttttatctgtgaaacgtgaatactaatacaatacaaagtacctcatgcagcttaataaagaagaactacttttattattataactgtaatgaaactatgtccttattctgttgtattctgataaggatttccttttgagatcataagctcagggactcatctatgaggaggggtggtgtcttccatgaagggctggatatttttgatgatgatcattcagggaaggcatgtaccctcagttaggaaactgaaattagaccagagaactacctccctccctctcactgtcctgcatctacagctcaaggaatccagatacccttacaggccctcctgaatagcaaggtggaaacaaggaaggggccacaagctgaagatgataagctgtacggtgtaaaccagatcgcatgtcatacaggcagcagattacagcagtgaagggtagaaaccctgaagtcagaacatctcccgttgtgcatttgaagcattagaaaagcaaactctcctagtggaaggtgaatttcaggacagaaggtggggtttggcgtctgagtgcttctgcccaggtggaatggggcttatttcagtagatttccttgcaagtcctttaaacttctcgaagctttcagttacatctattgcgcctcgtgaaaactctaaaataggaagtttggacattgttacttctatttttatgagttaataagttttaaagagattacatgactcgcccaggatcatgagattagtaaatggcaatgcccaaggaaaatccagtttttttaaaaaaaaattattcccagtccagatttcaattatctccatattaggaaagtaaacagggcatgaaggatttttaaactatcattttgcattattcccaccacttaccctttccacttcactcacatcttaggtaactgagtcaactgcattcaaaagaaacatttttggggggagaggggagggatagcattaggagatataccgaatgtaaacgacgagttaatgggtccagcacaccaacatggcacatatatacatacgtaacaaacctgcacgttgtgcacatgtatcctagaacttaaagtatgattaaaaaaaagtaaaaataagtaaataaataaattcctttaaacaaaaagaaacattttctgtgttcctcacggacacatcactgatggctgtctgaacagattcaactcactataaattcaagcatgcaaaaggacataacctgtacatatccacctggctccatagagtaattaagcaaataagtgtcattgtctaaaactatgtgcttgcttttctgatttagccctaagtttatatatccatgagtgggatcaaaaacgattttccgattctaaatttctgaaaatcacgatgagatgtttaagtgaaaaaatgctttggcagcatacaatattacaagttactcaagtattacaagttaacaagttactcaagctatagctcagaagccatatacatatatatgtgtatatatgtagagtatatatgtatatatacacatatatgtagagtatacatatacgtagatgtatatatactctacatatatgtatacgtatacatatacgtatatgtatacgtatatgtatatatacatctatctatctatctatctatatatatatatatattttttaagatggagtcttgctctgtcacccaggctggagtgcaatgccatgatcttggctcactgcaacctctgcctcctgggttcaagtgattcttctgcctcagcctcctgagtagctaggactacaggcttgcagcactatgcccacctaatgtttgtacttttagtagagacggggttacaccatattggccaggttggtctcgaactcctggcctcgtgatctgcccacctcggcctcccaaagtgctgggtatacaggcatgagccaccgtgcccggccgcaaaatatattctgaggaataaaaatgattgtagttagttttccacagtccaaagcaagctaataatatttaaagagttaaaagtgtaatataatcatcggtcatgtttctacaaccaaagagagttgaaaggagtcaaatatcagcataatgcagataatgtactcactggcattgtgggcctttattatttggataatcattttcaccttgtggagacttttccagaattatatacttttatgcctaatcagcaaattaggcagttgaaaagtatgtatgaagcagctaatatgtgccccaattaggctaggtagtgtgggtatataaaaagggtttataaagggggaggctcctattcaaaccttagtggggtcaggagatgcggaagttaattaacatatattaaatatttttttactcacccacacctagagaaacagtactgttttaaatgtgctgtaggagttcagagaaatactgattaatgtggtttggaataaattaaataataaaaagctttgctgaatacagttagtttaaaaaatataaaaatatagggggatttgcagagaaatctgttcaactcttaaaataatttttaatttatatatgtttatataagaattccattttattaacatgaaatactagtacctttttttggggatggagtcttgctctgtcatctgggctggagtgcagtggcggatctcggctcactgcaacctctgcctcctgggttcaagcgattcttctgtctcagcctcccgagtagctgggattacaggcgtgagccaccacattcggctaatttttctatttttagtagagatggggttttaccatgttggccaggtgggtctttaactcatgacctgaagtgatccacccgcttcagcctcccaaagtgctgagattatgcgtgagccaccgcgcctggcccagtacttttactgatgaaaaatgtaatgtaaaaggaaggtctgtcttacatacaataagtgctgaatctgggtcttttttaaaaaaagtcattgagaagacttactcctttcttaagttttaagacatttattattgcaaacagaaaaattgtactagataccggggatatataaacgaataatgccgtttctgtcttcaagatcttactgtttggtaggtggaaataaagtgaacgaacgaaggcactgcaaatcaatgtgggaggctctataagcatggggccacagaggaaaaggctgagagggaaagcttcaatgactaggtgacttcaaaaaggtcatcctggccaggcacagtggctcacacctgtaatcccagaactttgggagggccaggcaggcggcagatcgcttgagctcaggagtttgagagcagcctgggcaacatggggaaactctgtctctacaaaaaatacaaaaactagccagacatggtggcgcgcgccgctcctcccagctacttgggaggttgcggtgggagggtcacttgagaccgggaggcggaagttgcagtgagcagagatcacaccactgcactccatcctggacgacagagcgagaccctgtctcgaaaaacaaaagacaaaaacaaaaacaaaggtcatcctgcaggacaaccaggagggcacaaatgtgtgtctgtgggaagctgaaatgttggcgggggaaaaaagcagggaaaggcattccagaaaaaggaaactgtaaacagcacacgaaaaagcatagtgaatgaataggaagcctgagaccaaacttagggtttcctacacttatttcaaagcccttcattatctatatggaaagggggagtctttaaacacaaatatttagatcatattgactgagatttagatataaatgaatgctaataattacttttcgttattttggggtgttaaacatttactgtacaagattgtattcgttttaagtatcttctaacatgagccattttgtaatgattcagttgtttatattcaatttcaagtagaatgctgatcacagcgccaaatgggtatcttctacagaaaaagttattttaataaagaaaaatatagtcagttttaggatttcctgagagattatagaaacaataaaagcattaaaactgttaagtcattaaatacgagtaccttgtattttgaaggctcttaaaatttagtttataaattgcttttacataacatatgcactgaaataccacttaagattagttttgaaaataggtgttcgtttcaaccacatcattaggtattttattcaaagctctttataaaaagagctttactatgttccagtatagtaaacttatccagaaaataagacaaaaatttaacttcatgctatagctgcaaagttttcggaaagcgggatttaaaacttccattgtaactttaactagcggtcatgtcaaatttcacaactaagaacattttaacgcatgtaatactgagcacaacatgggcacgtttttgttgctatgagaaccttctattttgtattagacattgcagccttgacgacgcaatgtttgtgctattttgcgcatgttttcctgcagctattcctctcctctagcaatagtcgaatggctctggtttcctcttgcgcccggcccagtttttccgttttagcttcggttgtcataggctgtgctgtcgctttctctgggaaaggacggtgaagactggacgggagaaaccgggagggcaggcgcggccgttctgcagcagccgggccgcttcccggcgggaggcgggctgcgaatgggaagcgggaggaggaggccgggccgcgggctggttctatcacccccttgggagcccagctcttcacctagctctccggcgcttttcaaaatctgcagttaacaacaaaaatcgagcaacgccacgtcgcacaaacaggacaggagggggcgaggggtgtgtgcgcgcgcgtgctgtccccaaatggatgagaaataagggaaaggaggggttggggaccgtgtgatgaagcaacatgctaggcccgggacaagtccggctccggcctcgggtctggagggacaaggccgggggccgggtggcagacggggcctctggtcttcccccagcgcgagggtcgtggcgcgaaacggggacagggcgcgcgctcggagcctcctccccgccccgccccgcccaagggtcttcctcccccgggattcagagcggcccctcctccaggccaggctcgccgcggggcgctgagcaggccgggacaccgcggccgaggttatcgttaggcatctcccaggcgaccggctccgcagcaagatggcggacgagaaggacagggaaggtaaggtaggggagccggggagccgctgccctcgccgcccgccgcgaccccgggctgcacggggaagcgccgggtggggtgggccctcgtccatctggagttcccacccgcagggaaagggcggcctgaggagggggccacccggcagcagcagtcgccctgcccccgtccccgtagcccgcccggcccgccgctccgccccgccccgccccgcctctctcccccgccccgccccgcctctctcccctcttccctccctcttctctctcccctcctcccgccttcttctttctcctcccgccctcttcaccctcttcccctcctcccgccccgtcctccttccccctccctcggaggccgggccttgcatcctgcgcgggctgcgccggaggcgccggcagggggtgctgataatggcgtcgttgttcacggtcgcggggaagccgccgccgcctccacactctcgcctggggtctcggtgccgcaggcgccacgcccgtagctgtccaggctgtgggccccggggggtggcctgggtgaggaggagttctggccgcctgaatctgacgggatcctctgtttgcgccgaaaccccgcgctggcgcagcctgatggcgttcgcggccaccattttgcctccttaatgaggacgcaggaggacggtctggaggtcacagccgctgcctccgagcttcccggtcctccgaaatgcctgccccgccgccggctagcgccgcgcaattggcctagtgtcttgtcttaaaaaaaaaaaaagacacacacccaaacagcaattttaataacgacgaaaaaccaaaacctggttgagatcttggaaccgctgtgcgccggccgggcctctcccaggggaccacccagccccgcgcggtggccgcctgcagaggcgggactgcgcttcgaggcttaaggtcgccagttcggaggcatcgatgtgttgtctgtgcggagaagccaaaaagtgattacgtttatttgcaagaccgttcatgttgttttcagttcatggtatgattaaaacccgatcctttgttaccatgcccttaggtactaaaaaataattgtgtttgatagttggcagtcacccaaaaatatccaaaaagccatgaaacagtaaaggtaaacaagtaggaagtgaaaataatattcgtcctttgttttctttctggagtgctcaaaacaccctctcaaaccatttttctcagcatagaaccaagtgtggtcaggttaacagctaatatttacaagggaagaaacgaaccctgagatatttagtcacttgttccggtgatcacagaaaatcggcgaagaaacacatgaaactgccaacgatctctctattgataacaaggataccgtgatttttatgtaatattaatctgagaagccaggattattttgtaggtattagctttacgaagatgcccttacatacaaagaaaaggataattttaaaactttcccagaaaaatggatggcttatttttgttctttaccaaaaaaaaaaaaaaaaaagccattaggagataaactagcaaggtaattatggatatttattttcttaaaaaagacttggttaggtcagcatgagaaaaaacgcactggagtatggtacaaatacagtatttctcgttttttaaaaactgagagctttcctgatttttcagcttttgaacaatttttttccatttaaagtaaattcagagaaacaattttgtcgataactcatagaagtaatgactgttaaaagctggatgccattcattcagaatacatatattcaatgccattatgtagataaggcattctacttagaactttgaaagatacgaaaatgaaagacattgtctttgcttccaaggaaggtgagatgagtaagggagatgagaaatttacaaatgggaggaaatagttaactgggctgagtagtctgggtgccaaccactgtgctaggtgtgtatccttgtagtccgtggacagcagcctggacatcactggctgccaccgacctaataatgaatcagtcttcattttaacatgtttgtaggtgatttgtatgtacattaactttcgagaaggccgggcgcggtggctcacgcctgcaatcccagcactttgggaggctgaggcgggcggatcacgaggtcaagagatcgagaccatcctggccaacatggtgaaccccgtctctactaaaaatacaaaaattagctgggcgtggtggcacgccctgtagtcccagctactcaggaggctgagacaggagaattgcttgaaccggggaggcggaggctgcagtgagccaagatcacaccactgcactccagcctggcgacagagtaagactccgtctcaaaaaaaaaaaaaaacaaaaacaaaaaacaaagttcgagaagcactcatgtgctgtatctcatttattgttaacagttttatggattaactaattgcagtttgtgaagggtattatgaaataaaggcattttgttagaggataaactaagtagagactcattttggtggtaagatctttttatggaaatagtctattactatatttgattgtcagctactgtattttgaattttcagaaattacgtctaaccaattaatcagaattgattaagttttgaggattcactcaactaaactcataaaagactgatgtgcaaacctgaatgatttattaatttaaataagggtatatacattgacttgaaggctgattttgccaatatactaatataataattttggcaatatactaatataataatatactgttttatgggtactaagcttcgggtagtgtgaatttgtatttcagaagtcatttgatgaccgtggaatcacacaaaagaaaggataattttgaaggatgtgttcagtaccctctaagttccaaaagatctgggaccatttctgatctgttaatactgagtgttgtgcagagtgcttggaacgtggtaggtaatcaataaatatttgttgaattcagaacatttgaattaatcaaagacagcttatgagattttaaccaaagcattcctagctattttccccaaacttattctatacctaaaagtacacaaaactcgttttaggtctcttttcccctctgctttaccggtaagatacattcttctattccatctggctcaacaaaacgttttatttcacagtgccacggtattcactagcatgtctttaaaaaacaactacaaaaaacctcattgtagaaatacacatatgttttaaatagttcatccttaatattgagatttctaaaagttctaaagggggaataagtttcagggtacctatcctatccactcttcttcaatatttagagattaactttgatagaagtattgagaatattgataagaaaaattacctaaattagaaggggctattgtgctcataaaatttttttctaagattatgtacgttgaagttgttatacttatttgtagcattttttgctttcatacagtataatttattttttcatagattaaaaattatacagaattatattagctaaaagtttaacctttagaaccaaattatttttaaaaccacttttttaactgaaagaagaatgtttgaaacgggatgagaaaaaatatttttgaaggtttattatttttccaaagtttcctcagccagaacattttttgttttgttctttcttttccttctgttttgtctgtttaaatggagagtcaatgcaattgttgattctttggctccttaaatcttattgtttctgtctcttagagaattttatataggactggaaggatcttctgtttgtaattagactcacgtctaggaaacaaactgcttagttataaaatttgaacttttggcagccagtgagctttggaaagtaagaactttttagtaagctgcagatattaaaagctcactctaggatttactatttttgtttctattaaaatattctttgttactttgcgtgctttgataacattgcttgataaagtgcctctaattcaattatcacctcctaaatggaagaggttttacaaggtttgttgttttgtttctgatttccttcattgtgccactcttttgaaaacccaacatttggaaatataaagtaaaaaacagaaatttcaggtgcctattactttataaaaagggttcccttaaataacgtctttgttttttttttcttcttttattttgagacagggtcttgctctgctgcccaggctggaatgtggtggtgcaacctctgttgcctaagctggaatgtagtggtgccatcacggctcactacagcctcgacctcctgggctcaagcgattcccccgacctcagcctcccaagtagctgggactacaggcgcaagccaccatgcccgactaatttttttaatttgtagagacagggtttcactgtgttggctacgctggtctcaaactctttattttttttatttttattttttttttgagatggagtctcgctctgtcgcccaggctggagtgcagtggcacgatcttggctcactgcaagctctgcctcccaggttcacaccattctcctgcctcagcctcccgagtagctgggactacaggtgcctgccaccacgcccggctaattttttgtatttttagtagtgatggggtttcaccgtattagccaggatggtctcgatctcctgaccttgtgatccgcccacctcggcctcccaaagtgctgggattacaggcgtgagccaccacgcctggctcgaactcttgagctcaagtgatctgcctgccttggcctcccaaagtgctgagattacaggcatgagccaccctgcctggcctcatagtaactgtcgatagtatagagtgtagcctgtgggacagtacaaaggttgagctttgaagtaagacttgaatttgaattccgtcttccccaagctctaattatctgatcttagccgagatgctaaacataagtagcttcaagttcctcagatgtaaagtggggataattatacccccaatatttcataatgttgtaatggggacaatgttttcttattcatttttacatccccagcacctgccacagtgcctggcatcaaaggaatgctgaggccggctcacgcctgtaatcctagcactttgagaggcccaggcaggtggatcacttgaggtcaggagttcaaaaccagcctggccaacatggtgaaaccctgtctctactaaaaatacaaaaaattagctgagtgtggtggcgcgtgcctgtaatcccaactactcaggaggctgaggcaggagaatcgcttgaacccaggaggtggaggttgcagtgagctgagatcacactactgcactccagcctgagtaacagggtgagactctgtctcaaaataaataaataaataaataaaaaatacaataaaggaatgctgaataaatgggaaagaaagtgtttggtacgtatctagtgaattagtaagtattagtatctgcttaacataaaacataagagttggccaggcgtggtggctcctgcttgtaattccagcactttgggaggccgaggtggggagatcacctgaggtcaggagttcgagaccagcctgaccaacatggtgaaacgctctctctacgaaaaatacaaaaattagttgggtgtggtggtggttgcctgttatcccagctactctagaggttgaggcaggagaattgcttgaacctgggggatggaggttgcagtgagcctagatcgcagcattgcactccagcccaggcaacagagcaagactccatctcaaaacaaaaaaacaaataaaacataagagttaagaaaacttttaagtcttaccaattgggatcatgcataatgcattcctgcatatttctggggtaatttaataagttttcttcctgttttagaccaatataaatatccggttaagactaagcaaacaagaagactagctttttgaagcctaatttgtttcctcttattcagaataaaaaaaaatttgaagaaaaactggactgaaatttgtttttgctctgatatataaaatttacagaaatgtctcaagaatagtcataattttaaagatcaaatggacagtgagatactacctcacgcctgttaggaaggctattatcaccagaagtcccccaaataataagtattggtgaggatgtggagaaactggaaccctcgtggactgttggtggcaatgagaaatggtgcagctactatggaaagtggtatggcggttcctcagaaagttaaaagttgagttaccatgtgacccagcagttccacgtgtgggtatatatccacagtaattgaaagcaaggcctcgaagagatatttgcacaaccatgttcatagcacattgttcacagtaggtaaaaggtggaagcaagccaagtgtccatcagcggatgaatgaacaaaccaaatgtggtatatacgtgtagtgaaatattattcagccttcaaaggaggaaattctgacacatgctaccgcttgaatgaacctgaaagacatcatgctaagtgaaataagccagtcaaaaagacaaatactctgtgattccacttacatgaggtacctagagaagtcaaattcatggagacagaaagtagattgctggttgccaggggctgtggggagaggagaatgggaagttgtttaaggagtgtagagttccagttctgcaagatgaaggaagttctggagattggttgcccagcagtgtgaaggtacttaacactattgaactatatggttaaaagtggttaatacagtaagttttacattatgtgtattttaccacattttagtaaatagaaaatgttgagtacattcagaatgaaagaaatggtacattgtttttcaaaggcaatttggaaatttgtattgaagaataaatgatgatggctaggcaaggtggctcacatctgtaaactcagcactttgggaggctgaggtaggaggattacttgagaccaggagttcgagaccagcctgggcaacatgctgagacctcatctttgctaaaaataaaataaataataataaagaagtcgggggttccctctgttggctttggagcccccatccctctgtctctgtacagggaagcttcttccttctcctttcttgctccttcttgcctgttaaactctctatttcttaaaaccaaaaaaataaaaaataataataaaaagtgatgtccacatgctttgagctttaatatacttctggatatttatccttagaaatatattctgaaaagaataaaaaatgctctaagcacaaaaatgatcaacataaagttatctataaatttgaaaatatagataacatttgcatgtccaactaatggggcatacaaaataaatggttgtatgtccacttgttgggttgcagccaaatatataaaaattatatgtgtaaatgggtaaggacacgtgggggagcccaggagatgatgatgatagcagggtgattagacttttaggggcacttatttttaaaatctcattttaatgtcagttctacaaaactttaaaaacccacttaaatatgctaattaaaaattattcttacccacttgtgaaagtgtgtttaccagatcctgtacttgacaatcctttgtaaacctctagtatggattttatagatattaagactgtaaaaaagtaattttagtttttatttttattttttaagagatgagatctaggccgggcgcagtggctcacgcctgtaatctcagcactttgggaggctgaggctggcggatcgcctgaggttggaaattcaagaccagcctggccaacacgggaaaaccccgtctctattaaaaatacaaaattagctgggcatggtggcgcatgcctgttatcccagctactcgggaggctgaggtaggagaatcacttgaacccgggaggcggaggttgtgatgagctgagagcaccattttactccagcctaggcaacaagagcggaactccgtctcaaaaaaaaaaaaaaaagagacgaggtctcactctgtcaccctggctggggtgcagtggcttgatcacagctcactgtagcctctactttctgggctcaagtgatcttcccactttggcctcccaagtagctgggactgcaggggcgtgccactgtgcccaactaacatttttatttttggtagagataagatcttgctctgttgcccaggctagtctcaaactcctggcctcaggcaatcctaccaccttggcctcccaaagtgctgggattacaggcttgagccaccacctctggcccataattttatttttttaaatgcactagtaaaattgggagtttaaaaacctggactagaatttggacattgcctttttttttattctttttaagattttgcttgttagtgtcaatttatctgacctttggtttgaagaatttccatctaaagaggaagataggcagctaaggagacaatgatacaataatgtgataagtgctatgatagttgcacatgtatgatgattgggtgcctggggagagtcacctgattcacacacaccctctttaaattatagcccctttttattccctctcatagctatttgtttttttcctctttcatactatattttgtaattgcctgtagatgtgttgtttgatgtctgcttctcctagactcttaacttccaaaaggataggggtcatgctcatgcatatacccagagcatggcatatagctcagtatttgctgaatgttgaatcaaagttggctttctgaaggagataaccgaagcttatcttttttttttttttttttttttttttttttgagacgtagtcttgctcttgtcgcccaggttggaatgcagtggcgtgatctcggctcactgcaacctctgcctcctgggttcaagcgattcttatgtctcagcctcccaagtagctgggattacagacatgtgccaccatgctgggctcatttttttatatttttagtagacggggtttcaccatactggccagtctggtctcgaactcctgacctcaaatgatccgcctgccttggcctcccaaagtactaggattacaggtgtgagccactgcgcctggcctaatttttgtatttttagtagagacggggtttcaccatgttggccaggctggtctggaactcctgacctcatgtgatccgcccaccttggcctcccaaagtgttggtattacaggtgtgagccacgactcccagccccaggcttatcttgaaggtgtaatagcacagagaacaagtaggggatggatatttcaggaagagaagaaataacatacttgaaattgtgaagactcaatatggccgaaatttaggatgggttaggagatgtgggaatttttattcttaaagcattggtgagtgattaaaagtttttaacaaggccgggtgcagtggctcacgcctgtaatcccagcactttgggaggccgaggcaggtggatcacgaggtcaggagatcaagaccattctggctaacacggtgaaaccccgtctctactaaaaaaaaaaaaaaaaaaaaaaaaaaaaattagctgggcgtggtggcaggtgcctgtagtcccaggtacttgggaggctgaggcaggacaatggcgtggacccaggaggtggaggttgcagtgagccgagatcacgccactgcactccagcaagggcaacacagcgagactccgtctcaaaaaaaaaaaaaaaaaagtttttaacaagatgggaggctgaggcaggataatcacttgaacccgggaggtggaggttgcagtgagccaggattgcaccactgaactccagcgtggctgacagaatgagactctgtctaaaaaataaaaatgaaaaaataaaaaataaagttttttttagcaagagacaatcatatttgttgtctagaaaaatcacttgggcaagtgtgctcagtggattagatggactccaggtttgggactccaggtttgtcccagtatagtagtccagaaagataaaaccctgaaccaaagtaatggaagtcaggaatgaaacaaggagataggctagaggaaatggatagattttgtaataggacagatatgaatattgagtcaggtcagggacacggtttctgattgggtaacaaagaataaagaggaatagtagagttatgtaaataatagttctagtcttgcacatgttgagtttgggtgcctgtgaggcattcaggttgagatataacataggcagcactgtgtgcttggtacctaaatatctgttgaatgaaaaatgagaatgatgtgtgttggatcgcttgaatgtattcctctgtaagtggttgtagtcttgggaatggttgagaatgtccagaaaaaatggatacaattttgttgactgaggccgggcgtggtggttcacgcctgtaatcccagcaccttgggaggcccaggcgggtggattacctgaggtaggcagttcgagaccagcctgaccaacatggcaaaaccccctctctacccaaaacacaaaaattagccaggtgtggtggcaggcgtctgtaatcccagctacttgagaggctgaggcaggagaatcgcttgaacctggggaggcagaggttgcagtgagccgagatcacgccattgcactccagcctggatgacagagtgagactctctgtccccaccccaccaccccaccgccaaaaaaaaatgttgactgaaaggagaagtgactaggatcagaactctgggtaaaaatcagtaattgaacagagaaaaataacttgtgaataagattgaaagcacaattgcaaaatcatgggaaaatgagcaaatagtgtcacaaaagccaagtaggaagaatttcatgaaggaagcacttaaaaatgttgggaaaaactccccaatggttaacatttatagagcacttactctgaagtaggcactgggctgaatgttttacgtgtattatgtcctttaatccttacaataaatctatgtggtaggtgcctctgttacccgctttccacaagtaaggaaatggaggcttagataggtaaagcagccttccagtttcagctcaaaaggtaagcgcttggaagtcatcactccggttgctcctggagccataaactgcaagaaatatttgttaattttgacaaattggtggaggctgcgtgtggactgtcatgagagtgagaaactcctggaggcctgcagtcttaggcggtccctcacacttcctccggttttactcctaggaaccccacggggttattctggtgaagagccaagcaaggttggtttaacaggggaaggggaaagcaacgcttttgaaatatgctagtgcattcttcataaaaaggccaatttcagtggccgctagtctggtcttatctcaacggatggaaaaagctgaaaaacacttgtgaaggtcacagcccattgacacaggtccactaaaagactgagatttcatcgtaagttgatagaattctcctcacccatccctcaccaccacatcaacaggaatacaactcagaccaactgacagcggcttgcagctggaagacctacaaggtggagactctatttaaggacaagttcttagggaagcctgaagaggaatctggcacctacagctacagcaaacattaaacacagccctactcctagccagattggggtaaagcctcacactagtagctgattactatcatgtctggcttccaacaaaaaatgacaagacatgctaataggcaagaaaaacagcccgaagagacaaagcaagcatcagaaccagacttagatatatgataatgggtgttttgtaattatcaaggaatttaaagaactgtgattaatatgttaaaggttcaggccgggcttggtgacgcatgcctgtaatcccagcactttgggaggccaaggagggtgggtcacttgaggttaggagtgtgagaccagcctagccaacatggcaaaaccccatctctacaaaaagacaaaaattagccaggcgtggtggcgtgtgcctgtagtcccagctacttgtgaggctgaggcaggagaatcactcggaccctggagtccatagactcaatgtggctgaggaaagaatcattgagcttgaaggtatgtcactagaaactttccaaactgaattgcaaagagagaaaagaatgaaaaaacaacacccaagaaccatgggataatttaaaaggtgtgaaataacatgtaattgaatgccagaaggaaaagaaagaatagagcagaagaaatatttgaaaaaatgggctgagcgggcccagcactttgggaggctgaggcgggtggatcacctgaggtcaggagatcgagaccagcctggccaacatggtgaaaccctgtctgtactaaaaataaaaatacaaaaaattagccaggtgtggtggtgggtgcctgtaatcttagctacttgggagcctgaggcagaagaatttcttgaatccaggaggcagaggttgcaatgagctgatatcgcgccattgcaagagggtgagactccaatctcctagggaaaaaaaaagaagaaaatcatctggaaagcttgttaaaacatagattgttgggtctcaccctcagtaatctggagtgagggggtctggaaatttgcatttctaacaagttaccacaggatgagcatgctgttaagaaacattgatctaaaatttaaagtgaattttgccatttcagtgtatttccttctaggttttgtctaggcagatttgtattttgttttgttttacaaacttgagatgatattgaatatggttttatgtccagcttttttcacttactattagaaacattttttcatgtcacaagtatttcttaaagacatataaaggagttgcattcattatattaggttggtgcaaaagtaattgtggtttttgctattaaaagtaatcgggcctggcgtggtagctcacacctgtaattccagcactttgggaggctgaggtgggcggaccacttgaggtcaggagtttgagaccagcctggccatcatggtgaaaccctgtctctactaaaaatacaaaaattagccagttgtggtggcgcatgcttgtaatcccagctactcgggaggccgaggcaggagaatcacttgtactcaggaggcggaggttgcagtgagccaaggtcatgccattgtactccagcctgggcagtagagcaagactctgtctcaaaaaaaaaaaaaaaaaaaagtaaccggaaataccgcaattacttttgcaccaacttaacctaacattaatacttatggtcactatgatttacttaaggtttgtctaactgttagatatttaaattgtttaaaaatgttctgttgtaaatgttcttatacaaggattttttttttgacccagctttgatcctcatcctctacccactttggaaaaatttcttttttttctggagagacagggtttctctctgtcatccaggctggagtgcagtggcccaatcttagctcactgcagcctcaaactcctgtgctcaagcggtcctcccacctcagactcctgagtagctgggactacaggtgtatgccaccgtacctggctaatttttttggggggggggaataattttgttgaatcccatctctggtgggtcttcctagttacagaggataacccaatttcccaattctgtgagtaccttgtgatccttttgtattaattacattatttctctccaattttaaagaaatcaatcatagacccacatattgccattcagagcttatgatcaggataaaatacagatttgcttattgtctctctatcctgttacagtggaaatgataggaaactagatattttgtttcttttgttactaaatccctggatttagaaaatgtgtaggatatagtaatcactgtaaatatttgttgcaagaatgcaggaaccaggagtagcacattgatggcaccttgcatcttcttattaagagtaaatgtatttttctgtgaatccttttaaaatactgaaaataggctatgtgtggtggctcacacctgtaatcccagcactttgggaaattgaggcaggtggatcacctgaggtcaggagttcgagaccagcctggccaacacagagaaaccctgtctctactaaaagtataaaaatgagccaggtgtggtggcacacgcctgtagtcccagctactcgggaggctgaggcaggagaatcgcttgaacctgggaggtggaggttgcggtgagccgagatcatgccactacactccagcctgggcgacagagcaagactctgtcaaaaaacacccccccttcaaaaaaaaaaaaaaactccctcaatttcctgacacatacgtgtttatctgtacttactggctccttacaaaaacctcttacctggtttacttgttttcatttattatgctgtaaatctggttattggttaatgaattctctacctaaaatccttaatgtcttcccattacccttaggatagtctgaattctaacaaaacagacaaggatgtcttctgtctccagggttttttttttttttttttttttctgattacatgtgtggtatcaccattcacgcattctacacttcattatacgcttcatcatagagagcaatttctttgttgttcctgtaatgaaagtgctagcctgcgcacatattgtttccttatcccagacttcatttagtaaatagcattgcttagtggttaagaacatgaagtctgtagttaatccttatgggctcaaattctggctttgccactttagagctggataactttaggcaaggtacttaggtgttctaatttcttcacatgtcaaatgaggagcatagcagagcctgtcccatgtggtggtaaaggatgttgtggagaacttcacatgccgtaagagctctagaaatgttatgagtccttacttaccgtgttaggcctggtgctagatgttggggaataaaacagatttgggccctgtcctcttagatattgctgtagaggagagaaccattaaagagttacataattattgggccaggtgtggtggcacacacctgtaatcccaatactttgggaggccaaggtgggcagatcactcgaggccaggagttcaagaccagcctggctaatgtggtgaaacccccgtctctactaaaatacaaaaattagccaggcatggtggcacacacctgtaatctgagctacttgggaggcggaggcatgagaattgcttgaacccgggaggcagaggttgcagtgagccgagatcgtgccactgaactccagcctgggcaacagagggagactccatctcaaaaaaaaaaaaaatacataattgttataagcagttcaaaaaagttcagggttccacaaaagggacatctgatttaaatttttcttttttctttcttttatttttttttcagacagagtttcactcttgttgcccaggctgaagtacagtggcatgatctcagctcaccacaacctccacctcccaggttcaagtgattcttatgcctcagcctcccgagtagctgggattacaggcgtgtgccaccatgcctggctaattttatatttttagtagagacggggtttctccatgttggtcaggctggtcttgaactcctgacctcaggtgacccgcccacctcggcctcccaaagtgctgggattacaggcatgagccaccatgcctggtctgatttaaatttttcttacttcagtggctttgaatgtgacatttcctctaccaaaaactactactagtaacagatggaactgcgaatttacaagcctgaagtaagaaaggagcatagcttattagaggagttgcacgaggctccattgtggctggaatggagacatgaaggtgggaagaatggtgtgaaatgaagtttgaaagtaggcagaggccaggtctttgtgaagaccaggtcagggaggctgacttctatacaagagcaagagggagccattggagctttttaaacagggaaatgatacaattcattatgtttttaagaggtcacttggccagatgtgatggcacgagcctggagtcccagctacttgggaggctgaggtgggaggattgcttgagcctagaagttcgaggatgcagtgagctatgatcacacctgtgaatagccactgcactccagcctgggtaacatagtgagaccctgtctcaaaaaaaaaaaaaaaaaagatcacttgcttgcactgtggaagggtggagcacggcaagagcagataatgatggtggtgtcttggattagacagcagcggaggaaatggcagagaaggtttgagagtcaagagagtctaaacgtttttgtgactggatgtggggactggaggagacagggatgaatgaacacctttcagtccaacttctgactcttgcttctcatctttatctaaggtccatcctcaagtctgaggtgggtgccactcttgtgcctccgtagggctgtctgtgtatgtcactaagttttagcactgatctgttgtgatttactatagctggtctgttttccttttaagttagaatgtatttatagtagatggtagctgatcaacaaacatttcataaatgaaagcacagattaacataaaagtagatgatgattgagtacagtatttctttctttttttttttttgagatggagtcttgctctgtcgctctggctggagtgcaatggcgcgttctcagctcactacaacctccacctcccgggttcaagcaattctcattcctccgccttccgagtagctgagattacaggcgtgcatcaccacacctggctaatttttttttgtatttttagtagacatggggtttcaccatgttggccaggctggtttcgaactcctgacctcaagtgatccgcccacctcagcctgccaaagtgctgggattacaggtgtgagccacagctacggtatttcattttaagcctagtgttttggtggtatattgtctttggatcaagttgtttatgaaaaaagaattctcaaagaactattcctaccacctctctcccctgacccccccagccaaaggccaagaattggattcttgatttttttttttttgacagcatatgtctggaatatgtattggtattaattgggtcaaatagaacaataacattatctgtactttcagttaattaaccttgagggcatttctttaccttcttttttgtatgctttaaacagttcccatggtaagtattcctcttggggcttattattttatcttaatttctgtaggtgggattttgagtatctaattagatatttaaatatgtaaacagacatctccatgttagaaaaaactcagctgcactatttgtttaaaaaacttctcttatatccttaggtgatttgacttgtgttttgttatgactgctcctttgtatttattatcattaatttgttctttcgaaattaagtttaactttttttgttgtttttctcctatggtttagattttaacttagtgcaatatgtagttttttagtctttgcagcatttccattgatggaaaacaaatacagtgtgaaattgttggctttcatatacccaatatggaattaaagtgaaaagggaactatttaatttattatttttttaaatgagatcgggtcccactatgttgcctaggctggccttgaactcttgggctcaagcgatcctcccgccttagcctcctgggtagctagagaattattatataatggtataacttgcctcaactgggatttttatcaattaagtggcattttgttattatattgacatactaatttagttatatttattttataataagcaacactgctgtttatattttgtggcctattagagtaggaacaactaaaaataaggtaaataatatatttttaaaggagcatgaaataaaaaattttatttaatatttaggaaagatgatatgcgtatccaacccattgcaaaaattatagtaattgctagttccaaaatattgttagtgaaatgtcatcagattcctataaggcttatatcttcatgaaaagtaatgctaataacactgagtgtgacattagacctttgcctgttttctctctttccatatatgcttcctgtgaatgactaatagaaaacttattttctctcaaccaaatctgtgtaacttactttcctgagatactaggcaacttccctacgttacaaaaaattagtaatgataatgggtaactttgattgaatattcctatagttcaggtggtaaccctcaaaacaaccttgtcagctagatactcgatattgtgcttttcacagatgagaaaaactgaatatttgagcagttatttatcctaaagattacagagctatgtacgtatgaatatgtaagaatatgatctttaaaccaggtggtctggttctagagtctgtgatcttaaccatgacactgtattgcaacctagaaatggtggcaaaatttgttcaaagtacaatgttaataaagtaattttgatttatttagttattatttatttattttttgtagagacaaggacccactttgttgtccaggctggtcttgaattcctgggcacaagcgattctcccaccttggcctcccgaagtgttgggattacaggcatgagtcaccacaccaggccaataaagtaattttaaaaattaactaaagtccatactttactcagattttcttaatttttacctaatgtccttttctgctccggagtcccatcaaggacaccaggttaccatttagttgctatggctccttcggctcctcttggctgtgatcgtttctcaggttttccttgtctttaatgacctccttgacagttttcagaatgggtcagaatgcccctctattagaatttgatgtttgtgtcctgattagactggtggaatgggattttaggagggagaccacagagttaaagtaccattttcatcacatgacatcaaggttatgtactattaatatcaatacaattgatcactgttgatgttagcctcgatcgcctggctgaggtagtgtttgtctggtttctccactgtggtaactctgtctccccattccgtagtctttggaaggaagtcatatgtgcagcccacactcaaggagtatggagttatgcttccctccttgagggcagagaatctacatgaattatttgaaattcttctgaacagaagatttgtatcttttctcctatatatttatttacagtttcctctattcatggtttggctttccgtggttttagttaactaaggtcaaccaagatctgaaaatattaaatggaaaattccagaaataaaccattcattttaaattgcatgctattttgagtatcatgacgaaatctctctctgtcctaccaggatgtgaatcatcgctttgtccagtttatccacattgtatatgctacctgtctttaatcattgacatcttctgcttctgacatttaaccatgaacattgtcatggctcgggatgacccgggatctcccaaggcaggtgctcttccttttggtgtatcatcaggtcaacagtagcctgacactgcatcatggtgctctgtgtcattcacctcacttcatctcatcacgtgggcattttatcgtctcacatatgacaagacgcatgagtacagtacaataagatattttgagagaggccattcatatagcttccattacagtatgttgttatgattattctattttattattggttactgttgttaatttcttaatgtgcttaatttatcacaggcatgtatgaataggggaaaacatagtatatatagggcttggtgttatctgaggttttaggcacccactgcaggtcttgggacttatccctcgtggataaggggagactactgcacttgatcattcattcctgtcagtatggacacattggatgtttattttatactttgggttatgagccagtactactttattcattttgttgctcaaattgtttcagctttggccattggaagctcttttcgctggctcctatgtcactatgacatagccccatcaaggtgtggtgtttttggggggttttattgagacagtgtcttgctctgttgcccaggctggaatctcgatttactgcaacctccgcctcccaggctcaagcagtcttcccacctcagccttcctagcagctgggactacaggcatgagccactgcgcctggcctaatgtgggtggtgtttttttttttgtacttctactactactactactactgctaggatctagttctactcagtacttctggcaccaaatgtgtgggttttccacaccaaacaattctccagttccctgtggacaccaactgggagtcctacaattcaactcaatttaataccaactacccagagttactacagatcccacaggttaaggatttggtcccacaagaccattccctaggaaagtaggctaactgctgattaaaggtagtggatccttaagttactcacacttcagttagatgtggctacaaattgggggtttccataacccccttcttagttccataatttgctataaaggttcacagaactcaaggaaacactttgtttaacatttactggtttatcataaaggatgcaaatgaagaaacagatggagtgacataaagggtgcggtgagctctgccaggtaccccagctgaggagcttctgttctgtggagttgggtgcactattctcccggcatgtggatgtgcttgccattccagagctcttggaacccctttgtttagggtttttgtgggggttccattatgtaggcatggttggttcgatcactggccattcgagattcgctcaatccccagcctcttccctctctggaggtcacagggtggggtcaggtttggggaatgagtcagaatttttggcagataatttctattttgtattagctttctggattattctgattccattattgtaacttgtttactatggtccagctttatgccctttgtatacattatgacttttaatcctcgtaacagccctgtgaggtagagaaatagagcagtaggagtcagggcctgtttggtcagcattttgctattaccacctttttaaacttttataggagtggctctgaatctctagaaagtcatgtaaagatcttgatatttatttaaaatcataaacaaatattcacaaggaaactttttttcttgacattcagtatgttttaagtaattttcatgtggttcgagccttgtaaaggtttttctggttttcatagtgtagaaagtaaagaaagctgttacaattgactgtctggactgatttattcaagagaaaatcacttggtttatagaaggcctttaacattttgtgagtatgtgttttaaaccaaaacccatagataggaagagccgacagggagctggaaactgcaataagctttcttctaactagcaaacgcagttgacagacatctttttatagacgtatctgtgattgcacgctgtttttaggcttgataattttttcaacaaggaaaaacttttcttcaatttgaaaaagctgtttacagtaaaatggcaaagtatgagaagacagaaagccatcctgctcattctaaagctaaattgggccacatttcccttaaagtatagacaacagcagcagtggaacacagttaagtgtgtgtttagtgaaggaaagttttttgaatactgccgccacaataatttttcaaaccttgaattctttattgagaaagtgacaaatcagtgagagagggaaagggaaaagaaaattaattgaatttgcaaaatttcttaaacaactaggattacagaagtaaaagaatgaatttgaaggctgggcgcagtggctcactcctataatcccagcattttgggaggctcaggcgggcagattacaggaggccaggagtttgagaccagcttggccaacatgctgaaaccctgtctctactaaaaatacaaaaaattagctaggcatggtggtacccatctgtaatcccagctactctggaggctgaggctggagaatcacttgaacctgggaggcgaaggttgcagtgagccgagattgtgccactgcaccgcagcctgggcaacagagtgagactgtgtctcaaaaaaagcccccaaaaaaacaaaaaacaaaaagaatgaatttgacgtagtgcctgtgtcagttagctattgctctgtaaccaattactcccaaatctagcagctaaaacccacaaatatttattatctctcataatttctggctgtagctttactgggtgattgtgcctaagggtctctcatagtctggggctcactcacatgacttttggcaggaagccttggttccttattggttgttggctggaggcctcagtttcttgacacatgagactctctataggccacttgactgtacatgcaacattgcatctggtatcccatagagtgagtcattcaagagacagaaagagatgacacagaagccacaatatcttttataacataatctcagaagtaaccaaacattacttttgctctattctattggtgacataaactaaccctatataatatcagtggtgactgcgcagtggtataaatagcaagaggtgagggtcatcgggaaccatctcagaggctggctaccacagtctgccttctggcctccagtgattcacgtttctcgcacatgtagaatgcactcactctctccaaaggcccactagaatgggccttccgtcccattacagccattacagcatcagctcaaagtccagaatatcatatctaaatcaagcccaggtggtaatgaggttccttggctgtagctacttatgtatgacttcttgagtggtttctcttgatctatagacctgtgaactagagagatgttacttgccccttaccactcaacatacaatgggaaaaggtaacatccacagacacttctatcaaaaaagaggatgtcttcgtgtatttgtgctgctgtaacaggataccacagactaggtaacttatgaagaacataaatttatttctcacatttctggaggctggaaagtccgagattgagggtctgcatctggtgagggccttcttgctgcatcataacatggtagaaggcatcatatggggatggggaaggaggctgaactcattcttgttaaggaacccactcctgctataacatacgtgctcctaagataacagcattaatccattcatgagggcagagccctcgtggcctaatcacctcttaagcttccacctcccaaaacttgcatgggggtttcagtttccaacacacgaactttggggatacattttttttttggtatactttttggtattcctccatagtaaggaggaaatgggaggaacacaggagtcgtggttcataaaactgagcctggcaagtattggacatttattgattaggactcagtcttactgtccagaagtgattctaggtggcctttagctctgtcccctgagctcttggttagactctttgtcatcttttcttttacgagaagtagtacatgtttacagctaagcagttttctaagcctgattcctgtcaatagaagttttgggagtccaaagaacgtttttccttttgtaatctctttgtcatttttagttcaggcttaaggtgtttctgcaaatagcttccttttaaaatttttcataggtctcccacgaatcttattgtccattagacaaaagccatatacacaaatttgtttgagataagctgttctctgtctttggctcctactaagatagctaagagacattaaacttctttttttattttttttcttagatggagtcttgctctgttacccaggctggagtgcagtggcacaatctcggctcattgtaacctccgcctcctgggctcaagtgagtctcctgcctcagcctcccaagtagctgggtctataggtgcatgccaccatgcctggctaatttttgtatttttagtagtgatggggtttcaccatattggccaggctggtctcaaactcctgacctcgtgatctgccggcctcagcctcccaaagtgctgggattacaggtgtgagcccctgcgcctgggacattaaacttctttttaaaccctgttgtttgagtgaaaggatctgtaagactcaccctcaaactttctagagattctttgctagtctgaatgttgccttgatgcaccacatttggtaattctgaagtcttaagaaaggactgtagaaccatatactgtattatgttttcctggcagtgccctaaatttgatctttaagaagccacttcttagtgttttcttgccatctggagatctagggaattttcacaactagcaattcctggctccttgttgtttaacaggctttcctttaggttatctctcctcttgtattttattttttgtttgtttgtttaaaagagacaggttctcggccgggcgcggtggctcacacctgtcatccccacactttgggaggccaaggcgggcagatcatgaaatcaggagatccagaccatcctggccaacatggcgaaaccccgtctctactaaaaatacaaaaattagccgggcgtggtggcaggcgcctgtaaccccagctacttgggaggctaagtcaggagaatcgcttgaatccgggaggtggaggttgcagtgagccgagattgtgccactgcactccagcctgagtgacaagagcaagactccatctcaaaaaaaaaaaagagggacaggttctcactctatcccccaggctggattgcagtggtgcgatcatagctcactgtaaccttgaactccttgggctcaagcgattttcccacctcaccttcccgagtagcaagaactacaggtatgtgccactgtgcctcactatttttaaatttttttgtagagatgaggtctctctgtgttgctcaggctggccttaagtgattgtgatcctaccacctcagtctcccaaagtgtggatgacaggcatgagacaccgagcccacccatctcttgtattttattatgcgcaactggaaggaaccaggaagcaccttcagtgcttttcctggaaatccccttatctagattacccagtttattttctactttccatgttgatacaggtgacaatgttgcaaaatttctgctattgcataaaaaggatctctctttgcagtttccaatgtgattttcctcactttcccttaagctctaacctagagcctacggaagggccagtactgcttggctgcaaagcctctcccacatttttaggcatgtgttacgccagctccccgttttcccgtaccatacctctagatgttatctagtactattacctattagtcatctattttgtggtaacaaattacccccaaaacttagtggcttaagacaataaacatttattttttcacacagtttcttagggtcaggaatctagaagttgtttaattgggtggttctggctccgagtctctcatgaggttgtagtcaagatgttggctggggctgccgtaatctgatggattggttgggcagagactctgctttcctggggtttcccataggctgcttgagtgctgcttgagtggggttacccataggcagctggtttcccgcaggactcgtgataagaggggtgtgggggggccaacatgaaaatctagtatgaaagtgatgtgctgttacttctgccatattctgttggtcccatgggtcagccctggtgtattgtgaaaggggactgcacgaatgtgtgaaagccaggaggcgggaatcactggaagccatatggacgttaccaggaggcaggaatcactggaagctatctggacgttgtcttctacaaccctgtcttgaagaatttcgtagcctactgggcacgagtgcctacatgttctaagcattgtgttagactgtcacatgttgttgatttggcatttacaatccagaaaggaactgctacccccagttgaagtttaaagagatcaagtaacttgttcacgacagattcgaatctagcctgggaataaacgcttggagcctaggccttaggtaaaggagtggataaatattctatagcatcattgcctttgtatttaaatatgaattttcttcattatacttatgtttagcagcagccatttaatgtctattttatatgtggacacctctgctcaactgttttttcttgtattcccttctccatgcagtcaccccttggcatgtggcggggataggctccaggacctcctgtggataccaaaatccacggatgctgaagtcccttacataaaatggcagaatatttgcatataacctatgcacatcttcttgtatacttcaaatcatctctagatcagttataatacctaatacaatgtaaatgctgtataaatagtttttatactgtattgtttagggaataatgataaggaaaaaagactgtacatgttcagtacagatgcagttttttccccaaatattttcaatatacagttgaatccatgggtgtacagagggctgattgtgtagctctgacctttttattttttttaacctatcctatctcgttcttctactgactttccttccaacactttccatagagtcctttggagcgtcagacttactctaacgtgaataaacttctttacaaatactctttttatagactacccctctcatctctgtcttaactaaatcctggctttcctgctagaatgccactcttcggggaccatcttgaatgaaagctgttcattcttccataccattttgtcttcaagccagtaagctgaatcagtctacttccaattccaaatcattgttctttcaccctcatgtaaaaattcttcttcctttgaaattcgtgccatctttttttttttttttttggtttatttttattttttgagacggagtttcgctcttgttgcccaggctggagtgcaatggtgtgatctcggctcaccacaacctctgcctcctgggttcaagcaattctcctgcctcagcctcctgactagctgggattacaggcgccctccacgacacccagctaattttttgtatttttagtagaaacgaggtttcaccatgttggccaggctgattttgacttcttgacctcaggtgatccgcccacctcggcctcccaaagtgctggggttacaggtgtgagccactgtgtctggccctgaaattcgtgtcatcttaatcattttctgtcattctttgtcactgtcatttattagtctgcctgtagcttatcccttgtttatcaaagactttggcactcttttctcagttttctgtccatctcttccactatcattctgggtggcttcagtagccaggtggactaccatgcaacatgctagtttcatcatccttgttcttttcaactccagtgaccttcacttccacttctttccaacattttactatcatgacttttagactgtaagacactctgaaatcttgactccttcattctattgactgaccaccatctcctaatttccagaggtactctgctcccttacatatatatttattttatttttcttttttcttttgagaccaggtcttgctttgttctccaggctggagtacagtgatgcgatcacagctcactgcagcctcgaatggctgggctcaagcaatcatcccacctcagcctcctgagtagctgggactataggtgtgcaccactgcatttggctaattttaaaattttatttttagtagagatgaggtcttgctatgttgcccgggctggtcttgaactgagctcaagcaatccttccaccttggcctcctgaagtgctgggattccaggcgtgagccactgcgcccagctcccttacatatataataccggtgttggatcttaccaagatgtctaggctgacccccttcccccaattggcttatcagtcaaacaaatggctaatatcaaacgattctggctaatgaagtagaaaaggaatttattagaagatagtaggtagctcacaaaatcaacagggaagctggagaaccagcttggaaaatgggcaggaagcaaagaggcccagcagcatataccccagctaatgccatggcactaggacagtggttaatgtgctgttgctcctacattcttgctgttatttcttctgccattcccataaataattttaatactgtctctccatttttatattacctgcttaggattcaaaatcttgcacaagaacatctgattggctgagtataggtcacatgcctattcctttgctaccagggagctgggagaggaaagatctgccttctttggcttacttagtgagaaggtagacacttttctgccaatattatacataataggattccctcaaaagacaacgaatgtttggatcctgggtcaaaaaaaaaaaaaaaaaaaaaaaagaaagaaaaggagaggaaggggaggggaagaatagaaggaggagaaaaaggaggaagtggaggaggaggcagcaatattgacaaatgtctactttagcccactactggcttgggaatggggagaagtctgcctttaagcctcctgaaaaaaaaaaaaagcctcctgatccaactttaacctccaaattctcactagatgatcttgcttcttatttcaaaaataggagccattaggcctggaatcccttcacttgttgcctctgtctttaaatgtacctaatcaacattgtcttttcctgtttccctttagctatcttagtagaagagctcttccttctcttgttcaaggctaatttttccatttatattcatgatgtcatccacacttgtcttctccaggacccctcatcattaattaagccttccttcttagttaagattatttattaatattccttttttgtcagacattgctgaatacaggagatataaagatgaatttgatatagctttgaagtatttattatttagtgggaaaaagacagacacaaataattgctgtgcaataatttaatcatgattgtaattatagtagttccttactttatccatggggaatactacaccaagacccccagtggatgcctgaaacaatggatagtactgaaccctatatataccatggtttttcctatacatacatacccatgataaagtttttttgtttttttgttttgtttgttttttgaggcggagtcttgctgtgtcacccaggctggagtgcagtggtgcaatcttggatctccgcccactgcaacctctgcctcccgggttcaagcaattctcctccctcagcctcctgagtagctgggactacaggcatgtgccaccacactcagctaatttttgtatttttagtagacatggggtttcaccatgttggccaggctggtcttgaactcttgacctcaggtgatccacctgcctcagcctcccagggtgctgggattacaggcgtgagccaccacacccggccaataaagtttaatttttaaatgaggcacagcaagagctgaatactaataactaatgataaaatagattagttttaacaatatactgtaataaaagttatgtgactggtctctctctcaaaatatcttattgtactgtactcacccttcttgtgatgaagaagggatggagtggaatgacgtgagatttcatcatactgctcaactgcgtgcaacttaaaacttaagaattgtttatttctggaattttccatttaatatatttggaccacggttgagtgtgctaactgaaactgtggaaagtgaaactgtggacaaagggagactgctgcatttgtgtaatttgtttgatacatgattttctattagaatgtgtcttcagtggccaggcacggtggttcaagcctgtaatcccagcactttgggagccaaggcaggcagatcatgaggtcaggagattgaaactatcccagctaacacggtgaaaccccgtctctactaaaaatacaaaaaaattagctgggcatggttgcaggtgtctatagtcccagctactctggaggctgaggcaggagaatggcgtgaaccctggaggcggagcttgctgtgaccacagattgtgccactgcattctagtctgggcaacagagcgagactccatctcaaaaaaaaaaaaaaatgtgtcttcagtgtctaatacctaagaggtgctcaataaatattattgaatgaatgaagaggggtaagcacagggtactgtggaatcatagaggataggtacttggccctcccctaggagggaaggaagattgggcttatgtcagtggaggcttggtggaggagactgcagcagccagcaggggaaaaaaaatcaggggaaagtaccaggcagagagaggggcatgaacaaaagttgagaatggtgaggaggtggagatggtttgaacagttaggtgttaaatagagttattaacagttaacatctattgagtttacatacatacatagtatatgtttatgtatacttgttaagtactttacatatattttctcatttaatacttacagtattctttgattaaggtattattcccattttagaatagaaaaatctctgcaatacgtagggaaaatagttaacttgcccaagaccatttagcctataaaggatcaaggagggatttgttttggggtctttctggatgcaaaacctggtgctctttataaatgccatgttatactaatacagtgtggttcccaaacttggtggctcatcagagtcccctgaggacctttgtaaaaatacaaattcctggccataccccagacctgttgagtcagagtttccaggggcagagcttatagatctatatttttgggtggttcacatgtaactggcctgggactggttctctcaccctggggagttattgcaggtggtgtcaagagcaaggcaggaatagctgactagccagggaggttttcctgtgtcttgctcctgatccttgactttaccccgtagatggtggggcactgaagctgagaagtgtcatcagatacacatattgtgcccaccactttagcaacagtgtgaaggatgaagttgaaggcacaggttacaggcaataagaacttacatctttagactgctgtcttgactgagttcgtcctttttcctcacattctcaagttttctaaattttttttctcttggttctgccaacccttcagttctcttttccctagctaatttcttgaaagaaatagttatactcaatgttaggtttcagtcagttcaagaaatgttccttactgacttactcttctttgaggtcatcttccatcaataaatgtttattgaatgttatttgaaagcatggtcctttctcagattttgctttgaagtgaaaataccagggatgatttattttttcatcacgtaatcactcatatgacaatttttattgatcaccaagtactcttcatgtgtctcctttatgctagggcctgggatacaacagtgatgagataaggcctcggactttactgatcgaacatctaatggaaggtggaagaagagaccatcacacaatgacggtgttatggggaacacagggtacagtgcattcatacctcctccccatcactgtgtcaatcgcttaaccatctctctgcctccagccttgcttccttccagttaagttatcctcattgattatacatctagccagatactccctactctataaatcttcatttgatagctattgtccttaaaataaaatccaaactccttcaatgtgtcttactaaaaaaacttgagcctatccccaccttgcgtactctcattctgtttcattatagggaagttaaggagcaagaatttgaacttttccttatgtttctttagtttcttttctttctttccaacatgttcttgttctgttgcccgagctgaagtacagtggtgtgatctcggctcactttgacttcccaggctcaagccatcctcctgcctcagtttcctgagtagctgggactacaggtgcacaccagcacgcccagctaatttttgtgtttttttgtagagatagggttttgccatgttgctcaggccttagtttcttttctggaagatttttttttttttttagtattttgaattatttttaagtaagagaaaaaaaaatcaaccttgttaatataaagggtaatcacttaaaaagcacacctaagaattagtatctcaaattgttgtgtagccgccaccaccatccaacttcagaacctttttgtcaccccaaactaaagctctgtgcccattaatcaataacttcacatctccccctcctggaaactaccgttctgctttctgccttaatgagtttgagcactctaggtacttcagataagtggagtcatacaataatttgtcttgtgtctgacttatttcacttagtataatgtcttcaaggttcatctaccctataagaatgtgtcagaatttccttccttttcaaggctaagtaatataccattgtatgtgtatgccgcattttgtttatccatctgttgatggacatttgggctgtttccaccttctgtctattgtgaataatgctactgtgaacactggtgtgtaagtatctgttcgagttcccacttacaatacttttagttatttactcagaagtggaattgctagatcatatggtaatttgatgtgtaactttatgaggaactacgatactggtttccaaagaagatactattattatcaccatgtggcaagtggggagacttgggcacagagaggttaagtaacttgcccaaggtctcacagctagtacatggtaaagccaatggtggctggctccaggtcagtgctcttaaccagcaatatatacatacttactggcctcttttgtaatctctgttataattatgttttcctatttggggaagattgacatcatttggaggttttttttgagatggggttttgctctgttgagcaggctagggtgcagtggtggaattatggcttactgcagccttgacctcctgggctcaagtgatccttccacctcagcctcccaagtggctgggactacaggcatgtgccaccatgcccagctaaatttaaattttagaattttaacttttttgtagagacaggatctcactatgttgcccaggctagtcttgaactcctggcctcaagcaatcctcccccctcagcctcccaaaatgctgggattacaggtgtgaactaccgcctgttttgttttgtttttagaggcagggtctccctatgttgtcaggctagacttgaactcctgggcccaagctattagcttgctgagtagctgggacaataggcatgtgccaccttcgagttttgagaattggactaaatcaaacaatattttactcgtagagtatttccttcttggattgatttttttgtttgtttgtttctgagatggggtcttactgtgtggccctggctagtctcaaactcctgggcttaagtgatcctcctgccttagcctctggagcagctgggactataggtgtgagccatggtacccagctttggattgattttttttttacatgacaaaattgttatagttctcactcttaaatattttttagaatagttctagatgagtatacaggaaactctttaggaatttgtattctacaaaacaaaatgaaaaacaaaagtatactgacacagtgtatcagtaacaaatagcctgactctcaaagtactctcattacaaaacttagaatgatactttttttttttttttaaaggtggtatgttacccagtctcaaactcctgggctcaagtgatcttcccacctcagcctcctgagtagcggggactataggcatgtaccaccacactcagtgaattatatgttttaaaaggatattttgtatattggccatttctctaacatttcccaaaactgcatgcttttggcatctgtgctataaacttagaccaaagtagcttcagaaatacagtagaagctccccttaacgtgtgtgccagattaacataaaacagacatttcctttctaagacatgcttattctaagggcacgcagaataccttttgccattcattaagtatgatgttagttgtgagtttttcataaataccttttatcctgatgaggaagttcacttctattcctagttttcttttaaacaataaccttaagaagtattttttaattgacacataataattgtacatatttatggagcacagtgtgacattttgatatgtacacataatgtgctatgatcaaatcactattcctagttttccgagtgtttttataatgaaaagatgttatgtattgtcaaatacttgttctgtgtctattgagatgacatggtttttttgctcctcttcgttctattaatgtggtgtattatggtgattggttttcatatgttcattctcgggagaaatcccatttggtcatagtggataatcccccataaagtggctggattatgttttcaagtgttttgttgaggattttgcatttatatttataatggatgttggtttgtagttttcttcttatgtctcagttttgttttttttttaaatcatgttaatactggccttatagaatgagttgggcagtgcttccgtctcttcaatttttgggaagattttgtgaaggattggtagattggtattaatttttttttttttagacggagcctcactctgtcacccaggctggagtgtggtggtgtgatctcggctcactgtaacctctgcctcccaggttcaagtttttctcatgcctcagcctcctgagtagctgggattacaggcgcacaccaccacacctggctaatttttgttagagacgggatttcaacgtgttggtcaggctggccttgaactcctggccttgagtgatctgcctgcctcggcctcccaaagtgctgggattacaggcgtgagccactggcacccggccttattgagtttttagtaggtttacaggtactatcagagttattctcaaggtgtttacagtatggaaagtgagacaaataagtaaactgctaattataatatggtttgatagactattatgatagagatagcatgtatgctacatgattacataggagggtacttaacaaaaaagagaagggaagccttcaaaaggtcagttactcttaaacgtgagtgacgaatgggagatagccaggaaggaggagagcaatattccaggcaggagtgtccgtcacaaaggcggagggcaatattccaggcaggagtgtccatcacaaaggcactgggaaaaagcattatcactgggacactacagagacttcctgcctagtgcatctgtgtggaaaagtgtgaagagatcacatttttgagataggtaggagcctaagttcataaagggctttgtgcgcctggttaaggagtctgaatgttagtttgaaaggccttgcgaaccattggaggattttaaaccagacggtcaaattactaaatttgcattttagatcatcctagcaaaatgtggattatggtttgatgggtggaatgggaagtgagagaaaggagactaaaggcaaaaaggcaggaagtgactacattaatttagctggaagtgatgagtgtttatttatttatttatttatttttgagacagagtctcgctctgcctcccagcctggagtgcaatggtgcgatctccacttactgcaacctccacctcccatgttcaagtgatcctcctgcctcagcctgtgattacaggcgcatgccaccacacccagctaatttttttttgtatttttagtagaggtggggttttatcatgttggccaggctggtttcaaactcctgatgtcaagtgatccacccacctaggcctcccaaagtgctgggattgtagtctaatcgtaagcaatgacaatggaaatggaagggaaagaacagagttcagaagggtttataagtagatggccgggtgcactggctcacgcctgtaatcccagcactttgggaggctgagatgtgtggattgcttgagctcagaagtttgagaccagcctgggcagcatggcaaaaacctgtctctactaaaaacacaaaaattagctgggcatggtggcacaggcctgcagtcctagctacttggggagctaaggtgggaggatcgcttgaacccaggaggtggaggttgcagtgatctgggattgcgccagtgaattccagcctgggcaacagagcaagactctgtctcaaaaacaaacaaacaacaacaacaacaacaacaacaaaaaaccccagaaaggttgaaaggtgttgatgatcaaatagaattaggaagatgaatttgttagaatgagaaatttggaggactgtgatcagggaatcagtagaagatagcagtgagaaggaatagtagattatgtgtcctcaagtgatgaaccttaatagagtagtagtttttaatatgaagttgaaacaaggatgctcccagacaagtccaggttgtgggccattctgtatgatgctataaagcctggtctcttcaacaagctaatttcatgtgtgtggggaggggtggggaaggatggaggactgttttagtttcaaagagaacaaaataatatgtaacagccaaatgcagtacataatctttgattggattttagtatgaaaaaaatacctatgagacatttagggacagatggagacatttgaatatggaatagatattagatgatcttagtgaatttttgttaatttttaaagatgtcataatagcattgggattatgcaggagaatgtctttatttttaggagatatgctgaagtatttagggatgaattattctgatgtctgcaattgacttagagacagacagacatggaaagaggaatcaaaaaatggcaaaatattaacaatagtttaggcggtgggtatagagttgcttgtaacactaagctttcaacttttctgtgtgtttgaaaatttccttcattagagaagctggcaaaaaatatggcagattaggagtatggggctatgagtagcaatggggagctctctattgctaaccttccccaagtccctgagataggtaagccacgggagaatgagcagccagttctgaaagggacttcaagatgggtaatgactttggggtagtgcttctcagcttttatcactttaaaacctaaacattggccaggctcagtggctcacgtgtgtaatcccaggactttgagaggccaacgtgggaggattgcttgaggccaggagttcaaaaccagcctggtcagcacagagtgaccttgtctctacaaatgaaaacaaaaattaaaaaaaattagccaggcatggtggtctgtgcctgtagttccagctactcaggtggctgaggcgggaggattgcgtgagcctgggagtttgatgctacagtgagccatggtctcaccacagcacttcagcctgggacagagcacgactctgtctcaaaaacaaagaaacaaacaaaaaccctgagcatggaaaataatatttgtgtggcacacaatatctggtaaaactagatgagctttgggactctacatgaggcttgattattaaaaaaatcattatgttaaaaaattttgttatgtatttcattatgtaaaaaaatttataagaaaataaaacagagcattaggaaattttaaaatgatgacccttttttaaaagttccaaatgtatttaaaatgttaaaggtggaacttgagcttgcttcccaacgtgttactttttaatatcaaactttttgcttgaaatagttgtactcaattcctgattttaaaaaatctttaatatgagctcttcaatttttgatcatttactaccaatgagtaactgttcatgcagaaatgtaaaagcatttttcccaaccattaaaaaatcaaaatatgaactaggcccctacctatctcaaaaatgtgatctcttaacatgttctcacacttttttttttttttttttaaattttcagagcaagatccttcaggctgcagtgcagtggtgctatcatagctcactgcaaccttgaactcctgggcttaagggatcctcccatgtcagcctcccgagtagttgggactataagcatgtgccaccatgcctggctaattgctttttaaaaaattttgtgtgtgtgtgtatgtagaagtgaggtctcgctatgttgcttaggctggccccaaactcctgggctcaagcagtgcccccagcctggcctctcaaagtgctaggattagaggcatgagtcactgcacctggccctcgcacaaatttttgtagtttcccaaggattatgcttttctttttttttttttttttttttttttgagactgagtctcgctctgtcacccgggctggagtgcagtggcaccacctcagctcactgcaacctccacctcccaagttcaagtgattctcctgcctcagcctcctgagtagctgggattacaggctcgcaccaccacgcccggctaatttgtatttttagtagagacaggggtttcaccatgttggtcaggctggtctcgaactcctgaccttgtgatccgcctgcctcggcctcccaaagtgctgggattacaggcataagccactgtgcccggctggattgtgctttttcactgtgcctttgtcagtgatactcctgcctggaatatttcaaaccagttgaaattatatcatctaaaaacttctcctttaattaaccaatataacttggaaaattttctaataatccaaacgatttttttttttttttgagttggagtctcgctctgtcacccaggctggagtgcggtggcacgatctctgctcactgcaagctctgtctcctgggtttacaccattctcctgcctcagcctcccaagtagctgggactacaggcgcccgccatcatgcccggctaattttttgtacatttagtagagatggggtttcaccttgttagccaggatggtctcgatctcctgacctcctgatccaccctcctcggcctcccaaagtgctgggattacaggcgtgagccactgcgcccagccccccaaatgattttttaatccagttgaactgtctcatatcaattatttcaaagtaatgaagatttaatttatatatgatgcatgtgttttttgtttgtttgtttttgagatggagtctctctctgttgcccaggctggagtgcagtggcacaatcttggctcaggctcgctgcaacctctgcctcccaggttcaagtgattctcctgcctcagcttcctaagtagccgggactacaggcgtgcgccaccacgtccagctaattttggtatttttagtagagacagggtttcaccatgttggccaggctggtctcacacttctgacctcaagtgatctggccacctcggcctcccaaagtgctgggattacaagcatgagccaccgctcccgacctctcatgcatgtgtgtttagggccgcacaacaagcttggctgctactgaaaggacatatcagttacggaggcatggaagtagcccatagtatgtgaagataaagatttgggactgcttcctagagccatgagccctgtcagtttgaagtagttgcacactggaatgaacactatgctctttgggcacctggaacagaaacttctccaggagctctctactgggtaatggtgcattctgtatctggcctctgaaggagaagaccacatgatatgtcacacacttggcaatggggagcagtgggtgcctgatggcatttgttgtggttgtcgctgtgcagaacaggaggcctgccatcggagcctgtcgtgccctggtccccctgtgggaagctctggaatagactgctttctggggcctgacttcatctggccacactgagagatgagagataagaggatcagtattttggggtacccctttaatccatccactttacaggctgagtatccctttttctttcttttttttttttttttttgagacggagtctcactctgttgcccaggctggagtgcagtggtgcgatctcggctcactgcaagctctgccttccgggttcacgccattctcctgcctcagcctccccagtagctgggactacaggcacccgccaccacacctgggtaattttttgcatttttagtagagatgaggtttcaccgtgttagccaggatggtctcgatcttctaacctcttgatctgcctgcctcggcctcccaaagtgctgggattacaggtgtgagccaccgcgcccagccttgagtatccctttttcaaaatacttggtaccagaagtattttggatttctaatttttttggattttgaaatctttgcatatacataatgagatatcttgggaaagggattcaagtctaaacacgaaactcatttatgtttcatataaaccctatagacatagcctgaaggtaattttatgtagtattttaaataatttgtagatgaaacaaagtttctctacatagaaccatcagaaagcaaaaatatcactatgtcagccacccatgaggacaagctggttgtttggcatcagcatcattcctgaccctaaattgataggaattgatattgataagcaatcatcttcttacatttattcacacggaagtacttaccagtaaaaaatatgaagtaccattcatgaagtgaaaaaataatgtgttcaaggtaatgaagcagcacagtggcatcaccagaatacctgtgtcagctgttagcaacagcaaacaccggactttcagtctctgcctgcaatgctgtgttttgattagaaggttactgtatactgtacaggttgagtgacccttatctgaaatgcctgggacctccaaatgttttggttttggagcattttggatttagcattttcagattagggatggttaacttgtattgcaatgtccagtgggtaaggattcctgagttagggtagtcctagatttcagttaaggcattaattattcctgatagatgataatttgaaaaaagagactcgatgatcaagtgactttgggaaatgctgtgttgaacaaagttaagtttcatgattgtagaacattccaaagactttaatatactaatacacactataaatgaccatatagaactacatataaatattatatataaaccataatattcagagttttccagacatttttgatcactgaagccttttattgagaagctctggctgggcgcagtggctcatgcctgtaatcccagcactttgggaggtcacgggaggtggatcacgaggtcaggagttcaagagaagcaccttgaggaatgagtgttaaacagaacacagtttagaaaatatattgataagaagttattaaaaattcatgccttgcaggctgtaaatgcactttaatcagagtgccatttgttttgttcaaatgttttaaattattggaatgcacactttttaaaatatgcaaataaagtttggaaactaaaaaataaagttagtgcctgttctttagagatggaaggataaaattataaattataagttttacctatttcaaaacaaaagtcagcattatacttattggtaaaagactagtgttctagattattaataataataattatatttttataaaatggattattatcactttatgcattaatgttgctttggtagtgctggccagtgccatgagtcatgacagagaaataagatacaataagaagataatacaaaaagtattattagaaaatataaaataatcaactgaaagattttaattaatacatttttcaggaaatatataatcaatagcaaaaattcaatttttacctcaaacacttgaaattacagggctcgaaaaaatatttcatcacaatatctacaaaacccataaaatactcaggcatcatcttcttggaggattgtgtgtgacttacatgacgaacctcaaaatatgtaatatttaatttagagatctataagggatatatatatctaaatatacacctcttagatgtgaaaactattctaaaatgttaattctcaatgtatagctgattgcaatagcaataaaactttcaatggtatttcatttggaatttctaaattgtatatggatttctgtatttcctttggaataataaattggtattgatgaacattcctaaaaagaggctaatagagtggcaataaataaaatgctatggtaatggcacaagactagaaatgcaaatcagaatagaattaacagaatggacaattgatagaattaatctcaatcacataaaagatgataatacacgataaagtgcaaggaatcaagcacctggtaaagtaggaaaagctaatctttcactttgaatcacatcaaaataaacttcagatgaattactcagtgtgttgtccagtgtcaaaaacaaaaaacaaagaacaaacaaacaaaccacagtaaatctatctgtaaattgttgaagaaaatagaattaagtatttgccagacctcgagaaaaagggtgatttttctttgtctctctcttgggcctttcaaaggataagtttctcaactttacagtatgagaagaaatctcaacagatgtgactacctaaaaataaaggataatgtacttttaaaatgaccttaaatttaaaaaccaaacatcagctttgtgcagtggcagtgtcgtaaccagagagattttcccaagatactgttatggctaataagaaccttgctagttcaactgtgttcaactcgttgaatttcagtgagataaggcaaatatacaaaggtgaattgggcaggattgttcaataaagaattgattattgattataataatgaaaaatcagaaactaaacatccacaattggagggttgattaaatacattttgataaagctctataatggaatatcaggcagtcactaaaaataataaggtaatgaatatttattgagaatgaaagatccaatttattgctgagtgagaaattagattagagaacaacattaaaagtagttaactctgggccgggcgcagaggctcacacctgtaatcccagcactttgggaggctgaggcagttggatcatttgaggtcaggagtttgagaccagtctgaccaatatggtgaaaccccgtctctactaaaaatacgaaagtgagcttggcggtagtggtgcacacctgtaatcccagctactccagagactgaggcaggaaaatctcttgagcctgggaggtggaggttgtggtgagtcgagatcatgccactgcactccagcctgggcgacatggcaagactccatctcaaaaaaaaaaaaaaaaaagacaaaaaaaaagaaaaaaagaaaagagtagttaactctgggtagaatttgaagtgattttaacttaaactttcatctgtgtctttttcctccagtaattgtgtatgattttgatcatcagaaaggaaatggagctgttttcattttagaaaaacaagttcaaacaactgacctggaaaattgtttgcagtaacttcgacatagggttaagtctttattattcaaacaggtcatgcaaattgtaaagaaataattgaagatcccagtagggttgagcagagaacatgaatagacaattcataacatagaaaacagagatggtaaacaaacatatggatcattattcagattcatttgtaatcaaagcagtgtaaatttaaataatgaggtaatatttatttgttgttaaattagcaaaagtttattgctgtgttataataaagaaaaaataatatcaataaattatggtgtattattttggtaccattaaaaatggaaggttgtgtaaattatgttgcaacctggaaaaatataacatttacgtgaagtaattaaggagttaagattttatactgtaagtactaacaggtgggatggggtggagtgaggtgaggtggggtggggtgtggggggagaagagcaggattgttcaaatgaggaagatctgagttcagtccagctctgccactcaataactctgtgatcttgggcaaggtgcttagcctctctgagctttggtttctttttttctctacggttgtaaaagtatatacagtacctgacgtagaacctggtgtatagtgtttattcagtacatatttgttgagtgagtgaatggtagttattcaatgccatatataaaagaatatgtatgaagaaagattggaagaaaatacagcaaaatgatgagtagttatgttagggggaagagaatttgactgattttaaaatttcctattttctactattgggtggtattatatttctaattgaaataattacctaaactcatgcctaatctctttctttctgggtgtcctactgtatttactgtttgatacattttgacacctttttcttttctttgagacaaggtctggttctgtcgccaggctggcgtgcagtagtgtgatcatggctcactgcagcctcgacctgctgacctcaagcaatcctcctgcctgggcctaccaaactgctataggcatgagctcccatgcttagcacaatttagagacttaattacattattgtcctttattctttcactcagccaaacaccttggagttggccttaacccttttctttctctctgcacctaacataaaatttatcagcaaatcttgttggctctgctctttagaatatatccagaatctgccgggcgcggtggctcacgcctgtaatcccagcactttgggaggctgaggcgggtggataatgaggttaggagatcgagaccatcctggccaacatggtgaaaccttgtctctactaaaaatacaaaaaattagctgggcatggtggtgtgcgcctgtagtcccagctactcaggaggcagaggcaagagaatcgcttgaacccgggaggtggaggttgcagtgagccgagatcaagccactgcactccaacctgggcaacagagagagactctgtctcaaaaaaaaaaaaaaaagaaagaaagaatatatccagaatgctgacatttctcaccaccttcactgctaccattctggcccacatctctcacctggagtattgcagaggcctcctgactggtctctctgcttccacccttttcataatagccaaagtgatcagcagaccgcatcactgtgctgcctggaaaaacccttcagcggcttctcatctcattcagagtaaaagccgaaatccttaaagtagcctacagggctttttttttttttttttttttttttgagatggagttttgttcttgttgcccaggctggagtgcaatggtgcaatggcgcaatctcggctcactgcaacctccgcctcccaggttcaagcaattctcctgcctcagcctcccaacttgctgggattacagttatgcgccaccatgcctggctaattttgtatttttagtagagacagggtttcaccctgttggccaggctggtctcaaactcctgacctcaggtgaaccaccctcctcggcctcccgaagtgctgggaatacaggtgtgagccaccgcacctagccaaggcctctttacaatcaccctcaaactcatacctttctgatcttatttcttactcttctgcacttactgttctctctgcctgaaaactctgcagttgttcataaggctggttccttcccctccttcaggtgtctgcccaagggtcgccttaccacagaggcaggcctctctaagaccaccgtatcaacccattctcccccacccacgcccagcactcctcgtgtccctaccctgtttattccttcctctatttctcacaccatttgccttactatgtattttatcgaatattacgagcttatatttctttcccaataaaagtagctctatggaggcaggaatttttttctattttgttccttgccataaccttagcacattgtaagtactaggtaactgtttactgaatatatatatgagtgtttcatatatgtaagtcatagtccaaaactagtttgaaagctttttgagtaaatgtcatgttggtttttatgcctttcttcccccaactccacaagcaaagaataaggcaaggtaggcagggaacactgttgataagcaaacagtatctgtttttattggtttcactgtgcctctcaggctacgactctacccaaaggacttgagatagagaggccgctgctggaaatattctgtcaccgtgattggagtggttgagtggttccatgagtatatgcgtatgtaaacacttaattaagctgtgtatttaagatcagtgcacctttaccatatgtatattttgcctcagaaaaaatgtttacaaatacagtgtatcctttgacatctccagaggaagttaaacatgctaaatgatacataaatataaggagagggttcttcatatgcttacttattaagattgctagtctggttattagaatttttgttttgaattcaaagctaaagtaaactaatttttatttactttgtcttttgcagagataatagtagcagaatttcacaaaaaaatcaaagaggcatttgaagtctttgaccatgagtcgaataatacagtggatgtgaggtgtggaaatatttttttttttgttacacttttaaattactgatacaagtcataagatacaagagagctattttctctttttacactgtaccttggatttattatgctcttttaagtatttattttccatgctccgtaaaaggtctttgctagctattgctttgataagtactgtttcttattcttcatactctggtagaaacaatatactgtattctcattgcctgttccaacctataattgtaaactctgtgactgagatgaactctattttagctttagtgcttggcacatagttggtactcaggaaatagtcgttgagtgaaggaacagcatttgctttgtaaaacacataaatatgtattataaggccacaaataggatattgcaaggaaacagtaatgcttatgcgatgacacactccccctgtaaaatagcaaaaagaacccaaacagaagaacataaaaaggcaagagaagacatgaatactggtaggtctgaaatggaggacacagcttgggactgaaacaaaacaaacaaaaaaccccttaagagaagagattagacgctaataagaattgtagggtttgtgccacacacatcaaagaaaagcaatgaagccaggcgtggtggctgacacctgtaatccaagtactttgggaggtcaaggtggacagatcacctaaggtcaggagttcaggaccagcctgaccaacatggtgaaactctgtctctactaaaaatacaaaaactagccgggcacgatggcaggcacctgtaatcccagctactttggaggctgaggcagaagaatcacttgtacccgggaggcagaggttgcagtgagctgagatcatgccactgcactccagcctgggcgacagagcgagactctgtctcaaaaaaaaaaaaaaaaaaaaaggcaatgaaaccatcctttcaggaggccgggctaaatgagggttatttgatgagattgcaatctcaagaccagaacctagtagagaggccagcaaagcagtgggaagtggtttgaaaatggttctggaaaggaactgtttgatgcttataaaccagtgccatcagagctgcagcaccatacagctccggtggctgtggtcacattgcattctgtgggaatgacattgtggaacaccaggccttcctgtgggtatcccagtaggaaatgagtgggcagggtgctggtggtggtggtagggttagggagggggtgcagcaggcagcccggcctgcaatttgaataactaactacatgaatgacaagtgccttgacctcagacctctccttgaagggttctcctcctgggggcgggggacagaggtattgttagagaagtcagggaaagtatggcattatgagagagagggaaaagagagaaaagaaaccagcatctgcttgaggcttgtcatctaacacactacgtgtagttgggtgccagaggcttcacgtggattacctcattttaatctttttatttatgggttaagggttggcatctccggtttccagagacaaggagaaggtaaatcgtttgctccatgtcacaccaggtttctctaacgccaagtctcttgctacactgtgggcatgccacactgcccacactcccactcctactctttagagacatcaggggcttctcttctgccttcaggcttcctgacagtagcagtgaaaagaaaatctcccgatcactgacagcaatgatgccaggccttttttggtaaaagggccaattcagtaaaagaaaacgtgtttatgggctgaatctttttttccattgaaagttaaaataactttaccgaggccctgagggaaagtggatgttcttacaacctaaagagtctgctttgttaattaaagatggttactaagaaaattgttattgtttttagcattaaaatattgctgctgagtatatttgaggaataacaacatggatgaatgtagctttataatttttcctgtgttaatttgtatatcactttaaagtttataatgaatgttctcatgctgctggtatcattaccatccactctttttaaaaaattcgtttaaagatagggtcttactctgtcctccaggctagattatagtggcttgatcataactcactgtatgtaaccttgaactcctgaagtgatcctcctgcctcagcctcccaagcagctaggactaccacgcccagctaattattatttcttgtagtgacaggggtgttgctatgttgcccaggctggtcttgaactcctggcctcaagtgatagaccctccttagcctcccaaagtgttggtattacaggtgtgagccactgcactcggccactctttataaattggaaattaagctttgggaggccaaggtgggtggctcacctgaggtcaggaattcaagaccagcctggccaacatggtgaaacctcatctctcctaaaaataaaaactaaaaactaaaaaataaaaataattagctgggcatggtggtgtgcacctgtagtcccagctgcttgggaggctgaggcattagaatctcttgaacccaggaggtggagattgcagtgagctgagattgcaccactgcactccagcctgggcgactaagtgaggctttgtctaaaaataaaaaagaaagaagtgtctttgaacggagggagagatatgtaatggctcagtgggggcaggacagagagagctgttcctggagacgccccccgcccccaggcactggctgttcctcccctaactgctttatccctcaggtggaggtttggtgttacttcctgtgtagggctgatctaggtcccctgagaggtctaggtcttagaattttgtggtggctactttccctttcccttatctctgctttgcacaaattgaaatatttgatttgaaattgtattgcattagataaagggaaagtctggtattccaaatgctgggcagccaccagcccactgtcaaaagcattatgagctgggctcctgctactgcccttccacctctgaggggcagtcctgaggtctggaatcagacttcctgggttcccatcccagctccgtgactgcgagtcactttgttattctctttgtgcctccatgtacctttgcctcctaggtttcatagtataagtaattagttctcagagtgcccccaagaccctttccggggtctgtgaagtcataactattttcataataaatttaagacagtatttgttcttttcattctcactgtttccacaagtatatactggagtttttctttctttttttttttttttttttttttttagacagggtctcgctctgtcacccaggctggagtgcaatggtgcaatctcagctcactgcaacctccgccttccgggttcaagcaattctcctgcatcagcctcccaagtagctgggattacaggtgcccgccaccacgcccggctaattttcgtatttttttttttttttagtagagacggggtttcaccatgttgtccaggctggtcatgaactcctggcctcaggtgatccacccaccttggcctcccaaagtgctgggattacaggcgtgagccaccacacccagccttatactggagtttttcaaaggctacatgacgtgcagttttacaacagattgaacgcagaactagatatgagaatgcagctgtcctctgtgaagccaggtgttacatatttacattgaacgtatgtaaaacaatgtaaaacaatgccattcttctaaatatactttttgttttggaaaatatagtttaaaaaattaacaactatttatgtaaacatttgggttgatttatgatttttaaatgaattaataaatacatatttttaaaatgtaagctttaatttctaatatgatagtaaatatagatgcatataactcacacaaacatagacgctttgagcgccttgataatttttgatagtttgtaaaaggagttatcagaccaaaaagtttgagaaccactattgtgagtggacatttttaaagctcttagaacaatattagcttgggatttaaagctaagaacagtattagctattataattattctactttatatatatatagtttttattattattattttgagatggcatctcactgtgtggctcaagctggattgtagtggcccaatctcggctcattgtaacctctgcctcctgagttcaagcaattctcctgcattggcctcccaagtagctgggattacaggtgcccaccaccacgcccatctaatttttgtatttttagtagagacagggtcttgctatgttgcccaggctgttctcaaactcctggcctcaagtcatccgcctgcctcagcctcccaaagtgctgggattacagacgtgagccactgtgcctggccccattttatgttcttaaagtaaataactcagacttgttttgcccctgtttaatctggatgagcaatgttatgctgtatgtaacaaaactctcataagaactttaaaatacatattttgttttagagacaagctctctttatgttgcccaggctgaccttgaaaccctgagctcaagcgatcctcctgtctcagcctcccgagctgggactataagcacgtaccacacctggctagaactttttacttatttccgtatgttccatatcgatctcttaagatctgaagcattttattttcctttttcatttccttgttaaatagttttcgaaagctagcgccttgaaaaacattgggcaggttttcaatatcactaattagggacattctgattttgcctcatataaaacacagactttttttttttttttccagacagtctcactctattgcccaggcaggagcgcagtggagtgatctcggctcactgcaacctccacctcctgggttcaagcgattctcctgcctcagcctcccaagtaccaggaatagtgagattacaggtgtgtgccaccacccccggctaatttttttttttttccatacttttagtagagacagggttttgccatgatagctaggctggtctcgaattcctggcctcaagtgacccgcccgcctcagcctcccaaagtactggaattacaggcatgagccaccgcacccagccacattttcatttatatatattttcctgctctgtgtttagaagttaagaagactgattgaaaattaaatttttgaatagatgatatatgtacatgggataaaattctaaaggtagaaataatatatagtgataaataaatctcttttttacctatccagttcccctttctaaaggcaaagtttgttacagttttctctaattcttccagagattctccatgcaaatatgtatgagtatgcatgtgcatgtgcgtgtgcgtgtgtgtgtgtgtgcatgtgtgtattttttactgtggtaaaatatagataacctaaaatttatcattttaagtacagaatgcagtggcattaacattactctacaaccatcaccgctatccattttaggctttttcatcttcccaaactgaaactctgtacccatttaacaataattccatatcccaccctctcgcagcctgtggcaaccaccgttctgctttctgtgtctatgagtttcattatcttaggtgcctcatatatcaatggaagagtacaatatttgtccttcctgtgcttgcttgggcagcacatatactaaaattggaacgctacagagattagcatggcccctgcacgaggatgacatgcaaatttgtgaagcattccatttttaaaatacaaacaaacaatatttgtcttgtgtctggtttatttcacgtagcgtaatgttctcagggttcatccatcttgttgcatgcgtcagaattttattccttttttgaataatattccattgtatttatatcccacattttgttcatccatctgtgtattgatggacatttgggttgttttcatcttctgactgttgtgaataatgctgctatgaatactggtgtatagatatctgttccagtctctgcttttaattcttttgggtgcatatccaggagtggaattgctggatcatgtggtagttctgtgtttgatatttgaggaaccactgtactgttttccacagcggctgcgccatgctgcattcccaccagcaatgcccagagattctgttttctccacatctttgccagcacttgtcatttctgttggttttttggaggggggtgttgttgttattgttgtttctctaataaccatcctactgggtgtgaaatggtatctcactggggctttgatttgcattttcctaatgattagtaatattgaacatcttttcatgtacttattggccatttgtacatcttctttggagaagtgtctagtctttgcccatttttaaaccaggttgttttattttgttggtttttgagttgtaggatatgtgtttatttttaacgtgaatggtatgatactatataaaccattctgcactctgctttttttacttatcaatatatcttgactatttattaatatataaaaattggctgggcgcagtggctcaaacctgtaatcccagcactttgggaggccgaggtgggcagatcacctgaggtcaggagttcaagaccaccctggccaacatggtgaaaccccgtctctactaaaaatacaaaaattagccatgcatgatggcgggtgcctgtaatcccagctacttgggaggctgagacaggagaatcgtttgaacccgggagacggtggttgcagtgagccgagattgtgccactgcactccagcctgtgcggctgagcgagactcttatctcaaaaaaaaaaaattatccttatttcattgtatggatgaatcataatatattgaattaatctccttactaatggacgtttaagttgtttccaggcttttgctataatagctcatgctgcagagaatatcttagcatgcatatcatctcacaaaagtgagaactttttctcggtaaattattggaaatatgtcaaagggcttgacaatttttggtagatgttgctatcttgatgatagagtctctcatcttgtgtgagagtaccagtttcttcagtccttctgaaacaagctttaattatcaagcattgggattttttcccaatctaatatgtgaaaaatagaaactcagtgttaattttctttttcttttcttttctttctcttttttttttttttgagacagagtctcgctctgttgcccaggctggagtgcagtggcacgatctcagctcactgcaacctctgcctcctgggttcatgccattctcctgtctcagcctcctgagaagctgggatcacaggcttgtgtccacctggctaatttttgtatttttagtagagatgggggttcaccatattggtcaggctggtctcgaacccctgacctcaggtgatccacccaccttggcctcccaaagtgctgggattacagacgtgagccaccatgtccagcctaattttcattttctaaattagaacatctttcatatctcttaaaactgtttgtatttccttttgtttgacctgacagtttatgatttttccccatttcttcccactgaattattgatctttttctatatgaaaggtctcagccttagtcatgatgtgtctgtcatctatcttttcactctacttttactttctggcatgcagatttttttttttaatttagtcaaattacacacctttggagtatggatttaatttttggaaacaaacgaatgtcatttcgagtagttttagtagaataaatttaggttcccctaaataaagctaatttggtggggacaaaatacacccacaaggagtgcctctaaggtaaagaagataatttttccatgtagctgataaatttaatttgaaaatgactctaatcttattcacaaacaaatccagtttttttgtaatctaatggaataaaagtacaccacaagtccgtagagacagttgctggctctatcatgcattttctatgtgtcaccctctttttatttcattttccttatctataaaattgaaataaaaatgccagcaccacttaagccacaagagtataagaatatcaaataaaaaatatcaacttactttttttaacactccattctaatcaatttcagaacaggttgatactcaagaatttggtgagctaaaatgagatggggcccaatcctggaataaaagtgccaatctttcccctttcccaagccacacccatctgtcctgttcctatgcttcaatgcctttacagtgcgaccttatttttagtattccagactattctgtgtgatatggtttcactgtgtccccacccagatctcatcttgaattgtcgctgccattatccccacatgttgtgggagggacccggtaagaggtaattgaatcataggggcaggtttttcccatgctgttcttgtggtagtgaatcagatgattttataaagggcagctcccctgcagacggtctctttcctgccgccatgtaagatgtgcctctgctcctccttcgccttccaccatgattgtgaggcctccccagccatgtggaactgtgaatccatgaagcctctttttctttataaattacccagtctcgggtatttcttcatagcagtattagtggtatgagaatggactagtacactgtgtttactttatacctgccctatctataggagattttccctaatattttcttaatctttagacaaattttgcagtccagcagcaccaagtatccacttgctaatacagtgagtctcttttttcattgcttccatcttcaactcagtataagtctctgaggctcttggtatccaatatttatttcttttactgatagggagacttcagcttcgttagcaattggcaggaaccttgagtgtactaggtcctgtctaaaattctgtaagaaatagtaacaataacttatttgtaatggattagaaataacttttcctaggagcactggaggtaccataaatattacttttacttcttcacatatagtgctgttttgaagagatattaaaataacatttcgcaattcatgtttatcaggtagtagaaagtgtgagcaatgtggagagattgcatggacagttcccccaagacagttattatctgagaaagctggaagctactcagagagctttataaaaactgttatcgatactgggtctgcatttgtgcaatggaaaaacatggaagaggaatgggaattgctgggtccacacacccctcaataagaaatgaattgtaaaaacaggtttattcatgcagtgattgttcacatgtatgaatgaagtgaatgatgaactaagactacatgtgtaacttggataaatctcaaaaaacaacgttgaatttaaaaaattacaaaaggacggaaacatagtaccatatatatacactttaaatacacaaaataatagtaaatattgtttatgaatacaaatatatgcatggaaatgataaggattatcctcagaatagtggtgtgattgcatctgaagatgaaaggagaagggatgaggagtggaatgttagctgtttctgcaatgctttcttgtcaggaaaaaaattctgaagaaaatgtggcaagatgttaacatctgttaaatcttggtattggctgtcgtattttctcctgtacttttctctgaaatactgtacaactacacataaaaataaatatttttaaaagagtgatttatatcttatctctttaccatctcactttgtagttgctttgttaaaaattggtttcttatcatggtccttttgatgaactgggattaaagaaaagagtcaaagagaattttttaaagtcattccaaattctacttcctgaaataataatttttaatgttagactactattattctagagctctttctatccctgtgtaataaaataagtggatagaagggtgggaaattaatgagaaaggaagaaggaggaaaggaaaggaaggaaaaagatattgaagaaaaaatctaggatataatcttcatgtgggaaggacttactttaattttacttgactgggacaaaagaaaaaaaattaagttgaagaaattgtggaatctcaaatgtttgttagccataagagacgatatttattttaagttcagaaaagattttgagaaaaacattaagagactgtagtccttgtgtgtttttttaaactatctatttcgaatataaaaagtgtcagttgattccttgctgtgaaagataaggacattagcacttccaaaattctgtctacgttttctctcccaacccccaatttatcttaggtatatttttatttttacactgacaaggtagaatgttcatactttgtttagtattcacacatattttagtagttttgtatatttgaatgaaattaccactaaccacattttctcatttttttctccatccttgaattctttgatttatttttgtgtgttgattctcttgtcagtttttttttttttttcaggaagtgctcatggatgtttttgagactgggtctccgtctgtcacccaggcaggaatgcagtggtgccatcacggctaactgcagcctcgacctcctgggctcacacgatcctcctgcctcagcctcctgagtagctgggaccacaggtacacgctaccacacccagctaaattttagtttttgtagagacagggtctccctatgttgcccaggctgggcttgaacttccgggctcaagcaatctgcctgctcagcctcccaaagtgttgggattagaggcgtcagccaccatgctgagcctcttttatcttttacatgttttttttgtgcttgaatactttttacttgaatgacatcttataaatttacacaatcatttctcatggctaagaagtgttccaatgtgtaactatactagaatttaacatatttcctaattttagaaatgtaggttgtttgtaatatgatgctgctgtaattgtgactgggctagaattattagtgtggaacttttcaaagatcttatttctctcctgcactgccaaaaaataaaccctggatgcccaatttattttatctttaccttttcttaaagaggaatattttttttcttgttgggagaagagatatgtcaatcattatagttacgttctgagagtgggatggtgtgcaggataaagaagaaacccactctgaccgagactggaagaggagtttgttaaagatgtgggggaagtaagatttgagagagaggagtggaacttgagcagttacagaatatgaaggagcaatcaggaaaggggattacagcttaaaagtttttgaatagataatatgttcacatgtttaaatccaaagagaataaaattcaaagaaaagtccctgtaactcttttccaccagtcacccagttccctctaaaatattggcaaccagaatactagtttctagggatcactccagattctagccatacacaaggaaatgcaggtatattattttcttataccctgtttttactgaaatggttacttactttcatactatggtatgattcccatggagtggggtcatatctgtgatgaagcttgcttttatggcttttctgtagcgttcggggatctggaatggaggtagctctccagttcaagcttaggctaagtggcataaatgccataagggttaatgtattggaggacatcacaaagggcatggggtcggtcctagatatcccagtaggctatgttccaggctttacagatgggagttaataggaatggcattgtgacaagaaaaataacatttggattcaggcttccctcttcagggcccattactggctgttttaataaagaaggccatttctgtatctttggaggccaactttggttgactgtggattacaggtatctgtctgtttttgtttttgagatggagcctcactctgtcacccaggctggagtgcagtggcctgatctcagctcactgcaacctccacctccccggttcaagcaattctcttgcctcagcctcccaagtagctgggattacaggcacccgccaccatgctcagctaatttttgtgtttttagtagagaaggggtttcactatgttggccaggctggtctggaactcctgacctcaggtcatctgcccatctcagccctcccaaagtgttgggattacaggtgtgagccactgtgcccagccctgtttttttttttggaaaaggaatctcgctctgtcacccggactggagtgcaatgatgtgacctcagctcactgcaaccttcatctcctgggttcaagtgattctcctgcctcagcctcccaagtagctggcattacaggcaggagccaccacgcctggccaatttttgtatttttagtagagatggggtttcaccatgttggccaggctggtctcgaactcctggcctcaagtgatccgcctgcctcagcctcccaaaatgctgggatcacaagcatgagccactgtgcccagcctattgttcttattggactgtcttgatcaagtgcaaattttgctgtatgatttcaaaagtggggagccagaggctgtctgaggattggtggtttcagagagtgtacttcctgaggcctctgggtgtgtaccctctgtggcttccagattcattcgtcctgcagcctcaacctattctccttaacagaggaaatctaatattagattcactcgaaaagtgtggaagacttaatgcaaatgcaccacaaagaacagctcatggtagtttctttattagctttgaaatatagaatggacacaagccagaaagtgttactgtgtattcctgtggccccacacttgtttggaaacggggctcctttttatcattctgttggtcatgctctgtcaggttggatgggaccaaatattctttaagttttctcagttcgagcaagtttcttgtaaggacgtatttggaaataagtataagtgatagaaggtgttataagtaatccagagaggatttaaagtatatggaaggatgtgcttaggttatatgcaaatactatgccatttaatacaaggaattcatttgtataaggaatagcaaaaagtcccctcagcagcattccagcctctcagtgtactggaaggacatttattgccattagggtaacacaggggctctcgtatttcaagtcactctggtgactccacatcacctggtaatctaacatgctggtgattctactcacctgcttttatttcttcttttccagattcttcctattttgctcccgactgatttgatcctgctgtgtgtctcctactcctttgcgtctacctcctcatgggttcagatgctttgtgattctgcacctgccttctctctctgtgccgttcctcttccatctctcttccatctgtatgtcttgctttaaaactcccaaggaaaaaagaagaaaagtcggctttggtcatttgtcaatattcagtagtgtgtgcctttgttgagcagagctcaactgcatcagcccctctcttgcacacctatagagggacgccttattttggttaagtagccatctctggttcaagtatctgtgcctagggaggcaggtccaatggtacaaagcatagcaacctatacattcagaaactctggggagggaagtgtggatttggcagagaccttactgctcatctgatatagttaccccaaatcctaatgaggttgtttgagcctagtgttaggccattccaacacagtttctaggccaacagttggaactctgtggtaaactcaccggtttattaccatccccctccctggtagtgctagtgattcatgtcatggtggtcggctgtggtggagattgcatagtctaattctgtttcctctcctcctgagcacatagctatactgtaattcccagattctcttgcagatagaggggagctgggaattatggtctagctagaccatgtgacctagtttttaccaatgaaatgtggatggaggtaatgggtgctacttctaggcccggtccatggaaacctcccacgtgggaggtgcttttccctttacagcttgatatatacagtatagtgacattggaagccatatgttgaaaattatggaaccacaagatggaaggagctgggtccctgaatgagttgtcggaggaaagccatccaccgatcaggaaaatccattttggattttatgtgagccgtctccatgactattgtgttaagccactggaggctggagtttgttacagcagtggctgttatcctcacatagtggcattattgattttgctccacagggacccaaggaaggctttgggctccttaggtatcttggtgagcactgtcccaggcggaagttggttaacaggatggcccccttcagggagggctgatggggtatgggagagcgaccatcgctttgctactcctgataagcatgacataaagaatgtctctctttaagccttcctccccgaatcccaagctgtggatatcaatacatttgtatagattcatgcgagagttccagagtattctgaaactgcctctgaatttatttgcagaaaggtaggggttagtaactagtgataccactttatgcacagagcaagtaaactccatctttaccatggccaactgtagcaatagagttcagtgttttctatatcacagatagaagaagtaacaaaacttcatccatttcatcttcatatatagtaaggcgaggtgtctgagaggcaggggtgagaaagacaagactggcatgcatggtattgaaatggctgtgaaagggagaagatttgcttatagtagcagggcccaggtagcatgggaattcattacttttatctttaaaggggttagaaacaagtgttcagaggtgccatgcagtaatgaaaccagtccaggagccaggctgtaagtgctgtaattcaagtaagcttttggttaatttaaagggatggtagttacaccagctcctaacccatcgccatcttctgtttcatgtttttgattactgagaagtgacactcaaatgtttattttttcttaaaactactgagtacattttgtaacagctccagtttctactgagagctcatttatgccatatttcctttgctcacataactctaagagtacttctgttttttactgaaagcttgtatttctgtctctgctaagttataaacttactgatgacaaaatgtatttattatttgagttctgtaacgcatacaacattgccttttctctatatacagtgtgataatattagctgggggtatgtaactagttgtgtggtgttattaggaaatgaatctgtaaaggtgggctggggccattcagtgaatgatcttgtctgttgctctaggatcctggatttcattgtgtaagcaatacaaatccataaatgctgagaagggataagatgagatttgggcttttagaaagaaaaccctagccaggtgtggtggtgcacgcctgctgtcccagctacccaggaggctgagacggaagattgcttgagcttgggagttcgagaccagcctgagcaacatttcaggattaaaaaaaaaaaaacaaaaacccaaaaaagaaagcaaactctagctttaggatggtagatccattggcgtgcggaccagagcagtagttcttaatcctgggtgagcttcagagcggcctcacagcacggctagtccggtactgcatgcgaaggagcagcacagagctggcacacggcgggctctccaacccaactggacctggtgacctttatgaacccgcagcccaaagccaggcagaatcaaggaggtctccacaggtgccggtgtgggtagcttatgggccttagccacaccctggcaagtaactatcccttttcataacaaagctttcctgggcacttaccctgccaactgtattctgccgagttctcctctcccggaggcagtgagcatggaatgcccttgtctacgttgggaaaaggatataaaggattatggatgaaataccttctcccacaaacgccttctatataaaacaaaactaaaaaatttccacccactaaaacccctggctaaggccctatgattatctttctctttacagctaagaatcttaaaaaagagtttgctctttattgagcactctgttccttcttcaacgtgcaatttgtaatttcacttctatctctccgtcccatcctgttcaaactgtttttcctgaggttgttgtctcttactttatttttcatatgattgtcttttgttttcttttcttttctctcttcctttcctttcctttctttctttcttttttcttttttttgacagagtctcacttgcccaggctggagtgcagtggcgcaatctcggctcactgtagcctctgcttcctgggttcaagtgattctcctgcctcagcctcccaagtagctggaattacaggcgtgcaccaccatgcccggctaattttttatttttagtagagatggggtttcaccatgttggccaggccggtcttgaattcctgacctcaaatgacccacctgcctcagcctcccaaagtgctgggattacaggcatgagccaccacagccggcatcttttgttttcatccaacacctctgactcttttttctcagcctctgctttgggacgattatctttctatctggactattaatgtctgctagagtttcatctccatccttcttttcatttacaccctttctgggaaatctcttccatacctaaatctgtatcttaacctggaaaacatttttaaagtctatataaaaaaagcccttcttagttcaaaggtaaaattttaggaaaattaaattgaaaacttataagaaaataacaataatggaaactagatttgaaaacagaaatgacaggatgggcgcagtggctcatgcctgtaatcccagcattttgggaggccaaggcaggcgaatcttttgaggtcaggagttcaagaccagcctggccaacatggcgaaaccctgtctctaataaaaataccaaaattagccaggcatggtggcatgcacctgtaatcccatctacttgggaggctgaggcaggagaattgcttgaacctaggaggcagaggttgcagtgagccatcattgtgccattccactccagcctgggtaacagaatgagactccatctcaaaaaaaaaaaaaaaaaaaaaaaaaaagaaaagaaaatggaaatgatgttagaatctatgagatacaaccaaattaagactcattaaatgcctatataaagaaaaatgaaagcatgaagaaaatgaacagaacatccaactcaaaaaagctagggaaaataggtaaactgaaagaaagcagaaaggagaaattaatgaagataaaaacagaattaatggggttgggaaacagtgtaacagtaggaaccaataaatgaaagttttttttttttttttgcaaaagtttaatagaaagataaatcactagcagtgtcttatttgggaaaggacaaatgcaagataacttgggagacagaatgattaaaacataggaaaatttcaaatctaatgagagtcatttgtacaactctatacaagtgaatttgaacacctagctaaaatggtcaactttctagtaaaatacaatttgccagaaccagtcctagtcatatgtatatagattggaagagttaatattgttatgattgcaatactccccaaattgattaacagattcattgcaatctctatcaaaatcctggttgcctttttttttttttaaacaaattgacagttaattctaaaattcatatagaaatgtaagggacctagaatagccaaaacaatcttgaaaaaggataacaaagttggactcccatttcccgatctcaaaatttactgaaaagctacagtaattaagactgtgatactggcatgatgatgtaaggctagacacatgcatcagtggaatagaattgagtctggaaataaacccttacacttatggtcaattgatcttcaataaaggcggcaagacaattcgatagaaaaaagaatagtctttacaacacatgatgctaggatgactgaatatccacatgcaaatgaatgaagttggaccctaccacacaccatatatgaaaattaactcaaaatggataaaagggctgggcacagtggctcacgcctgtaattccagcactttgggaggccaaggcaggcagatcacctgaggtcaggagttcaagaccagcctggccaacgtggtgaaaccccatttctactaaacatacaaaaattagctgggcacggtggtacacacctgtaatcccagctacttgggaggctgaggcaggagaatcgctggaacctggaaggcgggggttgcagtgagccgagatcacaccactgcactccagtctgggcaacagagcgagactctgtctcaaaaaaaaaaaaaaagaagaagaagaagaagataaaagatctcaataaagagctaaaatcgtaagacccttagaagaaaacattgatgtgaatgtttgtgactttggattaggcagtggtttcttagctatgatacctaaaacaagcaacccaagacaaaaatagataaattgaatttcaccaaaattaaaaactttgtgcttcaaaggacactgtcaggaagataaagagacaagccacagagtgggagaaaatatttgcaaatcatatatctgataaggggtctagtacctgtaatatataaaaaactgacaacaataaaaagacaacccaattaaaatgtggacaaagtatttgaatagacatttctccaaggaagattatttaatggccaaaacatcacatgaaaatatgctaagcatcattagtcatcagggaaatgcaaatcaaaaccatagtgaaatactactttagatccactaggatggctgtaattttaaaaatgaaagatagcaaatgttggtggaaatataaaatggtgcagccactttagaaaacagtttagtagttcttgggaaagttaaatgtagagttaccatatgacccagcaaattcattcctaggcgtatactgacgagaaatgaaaaaatatgtccatacaaaaacctgtggatgaatgatcatagtagcattatttatactagccaaaaaatagaaacaactcatgtcaatcaggtgatgaatggataaatgaaacgtgatgtatttataaaatagaatattgttcagctataaaaggaatgaagtactgatgtgtgttacaacgcggatgaacctaggaaacattctgctaagtgaaagaagctggacacagaaggccacatgtgtatgacatttatatgaaatgtctagagcaggcaaatctgtagacacacagatcagtggttgtgaggaggtaaggggagggagggatggacgtagctgctaacaggtatggggattctttatggggtgattaaaatgttctgggattagatggtggtgatggtagctcaaccttgtgaatatactaaagccactggattacacacttaaaaaatcaattgatgaaaaagcaaaacaaactgatctcacaaagatagaaactctaaacacaccaatttacatagaatcattaggcaagttttcagagttctctcaccaaaaggcttcaatccagatagtttcacaggataattctatcaaagaagaacattttagctctagtgctacttcatctctttcagagaatacaaagtaagtataatgttgacaccaaaaacttaaaaaagactgcattaaaaaatcttacaaaacaatcttatgaatatctgtacaaaaattgtagataaaatgttagcaacaaaattcagtggcacacataagcaaatggagtttattccagaaatgtaaaaatagttctgtgttgggaagtttattaatgtaattcatcatataaacagatctgtgaagaaaaatcataggatcatctctatagaggcatttgacagaattcacacattcataattttgaagactcgataaagtagaaattaaggacatgatttcttagcataaaatatgtgtgtttcagcccaaaatctagtttcttacttaataaagaaggcacaaacagcattttcattaatgtcaggaataagataaagatatccgcatttgctgttattatttagtattgactagaggtattaagcaatataattatataggtgataacagacacgtaagtatttgacgttaaatggtagaaggtagaaaagatagaagaaagaactatctttattcacagatatatgattaaatatctggaaacctcaagaaaataaatggaaaaactacaaagaaaaataatatttgctaaagtatagtagggaataaaattaatacatagaaatcaagagcgttcacctatacaaacaatgcccagttggatgatataatggaaaataagactcatttacaatagcaacaaaaaagctaaaatttatagacaaaaatataacaaaaaccatataaatgctacataattcagataacttgaaatatataaaaatagatgaacaaatagacataccatgttgttggataagaggacttgaaattataaagatgccaaataattctaaattaacttattaagttaacacagtctcaattaaaatatcaccagatcttttctggacctagataagtgaattttaattttcatatgagaaataagttagcaagaataggcaagaaaactctgataaagagtaaggtggcccagcgtggtggctcacacctgtaatcccagcactttgggaggccgaggcaagcagatcacgaggtcaggagatcgagaccaccctggctaacatggtgaaaccttgtctctacgaaaaatacaaaaaattagctgggcatggtggcaggcgcctgtagtcccagctactcaggaggctgaggcaggagaaaggcatgaacctgggaggcggagcttgcagtgagctgagaccgtgccactgcactccagcctgggtgacagagtgagactccgtctcaaaaaaaaaagtagggtggtgagtttagctttgtttgatattaaaacatactacaaatcctctattgttaaaacagtatggcataatggatcaatgaaatagaaaatccagaaattgttccaagtgcatatggaaagttaatataggatataaatagcatctctgatgtgtgaggaaaacatagatttaactggatagctatttagaaaaatataaaattgggtctgtacttcatgctgtatagtaagataaagtttgtgtgcaacaagtatctaggtttaaaacaaaaccttgttaagtatttaaaaatatgaatgaattccattataaacttggagtaggaaaaataactcaaaacaaaagccagaagtagaaagattttaaaatttaataaaattttacataataaaatttcaagccaaaaaagaattataaaatcaagagataaataacaccttgagaaaaatcttacattgtaaatggctaatatccctgatattgtgtaaaagtggtaactcttttaaaaatatttgattaaccagaaatttccatttcttgaccacagagaaaaaaggaatctagtatgccattattttgaaatttaatcttttcagtgcacccccttatttactgcattattcacaatagccaatatagggaattaacctaagtgtccaaacgaatgaatggataaggaaaatgtgatatgtttacacagtgaaatactatccagtattttaaaaaacattttattttgaaataattttagagttatataaatgcaaaaacatagtacccaggatgggcaacataatgaaaccttgtctctacaaaaaaaaaaaaaaaaaaaaaaaaaaaaaaaaagccaagtgtggtggcacagtgcttccagctgctcaggaggttgaggtggttggattgcttgaacccaggagctcgaggctgcagtgagctatgatggcatcactgcacttcagagtgcaacagagtgagacgctgcctcttaaaaaaaaaaaaaaagagtttgtgtatccttcaccccattcacatcttacataactacactacaatgatcaaaaccaataaattaacgttggttcagtaccatcaactgaactagagatgtactggagtttcaccaatttcccacgaattccctcctctctcccaggatccgtgcagaacgctgtcctgcgctgttgtcttgtctctttagccctccagtctgtgacagttcctctttcatcaccttgatacttttgaaaaatcctgctgaattcttttttagaatgtccctcagtttgggtttgccagatattttcctgtgattagattgagccagtatatttttggcgagaatactacacacaagtgagtttgtgcccttctcagagcatcatgtcagggaatacatgatgttgctctgctttagtactgatgatgttaaccttaattgcttgcttaagatagtgtctgccaggtttccccacagcaaagttatgaattttccttttgtatttggtaaataccttggaggagatactttaagactgtgcaaatattgattcccctcaaactctggcccacaagtagcatccgttggtcaatcttgcctgtgaatgttattactgtggtttttgccaagcggcgttttggtgttatttttaaaaaggaaattccaggacagtgggcttgttctcattttgttgggcagtcggcagccattgggcaatgtggaatttagaattacttaggcctttcccaacacagaaaaatgccatagtctattaattcagtaaacatttatggaacccttgttatgaccaaggcctcttggtgaaatatgcagacagcataggatctggtctgcacctgagtctttttctctgccactacttttcaccttgaatcacactcgccatcaagatttgttctaagatgttattgcaaaaagtgctgagagacaagtccaggagtcagaggataggaccaatttccaattttgccccagactagctacgttactagcagggcgagtcagatatcgtctcaaagttctagtctccttatttttaaaatagggaatataatatagattgacattagaattaaatgagtggatatatatgaaagtactgtttaagtgaaaggcatttttcaagctataaagtgttctacaaattaattattgtctgggcacggtggctcatgcctgtaatcccagcactttgggaggttgaggcgggaggatcgattgagcccatgagttcaggaccagcctggccaacatagtgaggccctgtctataaaaaacaaacacacaaacatgaattactcaacaaatatttgatttcttattaagtgtgagctttttctaggtgttagaatatagcaatgaaagccaaagcctctgccctccaggaacttatattttagaggaaaaaggtggataatagaaaagtaaacaagtaataaatacaatttcaaatagtaataaatgctacactgtaaataaaacaggatgatgtaacaaaatgtgctataaagaaaataaagtaggataatacattagagaattggggtgtgtttaggtgggatggaatagtttagacgttctggtcagggagtgcgtctctggaagtaattttcgagataagaactttaagattaggagtcagctgtgtgaagcaggggagagcaaatataaaggccctttgaaggggaaaggattaggatgctggagaaaagcaaagaggatagtgtacctgtgaggtcgctagagagtggtgtaagatcaagccaaaaacgttggcagggccaaatgacgtagagcattacatgctgtgaaaaagaagtttctcggtgcagttgatcaggaagaagttgaccagaaagccattgaagggttttaagcagggcattacatgttatgattttcattttaaaaagattgttctggctgctgtgagaatggattgagatggccatcaagagcagaagcagaatgacagcctgtggtctattgcagtggtgcaggcaagagggaatggtggccaggcaagcttggtggtggcagtaagttgtaagatgtcattattgttattgttatgggctgaattacgtcccctccaaattcgtgttttaaagtcttaacctccagtatacctcagaatgaaaccttagttggagataaggtctttaaagaggtgattaagttaaaaagcccaaacaaaagggaggtgattaagttaaaatgaggccattggggtgggccctaatccaatctgacttgtgtcctcctaagaagaggaagtttggacacccagagagacagtgggatgctcgcgcacagaggggtgaccaggtgagggcacagggagaaaaagtggcgcctacaaattgaggaaggccccagaagcagccgacctgctgacacctttatctgggacctctggcctccggaaccgagaaaatcaatttctgtggtttaagtcacacagtctatggtaatttgttatggcagccctagcaaactgatagagctatgacaatcatgggtatggtgctgatctcttcattgtatttatcactacctaaaattcgcttagatttatttatgtttactctttcactcccttgattgtaagttccattacagcagggattttgtctaattcatagtaatcgcaatgctgcggagtgcctgcgccatggcacatgaaaagtgaccgtgtggttaaattgtttctcagtcactctgtaatatccagtattttgtagagcttttgtttttaatgatatacaggagatccagagttttttagggggctacaaactctagcacataggactatataagaaataacactgcagcaagttagaaccaggtgttcaggaagcatatcttagcagtggagacacgatctcttgattagagggaccttggataaaagaggccttttttgaacagaatagctctgctgaagaaagagatttcgtcattattttaccttcatttcatggcttttccaaaataaggtacatgtgtgaaaaatgccctccgtaagggcgaggtctttattttgttctctgctgttctgtaaacgataccagcacatcatagggttcaaatatttgttaaatgaatgaaaacattttcagatcctgctttgtccttagacatttttggattgctttaaatgttctcttatccttagcataatattagctatttaatagagcaggtaaaatgttttgcctatttttttttgtctcttataattgtgtgaaatattctgaatctggtcttcactttggtgtttttgaccttaggctgcccttaaactgaagtcacagcctagctcaatggcactggctcccccttgtgtcaggaacttgatactacacccactaaatgccagcctgccaagaaccaagcttccccgggtcaaacattttaagtggtccaaatgctatacataattaaatgatgacaccacgattgggccaccttattggggctcatttgctccaaatagtcttactcctatgcccactactatatatatagcacaggtacagaaaaacatttttaatacttgtaaccataaaggcttttggagttagtttgtacttcttatcaatataagacatctacgttgacaaaagaaatcgaatgttgactgagtgcggtggctcacgcctgcaataccagcactttgggagacctaggcgggcggatcacttgaagtcaggagtttgagatcagcctggccagcatggtgaaactctgtctctactaaaaacacaaaaaattagctgggcatggtggtgggcacctgtaatcccagctacttgggaggctgaggcaggagaattgcttgaacctgggaagcggaggttgcagtgagccgagattatgccactgcactccagcctgggcgacagagcgagactctgtctcaaaggaaaaaaaaaaagaaagaaagaaaaagaaatcaaatgtctcagcatattttaaatactttatatggaacagttgattttcactttctttcaaaagcctaccaaaattgaggagttagcgtttttttaatcccatgaaatcgatttaaaaggaagaaaattatttttcaaagggacaacattttattttcaagagtagtatttgatttctgttttgtgtacatggtagaatactgagtgagttgctcctggccactctcgctgttgaggagatgaacccgtgcagggacggccccaggaaggcctctttagctgtctgaatgaagtgattttgactctcagcgtcagtggtgtgctggagccagaccgtgccgacttatcccagctcacaagagctaatggctaaatttcaggagttctgcaaactattgttaaagctagtttatattagaaataaattatatagacaattcagttatattaaaaaacaagggtgctttcttcagcagcacttatctaagatcagaacaacatcgagaagatgagcgtggcacctacacaggctggcacacacatttgtgaagcgttccatattttttcaggttattctgtattaaatgcaaaataaatgcttttattaacaatgacaaaaagaaaggtaattgtaataaatacaatttaccacttcgtaattactttattatattttactcatactttgaggttatttgtgtctagtgtatgtgtggtggatgtaccatataatggtatgctattgtcatttcttccagactccacctttagtgatttcatgtttgtaattggcagcttgaaatcgatcttggaacaatggaaataaaaccacaatggaaataaaaaaggatccaaatcaggactttttgcctatgaggagccagtgataaccagcccattactatatgcaaaacgagtttatatgttttttctctactccaaaaacttaacaaaagaaggaattattaaactttaaaaaacgattttaattttattttactacattggtttcagttttttattttattttatcatttatttatttatttttgagacggagtctcactctgtcgcccaggctggatttatttatttatttatttatttatttatttatttactttttttgagacggagtctcgttctgttgcccaggctggagtgcagtggcaccatctcggctctacctcccgggttcaagggattctcctgcctcagcctccttagtaggtgggattacaggcgcctgccaccacgcctggctatttgtgtgtgtgtgtttgtgtatttttagtagagatggcatttcaccatgttggtcaggctggtcttgaactcctgacctcaagtgatccacctacctcggtaccccctcccccgacccagccccaacaaagtgctgggattacaggtgtgagccaccatggctggcttggtttcagttttttaaatagttttttgaaaagataacttcaataatttaaattctttaataattttaataatgttaaaaatggttttaaaaggttgctttaatttaattgaatttatttatgttgagacagagtcttgttctgtcacccaggctgccgtgtgatggcagcatcacagagctcactgcagcttcaacctcacctgctcaagtcatcctcccatctcagcctccagggtagctggaactacagccacacaccaccatgcctggctaattttacatttttttgtagaaacaggttcttactgtattgctcagggtggtcttgaactcctggacacaggtggtcctcccgcctcagccttccacagtgctgggatcacaggtgtgagccaccttgccttgtcactggtcgagggttgtgactgcaagttgtccaggttcttggcattttgaacaaagaattggacaaaatgcccagcaaagcaaagcaaagtatgaagcaacaaaagaacaaaagcagggattcattgaaaatgaaagtacactccacagtgtgggagtgggccagagcagcagctccagggtccagatgcagaatcttcttgggtccaaatacccgctagcagttttccattggccacttcacgtccatctcatgtaaatgaagtgctagcccacagtcagtctgaatggttgcagaaagcagccaaccagaggctgaagtgaagttacaaaggtcacacccctgtgcaaacaggagttggttttcgcagccaatcagaggctagggtgaagttacaaagttatacctctgtgcaaacagacttggcaggccattagtctgactggttgtggacagcagccatcggtctgactggttgtggacagcaaccattcagaggccggagtgaacaaagatgcaaacgaagactcaacccgcagtcagtctggtttgttgcagacagccaatttcccatctgcctaccagaaaaggtagtgagtttgcaaagggagtagcctctggtccttttgttacttaggctggaaagttagggttttcctttcaatttagttctaggaagtcagtgtgaaatagccttaggatccctgcctccagaccctattgccctgcctcagcctggcctaaaagctttacttgaatcttcaatcaattcacttaattcaaagtttcatttagtagaaataggttaaccaaccttaatattatatatgattttatcaattatgttatatttttgtttcattttctagttcctgtctaatgtcttgttttcttatttctaaacttctttcttttattttcatcattaagctatgaatttttttcctatctcctgtaactttcttttcacttatttcagtgtttttacatttttctcttcagctgtctccctttgcagacagacctcgatctctttctcagaattaatggcctcatattttcctgacctgtgctccttctcgctgtctcttttattcttagctcacctttaggatcctcactactcctgaggctgaactgttagcaatacggtttcctccactgtggccaggatcccagctccatccggataccatctggacatgtgcagggctcacctggccccttctgctgttttcccatgtctttggcaccagaaatacgatgcgaggatagtgcataggatcattcggtcatttttgcctctagccccgtatttcagaacatgggaggacaagagaagctctgagtcgtttttgcttctgctgtaatttgtttttattctcatctcaaggaatttggaagtccttttgaaataaatgcatctcatttcattatcatttgaggaaagagacatttgagaggaaagggcgattaatatttaaacaccacctcccttcccctacctcatttgcccttgtatttttttcttctcactcgctctcttatattgcctttactgggcaactatgtcaacaaattgccactgaaaggcacctgactggtgagctgccttgagctgaggtcagtgtgatccttcagctgggagccgctgctccgttttagagggcgagccattgctaccgctgatgagctgagcctggggctcaacgagtccatctgaaaagccatctctcttccagcagcagggagccactcgcagtgctgctttcatcagccttcgtgaaggatgaaaagggcttcgtcttttccacacacacttgactccagcagcgtgggggtttggagcactgatctcccctaccgttgaaaacccacgtgtaacttttgactctcccaaaacacaactaacagcctgctgtggactgaaaaccttactgataacataaatgtcaattaacacatattttatatgttatatggattatctactgtattcttacactaaagtaaactaatgttactttaataagagagaacattaggccaggcgcagtggctcacgcctgtaatcctagcactttgggaggctaaggcaggtggatcacttgaggccaagagttcaagaccagcctggccaacatggtaaaaccccatctccactaaaaatacaaaacttagccaggcgtggtggcgggcgcctgtaattccagctacttaggaggctgaggcaggagaatcgcttgaacctgggaggtggaggttgtagagagctgagatggtgccacggcactccagcctggtcgagagagctagactccatctccaaaaaaaaaaaaaaacgaaaaagaaaatgttattaagaaaatcataaggggctggtgcagtggctcatgcctgcaatcccagcactggcactttggaaggccaaagcaggtggatcacttgaggtcaggagtttgagactagcttggccaacatggtgaaacctcgtctctactaaaaataaaaaaataaacttagtggaacatggtgacacgtacctgtaatctcttatttgagaggctgcggcaggggaatcgcttgaaccccagaggcggaggttgcagtgagctgagatggtgccactgcactccagcctgggtgagagagctggactctgtctcaaaaaaaaaaaaaaaaaaaggaagagaaaatatatttactcctccttaagaggaggtggatcatcataaaggtcttgattatcatcttcacatggaggaggctgaggaggaggaggaggaggaagaggggttggtcttgtttcgagtggcagaggcaggagaaaatccacatctaagtgggcttgtgttgttcacaccatgttgttgaagggtccactgtgcctttcttttacctgcaaggaatggtaggctgatacacagcctcatctcaacttttacttcaggaaacaatattttaggtctatccagggtctccaagtttctgaagtactgagtgaaaatgttgtaactaatatattttgttatgaaactgaggattaagacatccttcataaccagcttctgaagccaaagtgatacagatagtataacaccagagtaaattgttgtataagtagtttatgtatatgaggcagggtttctgttatcctttgttattactgtggttttgatggatgagagtgaaatgtgcttatcttgttttttttttaaataaaatctttttatttaaaaaatttcaaacttctaaacggtaagagtgttgccctgaactcctgcacacttttacttagattcgccaatccctcatgatctgccacatttgtttttgcctcctctttctccttctccctctctcccccgtttctctctatatatgcacaaacacacatacctatttatacattttattattattgttattttcatcatcaccattttgctagactatttgagagtaaactgtaaacattgtaacctttccctgaaatgcttcactgtggatcttctttctttctttctttctttttggagaaaggtgtcttgctatattgtccaggtgggaaatggacatgaactcctgggctcaagtggtcctcccaccccagtttcccaagtagctgggactataggtgtgcaccgctggggtcttcctttctttctttttcttttctttttttttttttttttgagacagagtcccactccatcacccagatgggagtgcagtagctcgatctcgactcacgcaacctccacctcccaggttcaagtgattctcatgcctcagcctctcgagtagctggacttacaggtgtgtaccactacagctggctaatttttgtatttctagtagagacaaagttttgccatgtgggccaggctggtctccaactcctggcctcaagtgatccacccacctcggcctcccagagtgctgggattacaggcatgagccaccgtgcccagcctcagtgtaggtcttctaagacaagaacattctcttacataagccacagtgtctgtgtgtgctcttaaaaataaccttagagtcagatcacttgggttaaggtgtcatttggctcattcctctgcttcttgcaggtgcatttctaaacagtacaaaactgatattttctgggagtgatagaccgaaattcttatgggggccagcctgtgatataaaagtgagaatctgacagagttcatactgtactcatgacatgtatgtatgccccacctaaacaaataaacacgccaatcctagactaaaaaaaaactgtaataagaaaaaatcatcaacaacaacaacaacaaaaatacccgatggccaaatttgtcacttgggtcaacaatttgcggccctggatctacggtcaaagctcccgtggggtggaatatccacagctttctttggaagcactgtggtatagttcagaagttctcctttaagtccaagtgcttgactgagatttgtgagaggcagcagtcgcagtggcaggtagcatgagagctaggctgtgtgtgtgaatcccgtttccaccatttgctaccggtgtgatcttgggaaaatgtcttaacctttctgtggttcacttttcctcatctgtaaaatagtacctttcacacaaagctgtcatgaggaagaagtgaggaagaatatttaaagcaccttacaccagagtctggcacgcgtaataagtcactgtagaactggattctgcgaagacgaacctgatggctagaggccatcacatccatgcagatcatgatcctggtataaggggagagggatgtgaggactgttcctcctggaagacctagagaagatgttcattcttgagccagaaagctacttaatctacttttctcccattgggagtgactttcttttgttcttatccccgttgtcttttttttcttttttcttttccctttttttattagacggattttcgctcttgttagtagagatggggtttcaccatgctggccaggctggtctcgaactcctgacctcaggtgatctgcccaccttggcttcccaaactcctgggataacaggcgtgacccaccgcgcccagccctcatccccgttttctactcatccttcttgtcagacttctccccagctctctcctatatttccctagtgctgagggggtcactgcttgaatattaactctacgtgatccctgacaagttatttaatgtctttgagctttagttttctatctgtaaagtggggacaataatagtacctacctcctagttgttgtgagggttcagtgagttaatgtagggattactgtgtcaggacagtccctggcacacagtaagtgctgtggaactctcagctattgggtaggatgtgcatcattctctttaatagccatattcctccacggtgtactctatacttgtgatctcaattttctttttgctggctcttttttggagttttttcttcctctttttctcctctgcaagtgctcttattgaggtcagtcctcttctttttgtccagatctaagattctgcttattctcttagccttctgaaatattttatttttttactttgagacagggtttcactctgttgcctaggctggagtgcagtgccacgatctcggttcactgcagcctcaacctcctgggctcaagcaatcctcccccaagtagctgggactacaggcatgcgccaccataccccaataatttttaaaaaatttttggtagagatggggacttgccatgttgtccaggccaccttctgtaatactttaaactgtagcaacctggccaggctcatgcctgtaatcccactactttgggaggctgaggtaggaggattgcttgatcccaggagttcaagaccagcctgggcaacatagcaagactctgtctctattaagaaaaaaaaaaaatcagctgggcatgatggtgtgtacttgtagtctcagttgctcggaaggctgaagcaggagaatcgcttgagcccaggagtttgagtatgtagtgagtgtgatcgtgccacttctccagcctgggtaacagagcagaccccatctcctcaatcccccccacccaaaaggaagacaaaaccatcgatattattttgcagccagaagcttgggggtaggggacagtaaggaggttattggagaaagggaagtggagatgaggagggaagggagggagtgggagggagacactggctgattggctgagcagtggagagctaccgatggcaggattctgcagcgcggtgaggcatggggtggatgttgcgaaatgaagctggcggttacaagataagccatttagaagaagtgttgtgattagtgaaaggaagccgggaaatagaatagagtggcgaagcacctatcaagttttttcaagataaggaagatacctgaatattttaaggcaaaagaggaaacagctaataaagaaaataatgaagatgctgagagggagaggtaattgtgtgaagaacaagagctgagtgtggaaacgaaaaactaagagggagatttgcttctttgaggaggagcactttttatttctccaaggctacgagcacgaggcaagagctataggacattcctctaaagtggtacaaagtcagcgactgtaaaggtgacgtgaggattaataatagcacccagtgatcgtgcagttcacatctgttgagtgcagtgggtgataaggacgttttctgagatgaagggagggaagtgggtgataaggacgttttctgagatgaagggagggagtactttggagcttgaggcaagagatgctgcagaatagctgttttgagggagtttgccaggaagtcaacagacgactgagcggattgttaggcaacacccaggacagatttgatgttggatgggggtgaatttgtcataggccacgcttttttattttattatttattgcagcagtgctttgcaggaacaaagaaagtgaaaattgagatgttcaggattatggactaacagcaggcaggatggagggtgaagggcccagagttcagggtggtgacagtggccattttgagtggctgagtgtagaggactgagcagccgtgtgtagattaactgccaagcacagctgcgtgagtgagcctaggccaagctagcggaggaaccacgcagccaacccgcaggatggcggaaaagaataagccgtggttgattccatcactctgtggcgggcagcttgttacacagcagtagaagatgcatgccatgccttgtgttgactgcgcacagcagggagcctgaggcaagggagcctggcacagaagcagaggtcagtcggctggagaagctgggcaggtggagaagaatagagggggcctctggggagcacccagaaatacccagcagctctggagaagtgcaggttttagaatgtgagagtgagaaggaggcttgccatcttgagagatacacacctggtggcaagttgtggtgacggtaagtgctggagggagcgcagccacagctcagactgtctcttttcttccgtgccattcactctcagcagaggaccttgccttgtactacacagaggacagagaagtctttttatgtgagtttcttcatcatcccatttccaaagacaaactagggatacagatatgaattgtatgataaaacttgagataacagataagtcacattacttttctaagtctgattaaatcttgtgcccctacttgtcaagaccaataaaaagttagtagttttcgtggcttctttttggctcttatattgtacagtaagtcttctcttaacctttcaatcagttgttggaaactgcgactttaaatgaaatgatgtacagcaagtctttgaataatgttgttacaaagttgatgagaaaaaaaaatggttttgttatatgtccttttgcttacggttgtagtttccaagaacccatcaatgatactcagagaagacttgctgttctgggactccaaggcttagtgcagtctctgggggaaactggagagaggaaaagcattgtgctcatgagctgtctaggcctgagacagggacagcatccgtgtcgtctgcaccaggctcagccacagggagccttagcacagcttccagggccccagagctcaatggagagattagctttccataagaggaaggaacctcatccagtgcagtagaggaaaagagaagaacataggtgagatataggtgggctagtggagcagtttgtaggtgtacagggagagttcttgaggaagccgtggtattgttcttcaggccactgtggcctcatcagcaaaagaatctttgcctttttttcttatatcatcaggcctttgtgattcgagactagagagaaagaagttgcttaatgcctgcaagatgtcaatcacgtgggctttgttttctggggtctacccgggcaggtgagaccatagcagattcgctcagcagagaagaggatggtgatgggttcctcaaggggatgtgaaagagggagagggaaatttcctatgatagggaagaacttgccattctctcacatgtagcaccttgcaggcggcaggacctaggatgggggtggctggaagaacactgagcgctaagtgcctggccaaggccctcccaccctctcaggaaacccacccacccagtgaacaacgcccgcatcagccttctttgcacgggctctttcccagtagcattaaaatatgctcacatcattcaggtcttcagtatcaaaaaagaaaaaacatcctctttaacaccatgttcctctccagacaccccttccctcccctttacttctgtttgttttttggggtttttgtttgtttgttttttgatgtgggggtctgtgtatgttgcccacgctggagtgccaagtcagtgtctgttcacatcacgatctctgctcactgcaaccttcgcccccacttcctctgggctcaagtgatcctcacgcctcagcctcatgagtagctgggactaccggcatctgtcaccatgcctgacttctccctttcacttcttagatcctccttgacccactgcaatctaatttctcctccaccttcaacggagagtgcccttgtcaaaatcatagctgatctccttttttactaactccagtggctgtttctcagaatttacctccctcgacctctcagcagcatcggaaagccaaggatgactttccattttttttctccttagcctccacgccccggccctctcctggatgttcacttccctctctggctgctctgctccatctctcatgcgggttcctctttcttggatcgttccttgaatgtgggtactcctcagacctcttccttctctttcccagccaatacattctacgtagaggagctcttctgctcctgtggcttcatgaccggatccacgtctccagccagatccttctcctgcacttcgcactcttatgagtatcaagtctgtggtttgattttaccccacttgtaagctagcaagttagcttgttactgtctcatggatgttggcacaagacttgagactcctgagtcagtgacaaaggacttcattcctcttggcacagcaggcaacatgagcatcagcttgtgggtgacagttactcctgccctcaccttttcctggtgatgggcccagctggatgcctgcacaggaaatgggtggcatcacagaaagggaacagagctttcagaacagagaatttcagggaacagaacaggggatatctactgcttttatagcaagcaggaagcaagcctgctctttggcctggagggagacattatgtcatctctcgaggctgctcactgcggcatagccctgagagatggtcagggttttcatggcataaccagcaagaacaagcatgttggaaattcaacatgtcccagattgaactcttcatttcccttcacctaaacttttttacttcctttttaaaaatttatttttatttattttgcacatttattggtatttcttttagagacacgatctcactctgtcacccaggctggagtacaattgcaggatcatagtccactgcagccttgaactcctcggctcaaccgatcctgccatctctgtctcctgagtagctgggactacaggcacgtgccaccacactcgactaatttttaaaattttttgtagacatggcagtcttgctgtgttgcccaggctggtcttgaaatcctggcctcaagtgatcctcccacccacagcctcccagagtgctgggattacagatgtgagccaccgcgcctggcctgtttctccttctattttctgaactcagtgattgatgcagtcctcgatatttgtaactcattaccaactgataagaaattcttaactcttttgactttcctctccctcatgaagtctgatgactccttcgaactctctcttaggtttatttgctcttcttgccgctcgctgcctatccctgggtcagactgtgcttctcttatgtgtttaagacaattacagccttttatcatccagctagaatattcattttatgaagttgtaagttgttttattacgaaatgtttttagagacagggtcttgctgtgctgcccaggtggagtgcagtggccatttacaggtgtgtaatagctcactgcagccttgaacccctggcctccagccgtcctcctgccccagccttcctagtagctgagactaagttacttaatttaaaatgtatgtattcatttgtttgtaattcaaaagattcaaaaggtagatgctgaaaagacttcctccagcctttgcccctgccacctgctctcctccaaggcattctccaccctccagttaatgttaccagctcctcctgtatcctgttaatactgtacccaaggtagacattttatactcaggttactcaagtaccgtatgtgagattgtgacacaaatttccataccttacatttgcttaatacttttttttttgagacagattctcactctgttgcccaggctggagagcagtggtgccatctcagctcactgcaacctccgcctcctgcgttcaagcgattctcctgcctcagcctcctgagtagctgggagtgtcccagagaggaacatggaggcttctgttgctgacacagcacagtggaattctcactttctccttatctgctctcttctcagtctgactccagatggaagctcttccctagaaaagccctgtccagaaggagtttgcatagtctatcattttccattttctgttagccacattttttcaagtaaaaaagaaacaggtgttggaagaaaaactttagacaaggccgggtgtggtggctcacgcctgtaatcccagcactttgggaggctgaggtgggtggatcacgaggtcaagaaatcaagaccatcctggccaacatggtgagaccccatctctactaaaaatacaaaaaattagctgggcgtggcggcccatgcctgtagtcccagctactcaggaggctgaggcaggagaattgcttgaacccgggagatggaggttgcagtgagccgagattgtgccactgcactccagcctggagatagagcaagactccatctcaaaaaaaaaaagaaaaaggaaaactttagacaaattgaatttaacagaatttaattgagcaaagaaccatctgagaatcagctcacccttccaaaaaaagggaagtgatgtacggaaaatggaagtgaggtgcagaaacagctggtgtagttacagctcgaagttggcctcctttgaacaaggtttgaaccgttggctgtgattggccgaaactctgtgattggggcatgagtaggttatgtctgttgtaacatccggttaggttgcagttcactatatatgcggaaacctctaggtcaagcttaaaacatgtaaggaggcagctttaggcgaaacttatataggttggtgcaaaagtaattgcagtttttgcccttttaatggcaaaacccacaattttgcacgagcctaataatttaacacaagtaaaattaattttaacaacgtatcttatttaacccaatgtgtctaaagtgttatcatttcaacatgtaaccaatattaaaaattattaatgagctattttgcattttctttttcatactaagcttttggaatcagtgtgtattttacactgacagtacatttccatttgcagtagtcacatttcaaatgcataatagccagatgtagttggtggctgctgtttggtctagcacgggcctagaatttgtcttttcccaatcttgtctccttcaaaaatctttttttttttttggtaattaaaaagtcgatatatcatggttgtacatatttatgaggtccgtgggctattttgatacctgcatacaatgtgtaatgatcaagtcagggcaattgggatatccatcacctcaaacgtttatctttgtgttgggaacattataattcttctcttcttgctattttgaaaatagaataaattgttcactctaattttcctactgtactatcaaatactggaacttactccttctatctaactaatatatttgttcctattaacccaatatctctttgtcctccttctcctcttcccttcccagcctctggtaaccatcattctactctctacctccctgagaccaacttatttagctccagtaagtgtgagaatgtgcgatttgtgttgccctccttcaaaactcttgcctgcaataagagtgagaatgtgcgattagccgtgcatggtggtgcacatctgtagtcccagctacttgggaggctgaggtgggaggatcacctgagttttgggaagtcaaggctgcagtgagctgagattgcatcactgcactccagcctggacaacaaaagcaagaccctttctaaaaataataataataataataatatctttgctatatgaaagaaaaaaaacaagaaaatgggaaaaaaggaaatatacttgacatgaggatagtacatgttttgttggcccttcatttattaagaaggaagatgagtaagtgaaaagaatcctatattccacagttactgactttaggtttcacttttaagttgatacttattctgcaacctctttcagtgaagaaatttaaaattcttatttaaaacgttttctttgtaaatagggagtaaatataataccactaaaattatccagagtggtaaagaaattaactactctagttaagtgaatatttgcgaaattaaattaacattcaaacattacaactttaattttgataattttgaatggaagtatttcgtaatcaattacacatccctgtcttaatattcagagagtattgaatagcatttatacttttcttaggttatttgtggaattgaactacgttatgatgggggcagggagaggtgaataactcatatttattgagtcgctgctctgccaggagatgtgctttgtattatgatagctcttcttatttaacccttagtgtatcccccttcctggttcttagtgtttgaaggaagtcactgtgttttacctaccaggtaggcttatgcacacattgattaggtaggtgatctctccaatctagtaagtcacagagctgggatttgaaccctagtggtttggcgctagaggccatgcttttaacactctgatactaatgtcaacttcaccacaaaactctgcggtagacattatcatccccattttacaggtgtggaaactgaggctcaaaagagttaagtaacacttaacgtcagttggtacatggccaatgtttctttttctttctagaacttttttatattggcccaggcaaggcatttgccagtcaatgaaaccatttctttcatctttctttggttcacttatcctcctttttctttccccagaaaacatcttttataatcatgaggcaatatcggagtgatttggtttcctacattacaaaatatgctctgagataatttggagaaacctggccttttcggagtttatattctaaaaccattgaaaacttttttttttccagagagattggaacaattatcaggtcattaggatgctgtcctacggaaggagagctgcatgatctgattgcagaggtgagtacggcgaaaaggtttcattcagccagctctctgtgtgagagctactccttgtaattaaaaacaatccttaccggaaactaaaaaaaagtgccccaaactactgaatgtgctcagtggaaatattaggataactattcatattagccaaccaacaaaatctgaaagaattgagcagatcttgaagaaatgactatgaacaagtaacacaactgatcaaataaagaacccactgtagaaatgatcctctctgtaaaattagttgaaaagaggccagtagatgcaaggggctgaccgtatgcagaaaggctattgacagagacagtaaggaatttttatttatttggggaaataaaactaacttttagaacaagtagtaaacagaataaaatatcaagaatgaactttacattgaccagagagtctaagaagtttaaaaacgagtcatgtgtaatagtggaggtgaatgatcccataaggcagtggatgagcagcccacgatgagagtgcttcatgctctgtttgactttccagaaaggtctctgatctcatttcaaatgcagcattcggttcaacaacagagactttaagggaaaaaagctacctggccaggagaagaatcttttcagaattgcttatctaggcacaaagattttagtggagtctggggatggcaaaggggataacaggagacaggtgaggaggtggaattttatctctttattttgcacctagcgcagtacctgcttgttcaacattaagttggagagaaggaattgtgaccgtggtgagtcacttaacccctgttgagtgtcagtttctccataataataactacttcaaagtttgcttcaaagataaatgaaagaaggtacaagaatgcatgttttgaatcctaaagcattatgtaaagttaaggaagggaagattagaaagatgagtctgctgcacagatattagcaccttggtgaccaaaaagcagtagcaattttttgaagcatttggaaatattcagtaaaggaatctaagttgtaagaacacattgtttttaccttttgggattcaataaagctatttttaccaagagtaagaggaaaagcttgtttttcctgaattgatgctcacattaaaaaaagatactgattactgccttaaagtgtttctgcacaaagctggaattagtgttagggaaaagcaagctggaagtgtggaagaggtaagaactagaggacgaatttacagcgaaatcatcatcatcacatgctcaggatagtaagtgaagcaataatgaaaaatacctccgaaggtcagaaaaggaggatctctagagtctagtccctttatggtttgtttgtatgttttaatctctatcaggagttagcaaatcatggcccctggccaaatcctgcccaccgcctgtgcatgtaaataaagtttcactgaaacacagctaaactcatttatttgtatattatctatggttgtttcctgactacaagggcagagttcagtagttgccacagagacctacagcttggaaagcttaagatatttaccatctggcctttgcagaaaaaggttgccaactcctgatctatgggcttctgtgccaaagtagaacaaataccacatctagtactagaagatctgagttcaaactccacagctaccacttatagccatgtggccttcaatgagccacttaatccttcaaagcttcgtttcacatctgcaaaaggagtataataacatgaaaatgtttttatgaggattaaatttaataaccgaggaatcaactgttacttggtgggcatgcagtacatacttgagtttgcttgcactgctggtggctctctaggataataatccccactggtttgggcagttagccacagtgggtgcttaggtcctaaagttttattttatttttacccttttttagggacatgacacaacctttgaaaattacagatatttagaatacttatgtaccagtaggggtcactgagctattaagctctgtaaatatttttctatatttgtatacgaacacaatttactctaattaaattctactgataaacagctttgggtataactaccttttaagaacttttccaaataaatgggtgggaaaaaagcacataaaaaaagcacaaatttgaattgataaatacaagtatgtatttgtacatatttaaatacatttaatagtgaatacatgtaaacacatttagaaaatcaaagccccgtaaaagtcaacatctaggggtaaatgtcatattgctaaatgttctataatagtttcagagatcaaactatttaaatgtatgtgtgtatatgctttaaaattgctctataaggctgggcacagcagctcacgcctgcaatcccagcacttggggaggctgaagcaggtggatcactcgaggtcaggagtttgagaccagcctggccaacatggtgaagtcctgtctctactaaaaatagaaaaaatagctgggtgtggtggtacacacttgtaatcccagctagttgggaggctgagggaggaggatcacttgaacctgggaggcagaggttgcaatgagctgaggtcataccactacactccagcctgcgtgacagagcaagactctgtctcaaaaaaacgaacaaacaaaaaatagtcctataaaaagttgaaacctttgtaaaattctctggttgtcatgtacttgaactttagtgtagacacattcttttctctttaatttttataactttcagccctttgcttcctgaagatcaatttcaaatatggtgtttctcttgaaatagatcattttaaaaatcatttaactttgatccatgcagtttatattctataaatagcaacttcctgcaaatactttctgccttttggaatatcacaaaaactggcaactgtgagaaggattagtgaaaaatcttaccgacatataggctaccaaataatccttcttttaatattaagttagcgccttctaggatcttcagggtatgggagctgggaggagataatggcattttcatacaaatggaaaggttatttagaggtctatgtcttctgaagttccaacctaagtggaattatggagaacttcaactaattacaaaggaaaactaaaagatgatttaaaagtaagacctatgtttgtcagattattgactcaggcttaggcactaagcacggattatgactttttattggggtgaccatctgcatcctccccttccccatccttgcccttttttggttgtagatgttaggcagcacctttgttggctccacatctgttttgctcctaagcgtgctatgttctattaaccatctccacctttccccgtgactccctcttcaatctgtctgctcattatatgaggcctcttaacttctgtgctcaaacaactctgcttggcctctgttacctgggtgtaggagagctggctagcaaatcattacatggatttaacaaacccaggtctacaattacctaatctagtcaaccctggcttgcagaagacaccatcacagaacttagtgacaccagtgcctttctcaccagcctgatacccttggtgagcagtgcatctgagccctcccatggaacagaatcctccagtgagtcttctgactcattagatgcccattctgccctcccacttccgtcagcttggtttgccacttcactcagggtttggtgtcgcttgttccaggtctccacttcactcagggtttggtgtcacttgttccaggtctcaccctcgcagcaagggtgccccatctcctagggtccttgccagagtgttaagtctgtgtcctgagaaagtgcctgaagtcgatgaattcttgcttatccagttttatattccagacctcttggtcaagcactctcatccaatctcaggggtactcccctagctcctagttcaggagccaattcctatctaattccttttgcgattttagtgtatagtctttttctttccttattaggcccagcacttcctcagccagattatgctgggatttaacacttcattattgcctggagcagcccattggatggatggccttggctcaaatatgatggctaggatcatcattcaattacatttcctgcaactgtagatttaagaggtgcatttcattgggaggctgaggtgagaggattgcttgagctcaggaatgaggcacaatggtggcccactgctctgcagcctgggtaacagagccagatctcaactcttttttttgagatggagtctgactctgtcgcccgggctggagtgcagtggcacaatctcggctcactgcaacctctgcctcctggcttcaggtgattctcctgcctcagcctcccgagtagctgggggttacaggcacgcaccaccacacccggctaatttttatatttttagtagagacggggtttcaccatgtcggccaggctggtctcgaactcctgacctcaggtgatccgccctcctcggcctcccaaagtgctgggattacaggcgtgaccaaccacgcccggcccagatctcaacttttttttaaaaaaagagaaagaaaattgaattttcatggctgccatagttgtcgtctggaagagctgtaatgcgaatcaggtgttaagtgtccagtagaatatgaccaaaaggagttggctgctctatatattttatttctaaactcactagggcctacccctggctttcaggattagatcaaagcataaaactacttaggaatgaaatgaaggtcctcatcagatccaaggagtggggcaagagtgagcagaaacttgaccagcacatagtaaagataggtcagtgataagaactgggccaggcttatcctggaattctgttcttggatcaaaagaggataccatggcagggagaccatggtaatgatagttcttaacaaaactgtccctttacatatgatggttgacctcgacatctgtgcacagccatcattctgggatctttgtgatatttctgggagtcactgttttccttctgggttggacttctttctatcccaagttttcctctttctagttcctctagcattttaacatattatttgataacttcttgggaaagagtgccttgggggtaaaatttttgagatttgtatgtttgaaagtgattatgctaatctttggctggaaatagaattctacattcaatggatttttcttcattaaatggatttggatttttcaggtcttcagtaagagttctgaaggcactgctcatcttcatgttcctggtaatgctattgagatagtgcaaatccattctggttcccaatcctttgtatataaacattaattttttttttcctgaaactctggacagttttttttccccagagtttgaaatttcacaaagatttacgttggtgtaaacacatatctaatgtgttaggtacctggtgggccttttcaaactagtgacttgtattttttggttccaggaagttttcttgcaattattttgttttcttttttctgttttttggaactcctattattcatttttgtgtttctggactggactagtctttaacattcttcttttttttttttttttttttttttgtatttttagtagagacagggtttttaccatgtttgccaggctggtcttgaacacctgacctcaaatgatctacctgccttggcctcccaaattacaggcgcatgccatcacgcccggctaatttttgtattttcagtagagatggcatttcaccatgttggccaggctggtcttgaacgcctgacctcaagtgatctgcccgcctcggcctcccaaagtgctcggattataggtatgagccaccgcgcccagcctaatattcttatttttcacttattttccatctctgtctctgtgttctctctggtagatttcttgaactttgtcttccaatatttttattgagtttctcatttctgttgtgttttaaatttccagtagcttgtttttgttctttgaatgttcttttttaaatagcatcctgttcttgtttcagatctctgaagataatagtgttactttatttgaagttttcttctctttgcataatctgttttctccaagttgatacctgtgtctgttctggtctttgtttttgttagtagctttcctcagtgtctgataaaccttggctgtcagttcctaacaaacacatgcatggaacttgtcaactttaaacttcatcactgggtaatctgggaatcacccgcatcggagtgttggggatttttctgtcgtgcaggcttgattctttggaatagagtgttcagtcttctgcttgggaggcaaaagcgtctagctgccagttcggacaccttctgtttacactctttagaaggtaaatctcgaaactcctgcagggatggagggcaggcagtcacttagtggggaaaactgagagggaatttacagcttttcaaacatattttaccctagttcccctaattttagttcctggtccctcatcctcatttccagaagcaaccaatgctttttgaggattctttactcactactgtcttgggttcagttttctagatctactagattattgccactcatccatctacttctcagcttccaaaattttattcccattatattttttcctattcttcctaagtaggtgtatgattattttaacaaatgtttctttactgcaattttaataaggtttgagagagagtaaagttagatgcagatatacagtttgcctccttaacacagaagtttcattgatatttgattagtcagaaaatagcaacagtactcctgagaaaagtattaataatgtaaatctagatgagacattgtaatagtctttagaaagagagcattagtaaatgttgggactaaagcactgataattatagcatataagatgtaatacattggagtgaattaagtatgcatgtgtaaatattaagtgtaactacaaaagagtataaagtgaatgcataacttccaaactgatatagaggataaaagaattagagggcattctgtcagtccaaaaagacagaaaagaagcatagaataatcagagtatctagaaaacataagataatggtacttataatcataataggccaggcatggtggctcacacctgtaatcccagcactttgggaggccgaggtgggcggatcataaggtcaggagactgagaccatcctggctaacatggtgaaaccccatctctactaaaagtagaaaaaattagccgggcttggtggcgggcacctgtagtcccagctactcgggaggctgaggcaggagaatggcgtgaacccgggaggcggagcttgcagtgagccgagattgcgccagtgcactccagcctgggtgacagagtgagactccatctcaaaaagaaaaaaaaatcataataaatgcaactggattaaactcaccagtgacaagaaattgaaattggacttctggaaaaatccgatattataatacatcaacacatttctgccatctctaccttcacattataaatttaactttctcatcatttccacatccatcaccttagtccaagccttgtcatttctccatgaatgactgcaatggcatttatttacttatttacttatttttcagacagagtctcactttgtcgcccaggttggagtgcagtggcatgatctcggctcactgcaacctccacctcccaggttcaagtgattctcttgcctcagccacctgagtagctgggattacaggtgccggccaacatgaccacgcctggcccaatacatgcatttttaaatatttgagatggtattcagtccctactcatttcgctaagtgaggaaacccataaacaaatgttacagttttttttatatctgtggtcagtggtttaatgttacatttatagtgttgagacaactatgatgtcaaagtgtgataaatactccccagtaaccagttaaaataatgtaatgacactagtgaatcatttcctacacttttcatcttggatggaaagtatcatactactccaggcataccacaagccccggaggtcccaaatctccatctttcattattcttaattggttaagtatccttggattttttttctttgaaacttcggaattggcttttgagttagtagaacaagatccacgtaatctacaccctggtgaagtgggaatttctatcagcctgtgcctggactctatcattgagcttctggaagagccctgggactttacatcgtttggaatttgactgtatcaagtttctcagagaatgagaaagggtgggagtaattatgttcttattttgaagtagttggtgatatgaaatgttttatctgttattgttcctacacatcctgcctttgggagatgggggagaatggaattgatctgctctaatttttatttatgttagatgctggaatttaattatagagctgatggtactttgcagattagttagtaatggctaccatccagccattacttcgagtagcatcaggtaaatttggggcaatgaggagaatatattgtaaaaagcatatactgagagtattgcttatttgtaattggtaggaaaacatttaacgatgccaaagccatgatcagcagcgggaaaacgtgacccagggaaatcttcaaaagtggttttttctttattagataaataaaacgtgtttttatatagaacagaaacaatcacggcaatagactaataaatacggttttattccagatttcttattgtataggtaatatccagattacaaaaaattttaaataaataggaacttcctttccaacaatgccatcaccttaatataatcattgttaatattttggtacacttccttacatattatttttctgtgtaggtttttaactggactgtaattttttttgttgctatcgtattcttttttttagagactgggtctcactctgttacccaggctggagtactatggcaagatcatagctcactgcagcctggaactcctggactaaagtggtcctctcatctcagccttccaaatagctggtactacaggtatatgccaccactcccagctaattttttttttttttttagagacggggccttgaaatgttgactaggctggtcttgaactcctggcctcaagtgatcctcccacctcagcctcccaaagtgcagggattacaggtgtgagcatgtgagccaccatacctggcagaactataatcttatagtataattcagtaggtaaaattctgaatcttgcttttttccacctaattatatcacaaattatatctccatgttattacaaagctttcattataaaaatgcatgctgattaaattgcacaagaaaaaaaaggaagggaatgatctctcttctgtgcatcactcagacacaaccagaatattttacctttttcactcactattacatcaaaatgatttttcccttctgttatctagtttttagaaaccaacgctttaagaaagaaatcctgttctactataacatggatgaaacttaaggatattatgctaagcaaaacaagctacagttgacccttaaacaacatgggggttcaaggcaccgacccccgtgcagttgaaaatccaagtataattttgcctcccccaaaacttaaactaatagtctaccattgactggaagccatatcaataacatacacaatcaattaacaaagattttgtatgttatatgtattatttactgaattcttacaataaagtaagccagagtaaagaaaatactattaagaaaatcataaggaagcaaaaatatagttactatccaacaagtggaagtgggtcatcataaaggtctcgtcctcattgtcttcacactgagtaggctggggaggacgaggagaggaggggtttggtcttgctgttccagggtaacagaggcagaagaaaatccatggagaagtggacccatggatttcaaacccatgtttgagggtcacctgtagttataagtattaatgcacaaatactgcatgtgaggtatccaaaatagcccaactcctagaaacagaaaatagagcagtagtggccggggaatggcggaggggaaaggggagctgctgttcaatgagtacagaatttcagttttgcaagatgaagacgttctagagagctgttacacaacaatgtacatgtagttaacactgctgtactgtacacttaaaaatggtgaagatgggctgggcatgggggtgcaccccaatagtttcagctactcgggaggctgaggcttgaggattgcttgaagccaggagttcgggaccagcctgggcaacattgtgagaccctgtctctacaaaaaaatttttaaaaattagccaggcttggtggtgtgtgcctatagtcccagctacttgggaagctgagacaggagggtcacttttgcccaggagttcaaggctgtagtgagctatcgtggcaccaccacactccagcctgggcaacagagtaagaccctgtctctaaataaaaaataaaccaataaagtatacagaaggatgtgcataggttatatgcaaataatgtgccattttatatgaggaagttgagtatttgcagattttggtatccatgaggagtccgggaaccaatccaccatggatacagagggacacctatactaatatcattaatattttccatgccaatattctactataataggagtgcaatcgcttcctaatatttaattatatggcaatgaccatattaataaatagaaacataatattccattaaatgaatattccatattacatatccattcatctattggtaaaggttgctaacaatttttaatatcatggatcctgcatgataaacattatttgaataaagtataggcccttttcagatgccagagggccttgtgaagcaagccaaggcagtgatgggttactgaagggttttaaatgagaataacatgatgagatttgcattttattttattttaattcgtatttgtttttattgaaggaggttgtactttagacaaaccagtctgatggtagtaagcagttagattggaataatttatagtcatcctttccctgggtcatatctgacagcttggagccctttgtacattttgggtaattttttcctaaatggttttatttatctcttttattcagtaaaacttaattgccatgtttctatgatgctgtggtcagaatgtatgtgccccttcaaaattcatatgttggagcttaaaccccaatgagatagtattaagaggtggagtcttcagggggcaattaagtcgagagagtagatccctcacgaacgggattagcaatgttataaaagggctggagagaattagctagtttttgcccttgcatccctctgccatgttaggacacagtgctcatcccctctgggggccacagcattcaaggccccatcttggaagcagagaccaggccttcaccagacaccaaggctgctggtaccctgatctgggacttcccaacctccataactgcaagctgttaggtatgctgtttatacattacccagtctaaggtacttcgtcatagcagcacaattggactaagaccgaaattgatcttcgtgggactatttctataacaaatacctgacaatgtggaagtggctttggaactgggggtcaaggctggaagactttgaggtgtatgctagaaaagcctggattgctgtgaacagagcactaatggtgattctgatgagggctcagagaagagatctgtagagagagcctcaatcttcttagagattatctaagtagacaagaacagaatgttggtagaaatatggatggcaaaggcaattctgttgaggtcacagacataaatgagggatgaggtattggaatccggaagaaaggacgtcgttgctataacatggcaaggaacttgtctgaattgtgtccgtgtccatgctttatggaaggcagaacttagaaataatgaaccttggatattgaaattggcaaagagtttctaaaagtggtaagttcctggcattgacacttttgcacattgctaatagcagtagaaaatggtggtattcatactcccttcctggacggcattttagcaatacttatcaataagctaaaaaaaatatacaagctcattgatcagtttctggaggagatactgtatggagaacaaacagaaagattttacttcaaagatgttagtcacacggttgtttgtaacaacaactggaaacaacctgagtgtccattaacacaaaaatggttcaacaaatcttggtctgtctgtggaatggaatgctgtgcagtcattacaagtatgtcgtgaaagactgatgccaccacacacctatgagagtggataaaatccaaagcaccgacaacaacaaatgctgacaagaaagtggagcagcaggaactctccttcaccattggtgaggacagtgcagcactctcttagaaaacgaaacatcctcttaccacataacccagcactcttctccttttatttatgcaaaggaattgaaaatttatggccacacagaaacctgcacacagatgcttatagcagcttcattcataattggcaaaacttggaagcaaccaagatgtcctttagtgggtgaatggataaataaatgtggtacatccagacaatggaatattattcagcactaaaatgagttatcaagccatgaaaattcattgaagaaaccttttttcttttttcttttttttgagacagggtctcactctgtcacccaggctggagtgccagttctcccacctcagcttcccaagcagctggggttacaggcacatgccatgcccagctaatttttaaaaatttttgtagagatgaggtttcgccatgttgcccaagctgagctcaaactcctggcctcaagtgatccacccaccttgccctcccaaagtgtgggattacaggcatgagccaccacgcctggcctcagaggagtttgagggcagtgaaactactctgtgtgatactatcatggtgaagacttgttgttatgcatttgtccacacccattgaatgtacaacaccaaaagcgatatagtttgaatatttgtccccgcccaaatctcatgttaaaatgtaatcctcggtgtcagagatgggacctggtgggaggcgtttgaatcatgggggaagatccctcaggcatggctcgggccgtcccttggtgataaatgacttcacacaagctctgagttcacacaagctctggtcatttaaaactgcgtggctcctccctccgcactctctcttgctcctgttctggccatgtgatgtgcctgttgcctcttcaccttccaccatgattggaagctccctgaggcctcccaagaaaccaagcagatgtcagcaccatgcttcctgtacagcctgcagaactgtgagccaattcaacctcttttctttataaattacccagtctcaagtgtttatagcaatacaagaacagcctaatacaaagaattaaacctaatgaaaactatgaactttgggtaataaagaggtatcaatgtagctctattaattttttttgtttgtttgtttttgagacagagtctcactctgttgcccaggctggagtgcagtggcatgatcttggttcactgtaacctctgcctcccaggttcaagtgtttcttctgcctcagcctcccgagtagctgggactacaggcatgcaccaccacacccagctaatttttgtagttttagtagaggtgtggtttcaccatgttggccaggctggtctcaaactcctggcctcaggtgatctggccacctcggcctcccaaagtgctgggattacaggcatgagctactgcgcccggccagcttcattaatttttaacacatataccactctcgtggggatgctgattgtaggggaggctgaggatggggagagcaatccaggggacggggcgtggcatatgggaactgtctggacattccacttaattttgctgtgacataaaactactcttaacaaactcaaatttattaattaaaaaaagactaatggcttgataagatgttcacagtgttaagtaaataaaaaaagacgctagaattctatttcttgctaaaatatatatatacatgtatatataatacatacacaaatataatatgtggatatagcattgtattaatgaatataaaactaaaacaaagctctccagcactgtatatacagaagtgatctgtagatgacaggatcgaatccctgcgtgatttgtattctttgtgctcgtctctatttttcactgttccacaaagaacatgtattatctctgtaacaagaaaaagaagaaaagaaaactgcattatatcattcaaaaagttgtctagtggtcacaaagacactattgaagatgcatgttgaaagtttgaataaagttggtttttaaaatgcaaaaataaagagcaatatttttaaattaacgtcgttacatacatgatctgaaacatagctgtggacgtagtaaagtttatatatttaacttgaccaaaactcctttaggggattttcttattagggaaaggagggtcactttttgttcatcagtatattcagatatttattgtgttaaccactgctcctttgcttaatcacaaccaagaataaagcttttcctccaatcatattgcaacacaactttaaatcattgtttttggtctgagtggggttgaagagtatcttagtgagatgattgctgcaacacttgctgcaatcaccatctctatcaaatacaataaaactacttggcgtgggagcggcactcacccttaagtagagaaactggaactggagaggatgaaacaattagtgtagctggtgctcctgaagccccaccctcagaggattaaaacagggaaattaatggtctgacaggcactgctgcagcctttcccccatctcttcaaattggagaaactctcggttggaagtgatcttactaagtaccggatttagccacctgttgattcttagactctctggtgattcatctgtttttaacacttgcacttaaataggaaaggaatttataacccagaagactcgtgcagcctcgtggttgcacagcagcctctggaatctttagaataaataatttttctaaagtaagtggctttaaaatttttgtttttaaagacaacatttttggtagatgccaattaattattgtgattttgttctattcaaggtagagaaatattttctaaattgtgtttatgttttggttttgaaacatagtttatgtcaaaatttgtatctatactatttagagcctaatgtgaactatctcatggtttttatattttttactacaaacagtttttaaacattcacatgtgtatctgatttggtgacctggaactagctgaaatgcagatgctttataaaccatcttaactactgacattatcttgttttttgtgaagcatgaaatggttcagtttattgactgattgttatgtcactggggagaaaggaattttcacggtgtgttttattgtgcctatttagtgggttcagcattaaaataaataatgcttttatgagaaaagagatggcctgatgatttctcgatgcaagtggaagttaagaactccaggctgtgatcccgtcaaaacacctgccggaccctgacgccctcagataggcacttaacctctctgtgcctgtatttcctcaaatccaaaatggattaagaaaattgatttagaccaaagtagagtgagaagcacagtatttgccacatgctttgaggctgagataaatgttgatattattaaaaagtcccacagtatttattgagatggctccatattggggaagaggaggagagagactgtggagtgccggaaggcactgtgttagcctccagaatttgggcccctttgtgtggcaatgaaggcagtatattttcttcaggtcacctactccaccttaattctttgcaggaggagaagccaggcgtatcagggccttggttttccaggtgagcatctgctggcacactgttaagatgaattccctgcgaatggtacttttagcaggctacactcgagggatcttctggcaaagacgtttttcctgtacattcacaaacgctgcccggcttacttttaaattattactccacgttagcccttcccatagaagaaacaaactagacttaacttactttgcctcattcatgtttgcagtaacaagatgtatttgttttgtgagttgcttctgtcttttgaagggagggatgtggagtttggtggatatttgttactctcgcctttttttcagtccaaagaggccatgtggggaaacagcagaggtggaggcatcaccgctaacccacatagcctgccctctagacatggggcgaggcaacaagcggggagggagaaggtgttgaatgcgcctagcaattccgtgcgctatcttatttaattgccacattccacgtggcattttacggataggcggcagaggcaaacttctgtataaacaggtgggtctacactgtgggtcggggaggatgtgcctgaaatttcagcaccagcgattgagtcttttaggaaaaagtgccattgcatgtcatagaaccagaagtgtgtacactgctggtacaaatcatcatcatcatcgtcatgattgactctcagagttcacaaagcaccttcatatctcatggaaccttcacaaccatcctttaggttactggtccccctgttagacatgagcatgctgaagctagaggatgaattttaataacattcttaactattattggtctaacatggggaatatattgtgatttttctctgtaagaaaggtaatgtcttttttatttacttttcatacctagtactgtagaacatctgttttttaaaaaagactctgaccaatacagaaagaagtcaagtggattttcccaacacgactttgctttaagtgaagaaatgcaatgactttgtagtcttttcaaacatgtctgatataatatatggaatctttcttgaattcatttcagtataattgagttttctcctggagaaaataggtcccaattgcaccattttttctgcatttctgcatcaactctgtgaaatacatttttttttttggtttgtttgtgtttttttggagacagaatcttgctctggagtgtagtggtgcgatcttggttcactgcaccctccatctcctgggttcaagagatcctcctgcctcagcctcccgagtagctgggactacaggtgcacaccaccatgtccagctaatttttgtatttttagtagagatggggtttcgccgtgttggccaggatggtctcgatctcctgacctcgtgatccgcccaccttagcctcccaaagtgctgggattacaggcgtgaaatacagttctgaattctgaatatctgctctgcttgatgatagtgattcaaacttgatcagacttctgcttgatgatagtgattcaaagtctttggctaaaaatatgtcatatacacttagaatatatgttagttataatgtttgctagagccgctttgatagtgcaccacacagagtggcttaaacaatagaaatttattgtctcacagttctaaaggctgaaagtttaagatcaaggtatcagcatgattaaacatctaccctattcttcttgttcttttttatgacattggaatataccatatttgaaaaatgcattttagaaaaactaatggaatccaaataaagtttggaatttagtgactaataatatattaatattgattcattagttatgacaagtgtaccataataatgtaagagttaacaatagaggaattgtatcacaaatgaaattacaaattatgttacaaagcaaaagtaatcaaaacagtgtggtactggcacaaaaacagtcatatagactattggaacagaatagaaagcctataaatgaagccatgcataaatggccagctaatcctcagcaagagtgccaagaatacacgatagggaaaggatagtgtcttcaatgaatgatgatgggaaaactgttatttacatggagaagaatgaaattggatccgtatctcacaccatacacagaaatcaactcaagctggattaaagatttaaatgtgagacttggagccataaaactagaagaaaacatagggaaaatgctctttgacattggtctgggcaatgattttttggatatgatactaagagcacaggcaacaaaagcaaaaataaacaagtggcactacatcaaactaaaaagtttctgcatgcaaaagaaacaaggagcaacctatggaatgggagaaaatgttgcaaaccatacatttgacaagggattaatattccaatacatataaggaactcagacaactcaattgcaaaaacaaaaacgacctaattaaaaaaaacggaaaaaaggacctgacattttttcaaaggtgatgtacaaatgtccaacaggtatatgaacatcattgttcatcaaggaaatgcaaaccaaaaccacaatgggatgtcacctcacccctattgtaatggctactatcaaaaagacaaaagtgttggtgagggtgtggagaaaaaggaacctgttggtgggagtgtaaattggcacagccactacggaaaacagtacgggggtttctcaagaaactaaaaatagaattaccatatcatccaacaatcccacttatgggtataagtcccaaaagaaataaaatcagaatctctaagagctatctgtattgccatgtttattgcagcattattcacagtagctaagatatggaaacaacgtgtctataaacaaatgagtggatagtatatgtacacacacacacacgtatgtaatggaatattattcagccttaaaaaaggaggtcctgctatttgcaacaacatggatgaacttggaggacattatgctaagtgaaataagccagacacacagaaagacaaatactgcatgatctctgttacattttcaaaagtcaaactcatggaaacagagagtagatgggtagttaaccgggggtgggggtagaggaaatgggaaaatgttggtcaaagagtacaaacttttagtgataagaaaaacaatttctgatgtacagtgtggtaactatggttaataattattctatacttgaaatttactaagagagtagttctcaagtattctcaccacacatacaaaaaaggtaactagtgagtcggtggataagttaattagcctgtgtggtaatcattccacaaggtatatgtatatcaaaacatcgtgtggcacaccttaaatatatgcaatttttatttgtccatcatacctcagtaagactggaaaaaaatagaggaaactgagtgagagaggtatatgggaactctgtattatatttggaacttttctgtatatctaaaactattctaaaatccaaaggttattcaaatataaaatccttttataatataaaatagtgtctatattaaacattccatgaattctgtacttagaattattgtataattttattgtttttaatgccattgcttatacatgtttttgtactcaagaacaaattggatacggcctctagaggacagtgttgggtcatagaaagattttacaatttctgcccaagttgaagatggtcataatcatttttcttcttcttttctaaccacaagtcctgtttattcgttgtccctctgtaaaaacaacaataacaaagaacacttatgacccctctgctgttctgactagttggctgttttgttttaacttattttcgtataattttggttccacaaacatctattaggcaagaaagatctgcggagttggcaccataatgttcacatccctgagggtttgtgaaagttgtgagggaacccggggaagcgatatgaggcgtatattatgtgtcatttgtgagttcttccacgatggagacggaattatagagttgaacttcctttggaaaaacaaaccacggttcgtagcttgatcagggtgcatgtaagctaaagaggggttttggtcttttaaaggttgagactgcctgctctacagtggtttgttggtggtgggaggaaaggaaaaaaaccattgctcttgcttctggagcaaatttctggagtaatcagaatagcaactcaacattttaattttaaaattcctcctccggagataacctcgtaggattgccattgtatttgcccggggctcctgaggtggggagttgcagagtgctgctcaagtgcgtcagagccatatgaacattcacctgcaaaatgctcgccttggacttagaggcagctgaagacaattgttcatgaatggatgggctcagaaattctgaaacacacaattctgtcattgaatgcgctgaattttctgccgagagtggagtctgagggttctaccttgctaggtgtgaatctagtataaacattaaaaaataggagtcatttggatgatggtgtgttccacttagcagcaacctatagtttttcgtttgtttgtttttgctcgaagaataaatctgtccaaagctcatctgctgaattgggatctttgagccttttaataggagtcttgagagggagtggaaaatgtacagctccttatagatagcccgacatgaaagttaaggtcaatggtgttttgttcagccactccatccaagtcgaacccacgggcagggatctgttttgttctcatttactagtgctaagtgccaaacattctctttctcaggtatagtcttctaatttagtggtggtgtgacaaagttctatttaccatataggtacttaatacgtattatgatgatttaagatgtagttggtccttgagatcgtgattggtcccctcagctggtccctcactcaggattccttatctcagggaaaagcatcaccttatcccagtggtataagtcagaatcttgggagtcatccttgaatcctctgttttttccatccttactcataatgaatgcaggaccaggtcctaccaatttcacttcttaaatattttttgaagccatccatttctctctccatggccgccactccaatctaagcccttgtcatatctgcttagactactgaagaagctgcctcaccctcaagcagtgtgctcttccaaaacatgcatctatgagaccgtcactgatttcccattgttctcaggctagcaaccttatcactgtcatggacaagaaggccctgccgtcgggcccctgtctctctttctagcctcatcttgaagccttctccctgctccttgtactccagcctcctagccgccaatgtgtcagcagagagtcttcgcgtattcagtttcctctaggtgactgtctctcccctgctgtctctgtctcattaccttctactcatactctctaaatcagctggagtgttatttcctcatggatgacttccctggtctcctggtctaagaagtgttctttatttttttatttttattttattttattattttatttattttttatttttttatttatctatatatatatattttttgagacggagtctcgctctgtcacgcaggctggaatgcagtggcctgatctcggctcactgcaagctctgcctcctgggttcacgtgattctcctgcctcagcctcctgagtagctgggactacaggcgcccaccaccatgcctggctaattttttgtagttttagtagagacagggtttcaccgtgttagccaggatggtctccatctgctgacctcgtgatccacccacctcggcctcccaaagttctgggattacaggcgtgagccatcgcacccggcaatttttttattttttatttttttattgagatggagtctcgctctgttgcccatactggagtacagtggtgcgatctcggctcactgcaacctccatctcccgggttcaagtggttctcctgcttcagcctcccgtgtagcttggattacaggtgtgcgccactacgcccatataatttttgtatttttagtagagacggggtttcaccatgttggccaagctgatcttgaactcctgacctcaagtaatctgcctgccttggcctcctcaagtgctgggattacaggcgtgagccaccacgcccggccgagtgttctttattggctgttcttacagacccatgctccttcccctcactgtacttacatcagttcacagtgtctttggttgctgtttcttgattaatgtctgtctccctgatcagagtatcagctgtgctccagttgaatgatgaaggtaaatcttaaaaagataaagtaaaggaccatctctgtgagcaggggtcacgcccaagtgtgctcaccatccagagtctctagcacttggcacagtgcttggaacaactagttgctgaatacatttgttgaatgactaaatggctatttacttattgaatgtttaggtagaggaagaagaacccactggatacattcgattcgaaaaatttcttccggtgatgacagaaatactactagaaagaaagtaagtaagtaaatgcaattgttaaggcaaagtaatggtcagaattatgaatccattcatttcaggacgcttggctttttcactttgtgtgttatactcaagcagtgtgtcctaaggtggcctccctctaacctttcaagctacttctgaactggcagttggtacctgcttagaaatatcaaccacactagtgttatcctaagcaaagcataattagagggtaaataagctataaagatcgtaaatcaacattcttagtatcttctgttttgaattatcaatgataaataagaatcctaatatttttctagcaaaaatatagcattagcttaccatagttggttcatcatagaagtcttgtgcccagataaattgatgtccaaaaagctaatagataacctcaaacatgtcagtgattttgcactaaatatttcctgtggggctgaggtattttcaactttcatatccagaaatccaaaaagatttcaatgaggcaagtattatcatcccagtatgttagcagcttttattttattttattttattttattttatttttgagatggactttcgcttttgtcacccaggctggaatgcagtggcaccatcttggctcactgcaacctccacctcctgggttcaagcaattctcctgcctcagcctcccgagtagctgggattacaggcacgtgcatgccaccatgcctggctaatttttgtatttttagtagagacagagtttcactatgttggccaggctggtctcgaactcctgacctcagatgatctgcccacctcagcctcccaaagtgctgggattacaggcatgagccaccatacccagccctattttgttttatgtggtcatttattacggggatccccaaccaccaggccaggtactggtgccagtccctggcctgttaggacccctgggccacacagcaggaggtgagcagcaagagagtgagcattactgcccgaactccgcctcctgtctgagaagcattggcattagattatcataggaatgcgaaccctattgtgaactgtgcgtgttagggatctaagttgcatgctccttatgagaatctaatgcctgatgatctgaggtggagcagtttcatccccaaaccatccctcccctcccctggtctgtggaagaattgtcttccatgaaactggtccctggtgccaaaagggttggagactgctgatttattatgtaaagactgcggtaaataccacggcatttactcattttattgcataattatagatacagaccaattccagaagatgtccttcttcgagcttttgaggtatgtaaactccagcttatatgcatatacatatatataaatacatttatttacatacacacatatatgaaaaatttatcatgtagaacttattcaccaaatgaaaaatataatatctatcttttcttttcccctaggttttagattcagctaaacgtgggtttcttactaaggacgagctgatcaagtatatgactgaagaaggtaagtgtgatttattacttatcacaatgacttatgtgaggaattaataatttgttaacagttatgcgaaagttataggggatactttaaaatcagtcattctggtgaaagttatttactgttcctgctattttggcttggggatggtttctgttctgtgggggttaagaggacaaagagtagggaaaggggagatgggttgttgtctcgtagaattttgtgaagcacagtgattacttctataatttcaggcattgcattcagagcatttccagaataaaagatatgccatctggaaaacatgaactatcgatcactgtaaatgaaggcctcttcctagattgaagatttgaataaagaatataaaaattccgccccccccccggcgccccggcttttttttttttgagacggatccggtcttgctctgtcacccaggctggagtgcagtggcgcgatcttagctcactgcaacctccgcctcctgggttcaagtgattctcctgcctcagcctcccgagtagctgggattacaggcacaggccactgcgcccagctaattttttgtatttttagtagagatgggtttcaccatgttggccaggctggtctcgaacttctgacctcaggtgatccacccatcttggcttcccacagtgctggtaaaaattcccttttaaagagcttttctgtcagtgaagttacagataatgtagcctcaattgaatactgaggtcatttttaacactaaaaatgtccttttttaatgttaattgaaccatatatatttgttttgaacatggcccatcatacatatatgcatacacacacataaaacctgcacacttatatatatatgccaacatatttcctttaggaattctctctgctaggctgatgtgtaaatttgtttacactgaaggtcagtagcctgatggacagtctcctgaaaccatcctcatattggtccccttgccttctcccatacaaagctagagctctctggttcacagactgggtcctgaatgactcagagttgctaatcacttgaggcagaatgaaaagcgcaagtgattttgagtagggaagactaagactgcatctacacgcacaactggtttgaccattccagcttcatccaccttaaggcggaatacagagagtgagggtcagaatggcaaggccgtcacagctgccacccaagaactctgacgccattgttaaaattaccttcgggattaattctgatggggatgttacgactttcaaagcatcagcttcttcatcctgaggattagtctaaagaaagtaaatcctaggttatatatcaggcaacatgaatttagtcaaaatggcccaaacagttagattttcctactgttgtgtgcctactatatgtttaatatttagtaagtgtagtaaggtataatgatacttaaatctacttcctctctcaaggatattacaatcttatttgggaaataaaactaacataaaataattcacaatacaagacaatagaaagctaaatatcagaagatcaactagggctggcccagcctggaaaacttggtttgggaagacttaaagagaaaataggttttttgagatggtagaatgtatatggttaaattgttgagggcaaaggtaaactcttgtgcattataattctgtcacacatggtagatatcaacaaatgtttgttgaatgaatgagtgaatgagtagatgatgaagaccaggtgaaggggctaatgagagggagacattatcgatgtgtaaaacagtctgaacaaaaatggggaggtaggaatgaacatgctatttcagagagaaaataagcctagctggcccagagggtaatgttggcaaacagcaggaaattaacttcagtagacttactgggactaaattgtggagtcccaggctcaggagtttggaattcatcctgtgggcgatggagaagtattacaggcttttgagcagatgactcacatggtgtgtgagtgattgtgagaaggtttttctggtgctggtcggtttgttagatgcataagaaagaggttggactagggaggccacttagaaggttatttcagcattttgagggcacccaaataagggcctgacctggcagtgggaatggcaatgggaagaagggattggtacaataggactgtctgtggcaggatccatgggtcatgatgagtaacagagtgtaggcgacaaagctgagagctgaatccaaagtaccaccaaggctttgccctcgatggcgagtatgatggtaatgagactgactcaaacagaaaggtcagaacagaccgcagtgtatacagagacagtgcgaccacgtggtttacttggaggtgctgtgtgataatttcgaaaatggtatgtttacagagagttcatggtacttaaagatcaactattgagtatctcagcggactaagcataggacaggtatggtcaaataagaatacatatgttttcaattattcactcagcaagtattattacaaaccttccacatatatgaaccaatatgtttggaagtaatatgtaagatgtaaatctatacaaatctaagttacgatttaatataacagacccatcagctaagtgtaatagcagttgactagtttggtaaaataggagcttaagaattgctgctttgagagtctcagaattctacaaattgtttttaagtacatttatgctatataacaatatggattcaagctacttgcacattcatcctaatatccacaaagtatcaaacacactagtttgagaatatgcattcctacagccctggatgtcatatgataaaataaatcacactgaatcaagttcctacaagatagaagtccctaagtgtccaggaatgtgtattgcatcagacagtgtttagcagccgggaagatctcagaacaattttttaaacaaacacttgcatgttgctgcttctatgccaggtactgttctaagtcccattcaaatcataacacgtttcattctcatgacaaccctatgtgacaggtggtgtcgttatcacccccattctagagacaggtaagctaaggtggggagctgtgaagtgacttgctcaagatctcagagctcgtgagaggcagccagcatgtggatccaaacttgtgctttaaccactcagttatcttccttccatctttcatcaaatactggggcttcaagttaatcctctggtaatttcaaaagttttaatctaaataaataaccttgttcatgatgtctgtatgtcttcctactgttttgcctgaaatgacgtgttctagaggttgcttgatctatgacatctgcaggctaaaagaagtccagaatctaccagggtgtacaatagccttgtctttgaacctctggactgtcgtgatgtcctggctctacagctccagggagcgtaactagtggcactgtgggagcttgtggggctccatggctattaagctggctagtggaaagagaaaaaaatcagatgatcctaaatgataaattttcctttttgtctctctgaggtgagcctttttctcaagaggaaatggaagaaatgttgtctgctgcaattgatccagaatcaaattcaattaattacaaggactatataacaatgatggtgatagatgaaaattaaatgttctaaagataatttctgattgaaagaacaattttagaaattgcttgttcttgttaatttcacatcttatcttaggattcctatatgtgatatttaataccttgtgacataactattttaagacactttgtttttaaagatgatcgtaacactttaaaccaaatttagtatgtctagccttacagaatgataaattactatttatttaaaaactattcttaaaacattttaacattagaatggattgttgtttattttctacaataaaactcaggtcaccttcgaattaattaagctgacaaaatgaaaatgacttaattacccaaggtttggcatgtaaagatcttaagagggggcagaacgaaccactcgaaaacgagtagcagtgtaatgaaggcttcttttttaaacaataacaaatgcttcatcaatctgagtgtggaaggtgatttatcaaaataaatattactaatttatttttttatgagtgccaattacaaatatcatttgggataataataacttagtgtaaacatttatatttgctgatccagcatgtcaccatttatggagtagctaaaggagttgagatcattggaactagagaaaagaaggttgagtggaagttgatagtgtaaggtagtggcaattctccctttgtctttagaattctcacccactccgcatatctgtcatgggagcattgtcctgaatactgagtaagaatactgagaaatgttatggtgtgcaaatgtacagctcctgaaagagcagaatgaagcacaagcagtcacaatggaaaaatatatggcatggccactgcctcctccttgcaattctctccgatcttggcatcttatatggcaactatatggcaacttacaagcaaaggggaagataaagtaaagggaagtgaacaattttccaaacttagatattctgttataacaagacacacacacacacacacacacacacacacacacgggtctctatttgaagatggcttcaccactatatgtgtgtatctacatagatgtaaacatttagagttgctgtgagccttcctcaggcatgtagtcttgcccccaaaagaggcggctgctacccaagagactgtcgctgttcattcattcatgaaacactgaaggagtaccatgagatgatgtgctgggaaccggagtccctaacgaatccaggtcacagtttagtgagggaagcctgcaaggcagtcagcagccacatttcagataggggcatgttcagggtcccgtgcaagtgccgaagagaggcagctactcagccttgcagggagagagctttctggaagatgaaaggtgctagtgagcggagaaggcttcccaggacaggaagctcctgactttaaaacgagtagtttagtaagtgggtggcggggcacagggcatttcagcaggtgagcagcaagtccagaaaccctagaggtgtcatgaaacatggaaccacctgggaattgaaagcagctcagtatatttggaatgtgggagatttgggggtcatgatgagaggtgaaattggagtggtaaacaggagcggtatcattaaggatatcgggttaggtgctgagttaaggtttcagtgtgagagtttggactttattctgaagatcacagagaaagatcatttgtaagcagcatggaaaatagatttgaaaggtcaagactagaagtgagaccagtttgtaggctatttggttggtgggaggggatagactgggaaaagtcaagcatgaatcccaggtttctggctcggacgatgggtaaaagtgccattcattcagataagaagtccaaggagcaagtggggcatttggtaagcaaaatgatgaggttgggtgcagacaccttgggacacccaaagggtgacattcaataatcaattggatataggagggagatctggctggagacctggattttggaactgtcagcatgtaagtagtattaatgccttgaaagtagaagagaagacagtctagaacaaaaccatgggggatatcagcatttacgggaaggcagaggaagaagagcccacaaaagagactgggaaggagaagcctgagaagagggaaagctggaaagaagcatcttggatgccaagatcggagagaattgcaaggaggaggcagtggccatgccagatgtagtggagaggagagggaagttaaagacggaaaaaacgtccattggtgttagcaatggagagttcattgagggcctctcccacagcagatgtggggaagcaacagggtatggagttgagtggatggagtaaggaatggatgtgagaaggttgcagcctggaggacaagttattcggcagtgaagaggaggaaacggacaacaggctcggggagtgatttttggaagatgggtggatgtagcaagttcatttctagtccaagggctgagagcccacagagaaggtgaagggaggggccagcttccagagcaataaagagatttaggaacaatgaaccaacgcttgtggtccctacctcatggcctctgctgccttttggagaggaaggtagtaggttatagagtttcaagagaatggtgtaattttggaatatctcttgtgggaaatgggagaaagagttgagaaagagcccatgtaaggattttcaagaaaccctggaagattttgtgctcaggagcaaaaaagaaaagaaaaaggtagattgttgtaccagggttaaggttttgtcatgtgcgtgaggtggaaggaatcaaaggccgaggaatctgggagaaagcagttccgatggtgtccgtggggctaacgcatgagggaaagacccaggtaggaggagtgggtaacaggtaggaggagtgggtgacagatgggagggggtgagagggctcggggccctaaaagggcaagtggctggtgttggtagcaaggggtggtctttcctgcctgagtgataattcctgagtgataatatgtttcccttgaaatttcgcttcgatgtgttcttagagtgtttcttttcttctcctgtgttattatgtgaataaatagtaagagtggctgacgtttgttgactgttccctgcgttgcaggcactgtcctaagtgcttgacgtacatgaactcatttcatcctcacatccacccatcggtgcaggtgctattaagttatccccattttagaaaggtgacaatcaagaagttacacagcagtaagtggctgtatcagctttttctaggttatattgtgataacaaaactcccacgtgtcagaggtttgcaagaatgaagcttatttctgtttacgttttttttttttggtcagctggggtcatcctggactctggcctacgtgtctttgtcctactcatggcctagagaggtaggatgaccgtctgtcctgctttgcccgtggtagttccagactatacctgtcccagtgtaattattaataggtctcctttgtactcttagaaatgttccagtttagatgattaatatgtggtcatcccattcaaaaaatagtgagtaaaaacggtggtgaggaatcgtcacttctggaaggcttcctgacagataattccagcagtggtaagaatggaaggcatttcttccttctctagtttcccaagatcatttttttccccaggataacctgagattttcccaaggtaaaatccaaatagagacctgatgtgccactggctcggccgtgcatgctagaatcaccagccagagatgaggatgaaccgcgtgccttcaggacagggcggagacggaggaggaaaggagtgtggtgatcctcggaacatcagcagacaggctgttgatgataggaacacattgcagcggggaaggaggatggctgagatatgaaatacccttcaaggtggacgcatacccaggggcatgtcattcggtggcaggggccagcacggacatgcagcactgaggcgtgtgctagcgcccagtgcgtcgacccaggcacggacttgtttggagcatacaggacagctctgcgttaagacctgtaagccattaaagaagtacagtctggtgaatgaaccctaatctcttgatgatcaagtgatgacatcatattctgtctccgaggagacaccctcttgcacagaaggcagtagaggaagcttgcgtcgagattgcctacctccccagccccaccttcgagggttctttcaaaagttcggactgatgttcaacttcacatcttgtctcaaggcaatcctctctgtttagtctcatagagttggctttgtggaatgtaattcatttttatctttagcacaaatttgtctgtttcttttaaggccaccagaaagcacaacatagactccccacagaaatctcattttatctcctaagttgcagaataaacgtaccttgtttgcaaagggaacattttcctttacactcaaatcacttcaatgtgtattttgcctcttcagctcactgacctcgcccgcagcatctgatgtaagtcaccatatgccatttcccgactaggagagtgcttggcctcttgtgcaggaagtttgcttaccctcatgactcctggcttccgcagagcctgccataccccacagcttggccgggccctgtggaaagccatctctattctcacactgctggggaaggtgcatgactcaggacccgacacacaggcctgagagtctggcgatcttgtgctctgatcccagcttcatgtgtgactcactctggatcaggcgcttcacttcctgtgcacctctgtctgtaaaatagagagcccagctctagtccttctccctcctgagaagcaatgcagagatttagtcccctttgcagtcacccagtgtctaagtaccaaatgcccaagagacaaaaaagagtccaagatagcaggctagttgggattacgactgttcgttaagggcaggagtattttctgtgggatggaatgtgtttagatctctctctcctagtttcctgtcttccttcctttcgcttttctaaatccttccatgtaagaaagtaccctgtttatacagacagttccttgaagatcagtgtcactaccttaccctcctgggctgcttaaataaacggagagcctcatgggtgccaggcatggtggctgcctcctaggcctgcctatttctgaaagcatggttgccaatcatctgcttcaggagcatctggaaggagggtgttagaaatgggaggtgtgccccattccagacccctgaaacagaatctctggaggtagggtccaggaaacttatatttttaatattctcaggggatccttatgcacgcttgtgtgtaaaaagcactacctggggctctgatattgaatgaaagtgtgggatttggagttaggctctgctgcttactgattacgtaattggcccagacatttaatattgctgagcttccccggaggtcgaggctacagtgagccatgattgtaccactgcactcagcctgggtgacagagagagaccttgtctcaaaaaaataaaaaaatattgctgagcttctgcatcttaatttgtaaagtggaaaaaacacttttcggggctggtgtgaaaattaaatgaaataataaaagtgaaaatgtttaaaaagctgtaagctatgacacaaataattatttacagaaagccagctaggcagagagggagagagaaaaagagagagggaggggcagggatggagatctgctgcctgggtgtggacagggaggtggggaagtaggtaaataatagaaaactaattggagagaacgtgcgcatacctgggctgctggtggggagatagccgaggtttgctgtcatggtgctattaattataaggcgttaagtttatttctagaatgtgaaaacaggaggccttaagaggtttctttttttcttcttttaaaaatgtgctatcagtcatggtacttttagagcagcaggaattatttacctcatctagtggagaaaacactcttaatcatttgaagaaactgttatttttcttaaaaaagaaaaatcaggccaagcacagtggctcatgcctgtaatcccagcactttgggaggctgaggtgagcggttcacttaaggtcaggagtatgagaccagcccaggcaacatggtgaaaccccgtctccacaaaagtacaaaaattagccaggcgtggtggtgcacttataatcccagctactcgggaggctgaggcaggagaattgcttgaacccgggagatagaggttgcagtgagccgagatggtgccactgcactccagcctgggcgacagagcaagactccatctcacaaaaaaaaaaaaaaagaaagaaaaagaaaagaaaagaaaaatcacaagttgaaaaattgaggccaaacctagttctgtggagaaggagataagataaaatagcacactatgaaaatcgggccatggttttatatgtgtggcaggtcaaaatgccaaatatatcttgctggctccccccacacgccccggcattaagttttcagctattagtaagaaatctcaaaagaggcttctaagcatttatcaccaaacttaggaaatgtactgaagtataggtgagtattgcatgactttaaatacagcttttaaacatgtcaagatgtgtttccatgctctgaatgcctagttttaaactgtcttgctggctggtaaccattcctggttactaactcaaggtatgatccgcacttaggcaaagctcactgttaatgagaatagaggtaagtctattttccaactagtcttgataatgtttaagttttcttagttcttctttatcaaatccgattagcctgtctttgttcttacacaacatgatgaagagctcatcctggtggaattgtcggccccactgttctcggaaaacccccctgtgcttaggtgttgggatatcttcaattcgaggttactttttaggaactttttaagcctcttatcagtttttgaggactggtgtcattaaaaccaaataacatctgcaaatccttcactcagttggccacctgtacggttagtgattgcacggaaataagcaaggtggaatgagtacacgagcgaaggctccccgagcttccttcaggacagccgcctgccttcctgatacgtgcattcctggtacatgcatttctgctgtatggaccccaggaagatgtcaatgagatttaactctaacacagaacataaatataaattaaaacaaatcctggttttcttcctgcaccctgaggagttatcttgcgttccctgcaggggcacctcactgtgagatggctacgttagagaatcttctcaggaagggctcttttggaaaaacaatgtaaagtgtaaaatactctaaaaattactagagtggctcccaagcaataaagagaaattggaaaatgccagtaaacaaaaaagaagaggaaaaccccttaattccacagaagttaaccaccattactaatgctttgcttcatctcttctgaaagctttttccaaggatgtgtctctctatagaacttctttagaataatatcactgtggaacctatcagttagggtccttgaccataaggacagaaagcaggactcactggaaggcacctgggctgaggaaagagtgctcacagagcctactggagactggggcaccaggctcaggccaacaggagccaagggggcatctgagggcaaggaagcatggtgcaagaggatagcaaacatcacacaaccggaacagcccgtgcagggccgctgctgcaggggatggctttgcactggctcaggttcaaggcctgcaagacacagcccactgagctgagctccgtctggcctgggcaggcaaggaaggaccttgcttctaggcagccatgtggaaggcaggaatcctccaaccaccagctacaccccgctggagggagaaaatactctggtgagaaatcagggtactattggggaagagaaataaataaataataaacacgacaatactacaggatcagaccatatatgctattatgtaatctgctattttaaatgaatacataaggaacaatctttccatgatagtgtgtactcacctaaaacataactttgagtgactggatagtatcttattgtttggagataccttaattaattaattaatttagagacaggtctcactgtgtcaccctggctggagtgcagaggcacgatcatagctcactccagcctcgaactcctggcctcaagcaatcctcccaccttggcctcccaaagaaccgggattagagccaccacacctggcctatttaattagttcctcatacttcataatttaaataattttcagttttcactattataataaattgtgaccaatatcctagtagttaaatcttaatttaattgttcacttagaatacattccgaaaagcagaactgttgggtcacctttaaagtgatggggacctatttttaagtcttttgctaatgtgttttcaatctgtcctgcagaaagattgttcccacattctaaaccctcctcagcatatttttgctttttattttgcaattagatagggaaaaatagtatctcattgatcttttaaaaatttgcattccattgataagtggagctttctaaaggcccacagcaatgtactgaaagattcaattggattagctccaggaagcaccaaattggagcctcacagattgttttttcagatagaaacaacaaacccctcggctgctatgaaatggagcccacaaagcacaacatgacagacagaatctgaattccagagacacagtttctttcagaacaaatattatttgcaggaggcaattagaatgagccactattgcacagtagacttagcaggaaatgcacaaatattcaagcaacaaaataggaactggggaaataagcctgcaaaagaagtgaagaatgtccaacacaggcgggacgaggggccaactggcctcccgcgctcacaccaaaatgccagcttcttaggctgtgacagtgtttcctaatgcaattcatttgctcattcagtcagcattcattggattctcaccatgtgccagacactgtgctgggtaccagagatgccaaaatgagtatgaaacatagcccttgtccttgagagatttcagcctcatgggagagacaggaagaccaataatgacactgagcaagagttgttcagcaatgttagcaaagtgcattggggtcaatgacagcagctggctctgcctgtgggactcacagaggacttcatagaggaagtggcaggatgaactgcaaatgttttatgtgttcacattggcaattctgctgccaatactggggggtgagaatgttctagaatgagatggcttgaggctaatgctgaagtagctttttaatagcatggcttagggaaaagagtgctgaattccagctgtgtcaggtataggatatgtgacctggggaaagtcacgtgatgtgtctgtcctctgttgcccatctgtaagtgacagaaatcatagctaccttgtaggcttactctgagcatgatgggctgtctgcacacagggcttagtaagtggtatctgtcattacaaagtgttcagtaaatatctgctgaatgaatgaatataaatattttctctatatagtaaatatcttcaattatataacgaggttgggtacaggtatttataggatgtccgggagtagggaagtccattttcctaaacttgtgacctcagggacttcatggaaagggtgtacatgtcattttaacttcattcattcaataaaatatttaattagtgatattctatgctagaaacaattctagtaaactggtcgggtgtggtggctcacgcctgtaatcctagcactttgggaggccaaggtgggtggatcacttgaggtcaggagttcgagaccagcttgggcaacatggcaaaaccccatctctaaaaatgcaaaaattagctgggcatggtggcgggcgcctgtagtcccagctacttggaaggctgaggcaggagaattgcttcaacccaggaggcagaggctgcagtgagctgagattatgccactgtactccagcctgggagacaaagcaagattccctctcaaaaaaaaaaaaagaaagaaagaaagaaaagaaacagcgctagcaaacaaaacaaagtccctgtccttaaggaacttgaattctggctgtgaggttgacagtaggaggcagataatacatcaataaacatatgtcatgtcgggattaacactatgaagaaaaatgaagcaggataaggggtgagagtgatggggtactgtcctatctagaatgacatggaagtcccctctaaggaggggatcttgagcagtggcctgaaggaaatgaaggggcatggggaaagggcattccttgtagaggaacatcaagcaccacgtgtttggcagccagcaggatcagcaaggagcaccccaggcctttgtggcctgagtgaagagagagaagcagatgaggacggagaggtgggcagggccccgagcatgaagggccttgtgggccaggaaaggatttggagctaaatgtggagagaagaagagatgccattgaatggtgctgagccagttaggggacattaccagggagatggtgtctcaggccggggagataatggtggatagtgaaaggcggttggatttgggatctatttggaaggtagaagcaacaggatttcccagtggatgggatggaagtagagaaaaagacaccaagaatgatcacaaggtttaggtctcagcaacgacatactattcgttaaggttgagggggaagatcgagagtgtggtttgagacgtgttcccactgagaagccaaccagacatccaggctgtctatataagtctggagctccggagagcctggggttggagtggtcagtgcaccgaagatgtttaaaaccgtggggctggatgggatcccctaaagagggagggtgagtagggaagagaagggctccgagggctgaacctgggggcaacccaaagttagagatagggaaggagaaagatcagcaaaagatacaaggcaaacatagtatcagggcaatcccaggtcctattccgtcccccatcctgtgtccccagggcctccatcacccagttgtttctcttcagtgtccttcggagtccctgaggcaagctggactcacatagactagaaaattctagtgtattttgtgtgcaacccagtggtagcgccgcgtttttcagttgctttgaaatctacgaatatcccttctcatcacagtccgagtgaactgtcctgatgctgtggtttctcagtgtctctgaaattcttgtgaccttcagtcctgaggaccattcttctctgagtagggaggccgggggtcaaggccgggcctgactgccattgttctgactgcagaactgaacggagttcgatccagcggagcccgtgtggcggctgtcgaaagtaagcccttcacaaaaatggtgtgcctaaaggtaactgcagaggcactggggttcttaattttaaactatcagaaaagaatgaacgggcaacatgtgatcctcaggtgtgaaatgcaaccatcacacccttgtcccagaaacaccgtttcattttttctaaatcaagtgtgactccagtcccttactggccagtcataataagaggaggcctgggggtttatgtggtgcctctgaaacctaacaatacggaccaagaacatgacaactgttgaacaccaaaactggctccgtcacctacatcatcgcctgagcagccctgtcccctccccagtccactgctccggaaactggaatgacccttgtgaggaaaccagtgagaagcttgagcagttctctcaagggggggctttttcaacagattgttgaagggactatatcgacatgacgtttggcaaaagcccatagtgagactagaggagagaaagctgagtgacagccagaccctaggacaagggaagttcttccctccagtttgcccgccagccaacagcacagccaccagccctgcccacccttctgatgctgggacgcagccccgccctgccccgacaccaggccacaggccacaggccctgtcaacagccttcccattcctggcccagagaccctacctgctctctccagacagttcagctgtttgttcatgcaaagcctttctgaaaacaaaggcctattaattctgccccgtttgcaagtgaagccccagttctgtgggactcaaagcacacgctgatcgcttgagggggtggtgagaagacgatgtgaggaaggatgacttatttttttctcttttaacagcagaaggaaaaaacaaaaaatagtaactccataaatcatcctgccaggcagagaggaatctcccatttttaagctacaatacacgtttttgtaaaatgttttactatagagagttagtagacaatggtacagtgtatctccatgtaacatcaccctccccgccggccatcaactcgaggccaatcctgtccccatctccagaggtcacctccctcataattttgaagcaaatgtaaggcattattttattttattcataatttttttcagtaggtatatttaaaagatacttaaaaataaaggctcttaaaaattacctataatactataatcgtccctttaaaataatgatggtttggccgggcacggtggctcacgcctgtaatcccagcactttgggaggccgaggcgggtggatcacctgaggtcaggagttcgagaccagcctgaccaatatggtgaaacccagtctctactaaaaatacaaaaattagctggacatagcggcatgtgcctgtggtcccagctactcgggatgctgagacaggagaattgcttgaaccccggaggcggaggttgcagtgagccaagatcatgccactgcactccagcctgggtgacagagtgagactccatctcaaaagtagtagtaataataataataataattgtttaatgttatcatatatccagtgtcgaaaagatcagttttcccgtaaatgaataaatgaccttaaaaaaatactatacagaggcctggcacagtggcttatgcctgtaatctcagcactttgagaggctgaggctggtggattgcctcagctcaggagttcgagaccagcctgggcaacatggtgaaaccctgtctctaccaaaaatacaaaaattagccaggtgtggtggtgcacgcctgtagtcccagctactcagggggctgagtcaggaggatcacctgatccttgggaggttgaggctgcagtgaacagtgatcggtctactgcactccagcctgggcaatagagtgagaccctgtctcaacaaaataaataataataataataataataataaatacttcacagtttgaattaggagtcaagattcaaactgtgaatcttgtgattggctaacatgggttttttgtttgtttgttttttgagatggaattttgctctgtcacccaggctggagtgcaatggcgcaatcttggctcactgcaacctccgcctcccgggttccagcgattctcctgcctcagcctcccaagttgctgggattacaggcacccaccaccacgcccgactaacttttgtatttttagcagagatggggtttcaccatgttggccaggctggtctcgaactcctgacctcaggtgatccacctgcctcggcctcccaaagcgctgggattacaggcatgagccacggcgcctggcctggctaacatgtttttaaagtttcttttaatgtgtagtttttactcccaatctttcttttatccttgcagtttaattattggaggaaccaacttgtttgtcctgtagaatttcccacatcctggttttgctggttgcatcatcatggtatatataattaatgtatttgtctgtcttctctacttgataaattggcaattggatctagagcaaattcaggtttgatttggcgggaccagattactttacaggtgttgtatccttctatcaggaagtacatgatatctgattgtctctctatgacgtcagtactattgttgatgaacactaggtctatattaatacattatggactgcaaaatggtgataatctaattctatcattcttcatttactagtatttccttgatttataagtattttcctttatcagttttcaatattttcaaggtttctcaatattccttaacagcaaccaagtagtttttaaaattattttttaaaattgatacataatagatgtacatgctttcagggtacatgtgataatttaatatatttatatcaagtattttttgctttttagtattataataaagtcatgaatatttggtatatttcaatccattgtcgtcattattcttattgatgttcacagtatcccatttttgaacagtgggagctgcttcaggttggattctaaaagcttcctggatatatggcataagacgatttaggttcatcttgtacctattggtttccaatgacgttatcaatcttttgtgacacgagatcagggccaacagtgggtttttgctaatgatgtgttattaggcaataagtagaggaagagtttggtttgtgttagagatttacagatcattttacttgcttttgcaccgtgcttctacacaatagtgcacagacacacaactcactggttaaatggagaccacagaaatctctgggacactttatgagcagcctaatatctcctgattctacaagctagattggagaatgcgtctggagcctgaggccaaactgtggtcctactagttctcaaatcaagacaggattcacctgtggggaaaacgatgtgtacagaacctctgaatccattgtaataatcagtgtcattaggaactttatttatttatttatttatttatttatttatttttgagatggagtctcattctgtcgcccaggctggagtggaattatgtgatctcagctcactgcagcctccacctcctaggttcaagcgatcctcctgcctcagcctcccaagtagttgggactccaggcatgcactagcactcctggctagtttttgtatctttagtagagacggggtttcgccatgatggccaggctggtctcaaactcctgacctcaggtgatccacccgccttggcctcccaaagtgctgggattacaggcgtcagccactgcacccggccacttttaaatcccagtggcaggagtacttatagatttgccttaaattcccatttgttgggagaacaaaaaacatacaaaacagagtaggaggcaggtccaatacagactttcgaaaagtgataaaatgtggtaaaagcaaagcttcacacatccaatcagatgtcttcctcataagggaaagaacaagtaaccagctggagaggcccagcattgtttatttcagtcctccaccctgtgaggctgacgaggatgagaggtggtcctctatggtcaggaggggggaccagagaggccaagcattgtttatttcagtcctccaccctgtgaggctgaggaggatgagaggtggtcctctatggtcaggaggggggaccagagaggccaagcattgtttatttcagtcctccaccctgtgaggctgacgaggatgagaggtggtcctctatggtcaggagggagaccagagaggccaagcattgtttatttcagtcctccaccctgtgaggctgacgaggatcagaggtggtcctctatggtcaggagggagaccagagaggccaagcattgtttatttcagtcctccaccctgtgaggctgaggaggatcagaggtggtcctctatggtcaggaggggggaccagagaggccaagcattgtttatttcagtcctccaccctgtgaggctgaggaggatcagaggtggtcctctatggtcaggagggagaccagagaggccaagcattgtttatttcagtcctccaccctgtgaggctgaggaggatcagaggtggtcctctatggtcaggaggggggaccagagaggccaagcattgtttatttcagtcctccaccctgtgaggctgaggaggatcagaggtggtcctctatggtcaggagggagaccagagaggccaagcattgtttatttcagtcctccaccctgtgaggctgaggaggatcagaggtggtcctctatggtcaggaggggggaccagagaggccaagcattgtttatttcagtcctccaccctgtgaggctgacgaggatcagaggtggtcctctgtggtcaggagaggggaccggaggagggtggtctgggaagcactgcttgactcagagcttcctagtaccaagcactggatccactaaagaaaaggtggggagaggaagagtggctgcttgtggagtgggctatggctggaaactggtgagaaggtgatgacaaaagaaggcccattctcggtctaaaatctgtaaacaagatcctaagaagggagagtgggcttagggataagacagagtaaaaagaggcggggaagttgcagacggaatacgccgagccagcgacaatgactgggtggttcaaactttctttcctgggacagtggaaataagaagaggtgctcactttgatggggatgtggggatataggagaagagcctgtggatggagcacaaccaaactgaggttattgtgcagctggttttgcaagacactgatcaccagcataggtgattaaaaaaggactttctattaagaaatgttaacccttaaagagtaggatcaatgggccgggtgtggtggctcaggcctgtaatcccagcaccttgggaggcccaggcgggcagatcacctgaggttaggagtttgagaacagcctgaccaacatggcaaaacctcgtctctactaaaaatacaaagagcagccgggtgtggtggcgcatgcctgtaatcccagctactcgggcagctgaggcaggagaatcacttgaacctgggaggcggaggttccagtgagcggagattgcgccactgcactccagcctgggggacagatcgagactctgtcataaaaaaaaaaaaaaagaaaagaaaaaagaataggctaaatggacccccgtgtatttattaggcattgccattaacatatggccaatcttgcttcacctattctccctcaacagtttccctcacctccatcctcacccctgctcgttatttcaaaacaaattctagacatcacatcatttcacctataaatgctttgatgttatctttaccagaaaaggtagagataaggacctccttccccttttccccacacaaccattaaaccacgatcatatcttaaaaagctaacaataattctgtaatgtccgatatgcaatactttcaaatttccgctcttgtctcataaatatgcttttaccattggtttattccaatcaggatccaaacaaggtcctcgtgttgcatttggttgatgcgtatctaaatctttaactttccctccccttttgttcttgtctttcatttgttgaagagcctggtctttggtcctgtagaattgtccgcacgttggacttgtccgattgcatttctgtggttgtgtttaacacgtccctctattccctgtatttcccgtagaccaatttttatatctagaggctcgatcaatgtcaagttcagttttgtttttgttttttctttccttgcaaatcaacttcattggaagtggtgaatttttattgccttccttcaggaggtaacataatgtctggattgtctctttttgtcactcctcatactcagtagctgtcagcctgatctaggctgtatgaagctctccatcaacctgtcacctaatggttgccattaacattattttagtaggagttgcaaaatggtgatttttttttaaaaagattctatcattccttcttcatttatgcagtggaattcctctattaaagataattttctgaagaccagcctgggcaacatggagaaagcccatctctactaaaaatagaaaaattagccaggcatggtggtgtgtgcctgtagtcccagctactcagggggctcagggctcagggagtataacctgagcccaggacatggcggttgcagtgagccatgatcacaccattgcgcttcagcctgggccacagagcaagaccccatctcaaaaaaaaaaaaaaaacaaaaaacaaaaacaaaaacccaagataatattctgccatcaactattcggcttctttgaaatactgtttgttcagaaaaggcacagcagtttgcttcttttctttaatttttcaagcaaaatatttcttgatttctcttgaaaacatgcatttttggctggatgctgtggctcacgcccataatcccaacactttgggaggccaaggcaggaagttcacctgaggccaggagtttgagagacgcctgggcaacaaagtgagaccccatctctacaaaaatttttaaaaaattagctgggtatggtggcacatgcctgtagtcccagctactgaggaggccgaggcaggaggatcacttgagcccaggagttcgaggctgcagtattgcactccagcctggacaacagagcaagaccctgtctctggaaaacaaacagaaatatgcattttactttcgtaagtgtgtgtgtgtcataggtgggccttaaaattgcctgtatcccttatgagacgtataagcctccctttggcttgtgtgctagccaaaccacacttggtaacattcttcttcccttattagtttctggtgatttacagtgtttgcattagcagttacactgctctttctgtcacagtgaatctctctgggaggaagtgaagtgtttggacttgatttaatgaagctatcacagactgataaaacaggtttcaaatatcatagggttataaggaaaaagatgatttagaataattatttagataaatgataacagtacaccatgaattccataataattctgaatataactcttccctatgttaaataattaacatttacaaccatttaaatatatttcaatatttaatatatttaaattgtatatttaaaataatgtatatttaaaaataagaaaaatgttcacacaactcaaacttgcaccttgttatatctatgtttcttccattttaaattttgtcattcatcgatatgaactggttaccaataaatttggatttgtaagctaggtagaaagttggggaaatttctgcaggaataaccaggattaaccagataatttcaagattttcttgatctaggaattaagaattcatatgatatggtggcctggtgcagtggttcacccctgtaatctcagcactttgggaggctgaggctgacggatcacctgaggtgtttgagaccagcctggctggccaacatggcaaaaccccgtctctactaaaaatacaaaaattagctgggtgtggtggcgggtgcctgtaatcccagccactcgggaggctgaggcaggagaatcgctggaacccgggaggcggaggttgcagtgagccaagattgcgccattgcactccagcctgggtgacaagagtgaaactctgtctcaacacaaacaaaacaaaaaacaaacaaaaaggaattcatatgacatgggaactagaactatttccaaacagttgtaatccgattccaaagaaaccctgcacttctggtttcctgatgatgtcacccacataaatggctacgtcaaggagtcggtcctgagagcagcgaggcaggagtgaggtcgagtgggcaggcgtgagagccgagcacaggggcagaaaggaagactctgcacccagaaagcggaaaggaggcaagtgggggacaggggtggggtcactggcccaggcactatgggactgcacatcgcacacaacactaacttcccttaataaacactaagttaatctttacaactcttcagcaaggccgtgcaccccgggtccttctgttctgatcggaggacctcgcctcttattcagcagagagcgtagaacctttggcctctaacaccgccaaatctccctttcacagaccaactggcatctaagagctctaggggcagaagtgccgctgtggggcactgatggggcagggactgtggcgcaggtcacctcctgcctttgctgtctgacgcagcctcccagggctgcttgcatttggcaggggctcctcctccacgctgccctctcctggttctcagtcctgctcggtttccaggcaatcacagccccctgtgcaccactccaggcaccgggctcctaaagcagcccctttttcagagctaccctttagttggtgacactctccactaccaaccccagcccagcccagattccctccaagcacagttgtgctgggcacaatagtcatcatctctaagcttacctgtgatttcatccatcctcacctcgtcaccgctctcagaagctccgcgtcctcctggaggctaactcctcctctgctgttgttcccactccgggctacctcctcactgcccttcctccaccagagattccctccatgctctccccttgactttgtcaccatccctgtgcttatcgctttcagaccacagtcttagtcaagtccaccccgtcttttcaaagaacaccttcctttcctttagacgtctctccccgtcacccacccgtcacccagtctctctttccctccctccaccgccaagcattctgaagaaatgttcccctcaccctgagcttgctgcccctcccttccatttcccagcctcctgcagtctcactctgtctccagtacttactgagactgctgaggtcctcagcgacatgcccattgccaatcccagcagcctgtgtccagttcttcacgttttttgaattcactgcaacattgaatgcttgccagtgatgcctccttgctgaaattcttccttggatgaaaagacacattgtttccgggttatcccttttctctttgactattgcttctatgtcttactgaggcctctttctatttccacccttaaccattagtgttcccaggattctagcctcagctcaacttctttcatctctcccagtagcctcattcatccccgtgaccccagctacacttgcaaggactcccagatccaaacctttgatccagcctttcactgagacattctccagctgaatgttgtgctggtctctcatatgcagcagagtctattcctcctcctctcagctctcttttctgtccaacctagaccacaggcatcagtctctaggacttgcctcagcgtctctggggtccctccttccactctactcctataatacgagatgattccagccctcatcccctccttccttgacagttgccatagcctcctaactctgcctctaggctcagccccatccgatccattattcctctgcttttagaagtatttttctaaatagatatggccatggcttgtacctcagtatgggttttgtcaaaagcagaacctgaaacgaggattctggtgtagttgttgtatttgggaggaaacaatagtatgtgagtagggaaggaagacaggaaagggaagcaggccagtaaagggtgtgttgtcgagccagttacctctgcacgtaactggagctgaatcttgctgggcaactctaggagtctcgtagaatacatgcctcagagatatcctgcctgaggggcgagagagctcggttatttatactccgactctcatcaggcaatgagaggtgtcaattctgtagcagttcattcccctcctgcatgtacttggaggcagggggctcatgaaccccttaggcagtagaagtcaagccagctattgcaatggaaaggctcaaagggctagagaggggcacagatggaaggacagggacaatctctgtctcattaccctcctgcttaataatccccagaggtccccactgcccacagctggcctttctggcctcctcccctgcactgcttccctccattcacacaagggttctgaggtctttcctgaagaagacaagcaccctcatgccggtacgcctgggtgtgcatcgctctttcctccacatcacccttcgcttttaggttaactgataatactggccgcacgtactgggcacctgctacctgcagagtcatttatgtatgttagttgatttaatgtaacccctataatagcatatgagttgactagctaaaaagaatgatcacttccattctacaggtaaggaaatcacagctcggagaggttatctcaatgcctctggcacaaagctagcaagtggcagggccatgttgggagacccggctctctgctacaaagcctgtgcgaggcactaaccactgggctgaactacctcagacttcctgcctcagctcggcggtggcctgtccttgctccttctcacctaaatagatgtgctatcagctctgtcttcccatagcctatggtactttttttatgtggatgtctttattaagcgtgtgttatcttgtagtgtaagtatttatcatctgacttcccttttaaaccataagtccctcccattttaatcttcaatgcttggccaattgcgtaactggagtaaagacttcgttaacttttaaaagagcattaagttgaattctgctgggcacagtggctcacgcttgtaatcccagcactttgggaggcggaggcaggcggatcacttgaggtcaggagttcgagaccagcctggccaacatggtgaaacctcatctctattaaaaatacaaaaaatcagtcgagcatggtgatgcacgcctgtagtcccagctactcagagagctgaggcaggagaatcacttgaacccaggaggtggaggttgctgtgagccgagattgcaccactgcattctaacctgggcgacagaatgaggttccttctcaaaaaacaaaacaaaacaaaacaaaacaaaacaaagaattaagttgaatgaatgttgactttgtttcaataccatgcacacaaatactgaagaatgagacttcttaaataagacaggacctagttttgacttttctgggcatattctgctgggcaggaaagaaataagaacattaactctaatggaccacagacagatggcctgccagccagacagcgccccgctgagggccagagcagggcctttgcccaaatcaaggaggagcctattgtttcttccagtttgtgtatggaaggcaaaaacatacaaacaaaaattctttgaaagctcttcaggctctgcaatttgggacatgtttatagggcatgtgtaagtcacagtggtcagtggctctgtggccacagaaggcattaagaggaaatgttagtggcctcctcaccctttgttccttaaagggcttctgcattgacaccaacagccagaagggtttgctagcttttagtgtggttatagtgtggacttagacactataaaatgggaggaaagaaagctcctttttgggaagaaacttctacctatgtcagctatggtataccagctcacagagtgctaagaaaaaataaattttttaattaaaaaaaaactacatgtgcatgtttatgaaaacctggtttcacaatcagaatactgaacctgctaataaatttataccagaaaagcatgcatgctttgctgttaaaaattaactttataatttactttttggcaataggggataatgagaaagagcagcaaagatatctttaaaaggcagcagggagtcagacctcctcctcctttcttcacccaggtctgcactcgtgggcactgagtcgagaccaccaaatgcatgtgggtgggtctgatacccggtgacctgcagggacagcagcactcccagcctctgcccacctgctgaccgcagggcaaagtgtctagttgtaaaaggaaagtatggctccttctcccctcaacctggccgaatcttccaaagtcatttgcagaatattgactgcacagagcgaagaacactttgtttacaatgcagttggtgcaaaatgaatagactaatgaaggtgacgtgaatgtctttgactcatatttatagattttggcttctttgtttcctcttgaacgtattcgcagtgcctcctttctttgtctgtcttctcttcactttcatcaaaggcagcctgttccttctgaccttgaaatttcttttgtaaacatcatgcctgttggcacctgaacccacctaaagtttaaggggtccaggggtaaggggacttttagaaaaccctgctgtcctatggccaacatcagataactggggtgggacatagtagctcatgtctgtaatcccagcattttgggaggctgaggcaggaggatgacttgagcccaagagttcaagaccagcctgggaaatgtagtgagactccgtgtctatacaaataaaaaaaaattagctgggtgtggcacgcacctgtagtaccagctactctgcaggctgaggccagaggattgcttgagcctaggaagttgaggctgcagtgggaagtgtttgcgccactgcactccagcctgggtgacagagcaagatcctgtctcaggaaaaaagataatctggaagacgttattatttgtttttgtttgtttgtttgttttttagacagagtttcgctcttgttgcccaggctggcgtgcaatggcacaatttccgctcactgcaacctccgcctcccgggttcaagcgatgctcctgcctcagcctctcaagtagctgggattacaggcgcacgccaccacacccggctaattttgtatttttactagagatggggtttctccatgttggtcaggctggtcttgaactgccgacctcaggcgatctgcctgcctcggcctcccaaagtgctgggattacaggtgtgagctactgcacccggccttatttgtttttatggatgatccttattcctttacttatttcatttaaagttacctttaagattattggagcttaaaaaagaaatatgcagctgagtgagaaaaggttattgaaaattttactatatatgtgtgttcatatgcttagagacattgtgaaagcaggtaacttttaaacttctttatacttttacttaactgtggtggaatatacataacatcaagtttaccattttaaccacttccatgcatatagtccagggggattaaataaattcacattgtcgtgcagccatcaccctgatccttctctagaactttcttattccaaatggaaattccatactcctcaaacagtaactcccgttcttccttcatgttacctttttttttttttttgagatggagtctctctctgtcacccaggctggagtgcagtggcacggtcttggctcactgcagcctccgcctcctgagttcaagcagttctcctgcctcagcctcccaagtagctgggattacaggtgtctgccaccacgcccagctaattttttaattttggtagagacagtggtttcaccatgttggccaggttggtctcgaactcctgacctcaagtgatccacctgcctcggcctcccaaagtgttgggattacaggcgtgagccactgcacctggcccctgatactattttgagtgtgattcttacagtagtatcttatattttaaaaaacaggatacaccttaccttggtccttaaagaatatgtttgcttattctgctgtggttccaagattatttttcctataaagtttcccccctaagagcttatcaccgtgtcttacaggcgagtcagccaagtaagacatgatgaaaatgccagtgttatgaggttcccaggcgctccttcataaagatcctgagaaaagcttttaagaatgtatctaagagttgctttcagggatcttaactcaattagtggaggttgctgaccacaggccatgtctagagcacagactatatcgtcacgttactctgttgtcttctcattgttcaattcagcagcattttagaaggcccgctgtgtgctctgcactgtgctaagtactgcgagaaacagaaaagttgaagacgtggttattgtctgaaatggcagctcctgggaaaaagtgccgtagaaagaggagctggctatagaaaatatggtaatttctaacctaaaattaatatgccacttatgatcatacaatacgaacattaacgtgttcaaatatgagaacaggaacgaatgctggaaatatattaaagtaataacaaacaataataatattaacacctaacagtcactaagcatctgtcatgtgccaaacgccacactcgacactttacgcgctttatctcatttaatcccaccaagaacaagaagcttacggtgatggctcttgtccccagtttagttagaaaagctgacacacacagagattaagggcatggtactagcaagtgatgacgtggggctcccaactcagacctgcccgactccacggtccaaggctggtgtttgtcattgttgggacaaccattggtacactgtgatgtccagtctggaaataaaagagagtggattttgttctgttacattttatttttcacagaagtgaaaaggaaaaggaagcaattcattttaaaagcatccaaaagcaggatgttgtttctgtcacgccattgcttgggatctgctaccaactcccttactggtagcttaggcctcactggttgggattcttttttttaaaaattgtctgcctgggccgggtgtggtggctcacacctgtaatcccagcactttgggaggccgaggcaggcgggtcacaagttcaggagttcaagagcagcctggccgatatggtgaaaccctgtttctgctaaaaatacaaaaaaattagccaggtgtggtggcaggtgcctgtaatcccagctgcttgggaggctgaggcagaagaattgcttgaaacccggaggcagaggttgcagtgagctgaggtcacgccactgcactccagcctgggcgacagagtgagactccatctaaaaaaaaaaaaaaaattgtcttcctaagatgtccctagattccttcatgtacaacatccatggggacaccaccatgcaaagccaagtggttggccagcagccggttcctgccagtcttcctgtcaggctgaggactcgttcaagaggaaattcaccgatgcgtgaacagcctgcctgttcgtttggtgaaatagggcagattttttatttcataaaagtgtagtaaagggagaggctattaatcaaggatttaaattatgatcattattatttattatttttgagacagagtcttgctctgttgcccaagctggagggcacagtgatcttggctcggtgcaacctctgccttctgggtttaagcgattctcttgcctcagcctcccgagtagctgggactagaggcacatgccaccatgcccaactaatttttgtatttttagtagagatggggttctgccatgttggtcaggatggtctcgatctcgtgaccttgtgatccacccgcctcagcctcccaaagtgctgggattacaggcgtgagccaccgtccccagctgagatttaaattatttattttattatttattcatttatttattttgagacagggtctcgctctgtcatccaggctggagtgcagtggcacgatctcggctcatgcagcctcgacctccccagttcaagcagttctcctgcctcagcctcccaagtagctaagactataggcacgccacttcacctggctaatttttgtattttttgtagagatggggtttcaccatgttgcccagactgatctcaaactcctgagttcaagcaatctgcctgcctcagcctcccaaagtgttgggattacaggcgtgagccaccctgcctggctttaagttacttatttaaaaaaattattgcccactctttagcaatggggagggaatagtgtttcttcctggatcttcaggagtggctgtcccttctgggaaggtgcactttttagttgagaagtgaagttcagggaacctggtgacagtgggttaatagtttctcaacttacctctttttgccaactctgacatgtaggactcattcattctttcagtcactgtcattcatttatttattcatcagtaagtgccttccttgagcatggcacaccaaactatgtagcagggctcaaagaaccatcgtgcacagtgcctgccctcatagggctggctgtctagtgagggaggtgggcgtgtgaacaggcaaatcacacaccagtggccaacaccagggcagaatgatggacaaagcactgctgatgggcaaagagcacagaaaacaaaatgaccacctgggcctggtgccgtggctcggcaggaggattctttgaggccaggagtttgagaccagcttgggcaacagagtgagatcctatctctttttttttttttttttgagacagggtctcactctgtcgcctaggctggagtgcagtggcgtgatctcaggtcactgtagcctctgcctcccgggttcaagcaattctcttgcctcagcctcctgagtagctgggattacaggtaccatcgccatgcctggctagtgtttttgtatttttagtagagacggggctttaccatgttggccaggctggtctcgaactcctggcctcaagtgatccgcctgcctcagtctctcaaagtgctaggattatagacatgagccactgtgcctggcctaaagatcctatctgtaccaggaaaaaaaaaagaaagaaaattagccaggtgtggttactcacacctatatcccaattacttgggaggcggaagtgaaggctgcttgggaggatcgcttgaggccaagagttagaggctgcagcgagccttgactgagtcactgcactccagcctgggcaatggagtgagaccttgcctcttaaaaacaaaacaaaacaaaacaaaaaaaactttggcttgaggagtctagaaattaggaggtgacatctgagctgtgtcttaaaggacaaataggaagtttcgggtggagctggcatctgcaagagcacaaagccccaagagctagctagtgtccacctcgtcaaacagaggtggcgtcagaacaagaaactctccagggcaagaggaaagtgcctagatttcttgtttgtattttataccatatagataaaattgttatttgttttttgtaaggctttcagtcaccttgagtatctggctaaaacctattttttatcttaaactatagacacaaagattaatgttgtcaaagtagcataaaagctggtcttgtagaaatattttatcaactaaatacacggaagagctgtataataaaatcctgtctccttagctttttcttgtgtgctgtgtagtacaaaatattttgtttttatcttccttctgtggttaatacttataaagccagcaacgattttatctgacattcagaaatatcaatgtaaaagcctgtaagccctgcaaagaaaattgtttttcttcattcttttcaccaatactgggaagctcccaaagatatccaaggttaagcaatttgcattcagattgttgttattaagtctggtttccttctcttttttgtgagacagagtcttgctctgttgccaggctggagggcagtggtacaatctctgctcactgcaacctctgcttcccgggttccagtgattctcctgcctcagcctcctgagtagctgggatgacaggcactcaccaccacacccggctaatttctttgtattttagtagagacagggtttcaccatgttggccaggctggtctcgaactcctgacctcaagtgatccacctgcctcagcctcccaaagtgctaggattacaggcatgagccaccgtgcccggcctggtttccttcttttgataaatgataacagagaaaataaagcacatccacttatttttattttaattttattttatttatttatttttgagatgaagtttccctcttgttgcccaggctggactgcagtggtgcaatcttgactcagtgcaacttcgcctcccaggttcaagcgattctctttcctcagcctcccaaggagctgggattacaggcgtgcaccaccatgcccagctaattctgtatttttagtagagatgaagtttcaccatgttggtcaggctggtctctaactcctgacctcacacatccacttagttttaaatatgcttcagggcaggcacggtggctcatgtctataatcccagcactttgggaggccaaggcaagcggatcgcttgaggccaggagttcaagaccagcctggccaacgtggcaaaacctcatctctactaaaaatacacaaattagctgagtgtggtggtgtgcacctgtagtcccagctgcttgggaggctgaggcatgagacttgcttgaacccagaggtggaggttgcagtgagccaagattgtgccactgcactccagcctgggtgacagagtgagactctgtctccaataaataaataaatacgcttaaaatgggaaatgatgacttccaggctgtgggatgtttacttaagcaaaaacctctattacgctacctgagaattccattactcaagtttgaataattacaaaactacgtgatgggcctgccctgtctgacttcctgcacacttagaccgagaactgaaagaccctagtgtcaaaaatatttaagatctgccatgagaaatagatgagggagaattagagcaaaccctggccctagggtgcattttgagattgaaatcgcagcctagtctcttccattacaccatcagtaaatcttgaaggacagaagagtagccaagaacaacacagggacaggtgcgctgggcttggctggggagggagccaggtgaggttgtggcttcctgaaggccctcgaagtttgcccctgcagctttcttcggagaactgggagaacaccatgtgtcaccttgtggagcattttaaaaacgagtgagaaacctttatcgggaagatactacgtgctgtaaaacaatgacagtaagccgggcgcagtggctcacgcctgtaatcccagcactttgggaggctgaggcaggcagactgcctaaggtcgggagtacgagatcagcctgaccaacagggagaaaccccgtctctactaaaaatacaaaattagcctggcgtggtggtgcatgcctgtaatcccagctactcaggaggctgaggcaggagaatcgcttgagccccaggaggcggaggttgtggtaagccaagatcgcaccactgcactccagcctgggcaacaagagcaaaacgccatctcaaaaaaagaaaagaaaagaaaagaaaagaaaagaaaagaaaagaaaaaaataatgataacaacagttgatgaaatgctttgatttccagaagacattatataaggagagaactttacttgcatgggacagctgatgagctcctcagctagggagaggggagggattgactcattcttgatgatggggcagggccaaggctgtagggaattgggcattgtctggttgctggtggtatgagatgctggcggagcccaacccatgcctctggctgttatgcgagggtgggaaaattccagtttgctagaaccattaataacacaagtggaaatcatgggtaagtttacagtttattcaagcaagtacttctaattaaacagaaaaaaagagtgtgaactcttgaccaaggcatattcatgattttcagtaaaataatttctcacttctagtggtcaaaataataatgaagtgcgaatatgaagtgaaatgcaacattaagggttggttaaccccaaattctttcatcaaagagcaatatacaagaaattggagagtttttttttttttcatactaaaagtaaccattaagggtaaagaactgagcctggcacagtggctcatgcctgtaatctcagcattttgggaggccgaggcaggaggccaggagttggagaccagtctcggcaacaaagcgaggccctgtctctacaaaaaaaatttaaaagtaactgggcatggtgatgcatgcctgtagtcccagctacatgggaggctaaggcaggaggctgaagtgagccatgatcacgccactgtgctccagcctgggcaacagagcaagaccctgtctaaaaaaaaaaaggaggctgggcacggtggctcacgcctgtaatcccaacactttgggaggccgaggcatgcggatcacaaggtcaggagatcaagaccatcctggctaacatggtgaagccccgtctctactaaaaatagaacgaattagccacacgtggtggcaggtgcctgtagtcccagctactcgggaggctgaggcaggagaatggcgtgaacccaggaggtggagcttgcagtgagcctagatcatgcaactgcactccagcctgggcaacagagcgagaccccgtctcaaaaaaaaataaaaaataagtaaataagtaaataaataaaagagcaaggaactgaacccagtggataatgctggggcatcagatagaggctgttggccatttagttaaaataagatggatgaccataatctgaaagatgtaaaaaaagaaactgacctaatttatttttttgaatgaataaaatatatgtggtacaaaattcaaaaggtatgaaggctcatagagtaaaaactaatttttttttataaatgtgtcccaaaaccactcggatccctctcccctgagtgcaccgattccagggaatccttgtgtgaacaggcaggtagcatccttatgcgcccttcacgcatctctacacatcacacttttctcactaagcaacaggtcccatacgctcagttcctaattgtataaatacccacctcatcgatctcaatgtctgtgtagtattctattgcgtgaatgtgccatattttatttaaccagttcccttctcaagaatatggaagcagttttccatctttcagaaactctgatttatttgtttattatttgtatttttttcctgacaaaaatgctgttcagaacagaaattcgagtttaaattgcagtggctgttctggttcatgtagaactagacttcagccttttcctcattttcttttgcctggtagacttttgcttatccttttattttcagcatttttcaaacattttattttgggtgtgtctcttgtatacccaagcagtgattgcaacattttcagcaattgctataatttccattttagatacagagacacctgtcacttcgcaccttaaatgaagagcttctgagctaatttcttcaatgggaaggcacctcgggggtgatacatgaataacgtggaataatgcaatttgggcagattaccagttaaaagcaatgttaggtttggcccactttgccttgcaggccgctaaagcctcaaacaatatgacacctggccttttacaaagaccggacagtggaggtgttgacaggaatggtgttaagccaggttcatctgggtttgtcaagcatagacttctacttttaaaatatttagggcaaatacagttcaaaattaatttggtcaactacatttttcttaagtttctttagttttgaaacctttgtatatttttattaattatgaaactcatacaaatgttatgtaggcagaattttcaggaagttttatgcccctttttataaacctgtaacaaagaaataagtgatataatagggaaatacggaggtgtatttgcagtctttgtattttacaaaattatcatttgaccatagatgtgatcgttgctgttccaagtaacagaaagctcaacccataaaaggaattaactggcttatatgtaacggaagagtccaaaagcagacatagcttcagatgcagcttgatccagggctcagatgccatgatcagaatccaattcttgcatctgtttctttgggttggcttcattttcaggcagcccccttcctcatatcctcaagatggcagagacagcccatggtctttcccttgcagagacagatcaccaggaaacaatacctctatccctagccatgaaacagtcttgaactttattctgacttgatcagccaagtccctgttggaaccatcactgcctagcttaggcctgagacagtgctgcacctctactaccaaaggccgggctggccttccctaaagtgtatgtgctgcgtgggggagaggtacggatctgaaccaaaacgagggctgtccagcgtcagcaaatatctcccgcagtcccagtgcctccagcaggaggcaaagcatcaacccctccgtctggctcctctactgaaaattccctcagcagcctcacaggccttaggcttgtcttagctacttcttcatctacttttttgctttcttaattatttttcttttcttttttcttattttattttattttattttagatggagtttcgctccgtcgcccaggctgaagtgcagtggcgtgatcttggctcgttgcaacctccacctcccgggttcaagagattctcctgcctcagcctcctgagcagctgggatgacaggcacacaccaccacgcctggctaatttctgtatttttagtagagacggggtttcaccatggtctggtgacctcctggtctcgaactcctgacctcaagtgatcctcccgcctcagcctcccaaagttctgggattacaggcatgagccaccgcacccggctgcttccttaactcttgatctcctctctgtatcttgctttgtctagctgttctcttctctccatattcatccaaacatttgcttagaagtacccagaagcatggcgttgaatgtggtacaccttgaacgaagggtgaagaaacgaggcagagtgacttagtagcaagtgacagcacacagtttaaattttaatattagcccatttacaaacaacagcttatataatagtcattcacatacctcaacactcaccatcccctccccactttttttctggagacagggtttcactgtcaccccagctggaatgcaggtggcatgatcacagctcactgtagcatcgacctcctggactcaaggggtcctcgcgcctcagcctcctgagtagctgggaccacaggtgcatgccaccacgcccagctaatgtttttttttattttttgtagagacagggtctggctatgttgcttaggctggtctcaaactcctgggttcaagcgatcctgccacctcagcctcccaaagtgttaggattacagatgtgagccactgtgcccagccaacattcaccccattcaagtgtgcaattcaatggattctagtatcttcacagtgctgtgcaactatcactcctatctacttacaaagcatttccatcatcttaaaaagaatccccatgtccaatagcagttccccttcccccaccgtcatcctcgggcaaccgctaatcttcctgtgtgtctgtggatttgcctcttcagggcatttcacataaacacaatcatacaatatgtggccttctgtgtctggcttctttcatttagtgtaaggcttttgaggttcatccatgttgtaatgtatatccttagttcattcttttttgttaagctcacaaataaaaagcctcactttttatttgaggcaaggagactggctacagggattacagttccagcagtcaaaacgcaactccaagtggcactatttggaccgtaggttttgcttcattttggctggaaaagggtattcaggatgtacttctcccagccggacaagaaaaagggcaaagaaaactggaagagacgtctcgtctacacaaactgctctttggacacagcatcaacctgaccacacccgtgctggccagtctgcaggttgctgacccgccgttaagggacacaggccatactacacttgctagaaaaactgaggcaggaaaaagaggtgcaaggcactgggggaagagcaggtacctatagctttaaagctcagtgttgaaggggtaatccttgcaggaggcacagctcaccaagacacagaccctcccgttcctgttgtagctgactacagtggtcacatcaggctgctcagttgaaagtcgaagtcctccaagttttcagcagtgcgttccagcatcaccaccgaaatgatgataggaattaccaccaaattcctatgcatgggaaaccagatcagaacctgggctgcgtttttatttgtttattttttttactgtgcttggctgtgattgctttggtgctgggatcccccagacctgtcacgagagctgaggggactacaggcagtcaccaccttgcctttggattggcagccctggattaacttctcctgaggtgggtgcaggtggcactcactgtggttaaccactgtttttaagccaggtttctttttttctgtctgtcatatatatatatatatatttagagacagggtctcactctatcactcaggcctggagtgtagtggcatgatcataactcactgcagcctcgagttcctgggctcaagtgatcctcccgccttggcctcccaaagtgctgggattacaggctgagacaccacacctggtcttaagccaggtttctttaccatctcttggagatggctgcagttggagattccaaaagctttcagagcccttcatccaccagctcctccatgtggccacccatgtgacatgaagttggtgtcactaggtaccacgttgtctgtcccatccaacaggaaaaatagcctgttggccagtgaataaggtaggaatccaggtggtcccctgagggtcttctgacaggctcctttatcaggctcttctcatggtatgagcaccgcagcttgctgacagtggcaacgttctcaagcttcacagactccgtcacttggcctggaggggaattctaggtgtccagccccaggacaggcattttggcaccatgattgagcacgatatggtgagccatcctcacaggattaagaagaattctggacagaaatatagttgtaagtaagcatcagtcagcctgcactttgacccacttccttgtaaccaacagtgacgtagcactaggtaacatttgcatccccgttgttcctatagatacaatttctgaccttagaatcacaaggcttttgtttaaaatagatgggatctctgacattagaatcataagatttttgtttaagacttgcttaagatgtttttcagatcctgaattccagcaaaacagccgacaccaaccagtttgaagacccccacagaggaatgtgatcagcatgaaaatacagcttcgtctccctctcccatgactccaccctgcacacttcgaccaatcaaccatctccacactccagtctccactcccaaacccttaaaaaccccagccccaaactcctcagggagatggatttgacgtttcctcccatttcctccttcggtggccctacgatgaaacctctttctctgctacaaccctatgcctcggcgtattcactttctggtcccatccagcgatggacccatcgtggttaccgtggctggccaagcctgctgtgcttcacagaccccactcaggatcacaccacttcgttccactgtttggagatgccatgtttgcttatcccttcatcagctgatgagcatttgtgctgttttcactttttggctattacgaaaatgttgctacgagcatccatgatattcgcccatttaaaaaagtgtttttcaccattactgctgtgggaaatttctccctggctctgtcctttctttgtagcccagccttcccccaggttttggctctccctctctggctcaatgtcagctccttgtctcacctcctagagcaattccactctcccacctcctgctgcggcatttccaaagcctctgcttagcaagggaccacccattctgcacctctccccttagggctgcaagcacctgcacaaacttggtggttatcctatgcctcaactcaatcaaattctctcagttttccatcagcaatctttttaagccaaagggaaggcaaggacttgatcttcacatcacatgaatcatgacacctgccttagaaggcagaagcaactgtagttggaatagcaattgtttttcaacatatgggatgatatcaaggctctttcctccccatatgtcctgccctgttagtggctggggctgagggttttcccaggaagccagattgtcctcacaagttcctcaggaccctagggcttccacagatagtaggactgttatcagaaagaagtctcgatccagacgccgagagagggttcttggatatcgcccaagaaagaattcagggggagtccatagagtgaagtgaaagcaagtttgttaagaaaacaaaggagtaaagaatggctactccataggcagagcagctccgagggctgctggttgcccatttttttttttttttctttgagatggagtctggctctgtcgcccaggctggagtgcggtggcacaatctcggctcactgcaagctccgcctcccgggttcacgccattctcctgcctcagcctcccgagtagctgggactacaggcgcccgccaccatgcccggctaattttttgtatttttagtagagatgaggtttcacatgttagccaggatggtctcgatctcctgacctcgtgatccacccgcctcggcctcccaaagtgctgggatgacaggcgtgactcgtgatccacccgcctcggcctcccaaagtgctgggattacaggcgtgagtcaccacgccgggccggttgcccatttttatgattatttcttgattatatgctaaacaagggctggattattcatgagggaaaggggtgggcaattcctggaacggagggttcctcccccttttagaccgtgtaggataacttcttgacattgccctggcatttgtaaactgtcatggcgcaggtgggagtgtctcttagcatgctaatgcattataattagcatataatgagcagtgaggtcgaccagaggccactctcatcaccattttgggtttggtgggttttggccacttctctactgcaacctgttttatcagtaaggtctttatgacctgtatcttgtggtgacctcctgtctcatcctgtgacttagaatgcctaacaggctggggacgcagcccagcagatctcagcctcattttactcagcccctcatcactctgattcaaatgcctctgacatgaccacgcagatttgagaaacaggccctcagccaaccagactctggctctacgacacacttaatactgtgaaaagaagattacgggtcatagtcacaaataccaggggtgcaaaacttcagattagaagacacttgtcagactcagaggctcatccaactccacggagatcattatcaccacaagttcttcagacaggtgtggaggttttctaagggatatttttattttctggattgcaattttgtttaggaagagatgaaagtgaggatcaactactttgaggattgtacaactttgtaaattgcacaaatatgacggcatatttatatctgcctgcatttgtgaaaacaaacttgtcaaggagcttatttctggaaagggtcaatgattctagaaaaaaaaaaaagataaatatgagacccttcagtaaaaagaaacttactctagggaagttttttgtttttttaaagaagcagtattcactcgtgtttttaaaaaggaacatggatttcaacaataatataatgagtaaagcatctgtttcatttatgaaattagacctattaaagaacagaatcattgagggttaaggtaggatgagagtgacagggaaagaaaatggaaggaaggctaggcacggtggctcacgcctgtaagcacagcactttgggaggccgaggcgggcagatcacctgaggtccagagttcgagaccagcctggccaacatgttgaaaccccatctctactaaaaatacaatatttagctgggcatggtggcaggtgccagtaatcccagctactcagaaggctgaggcaggagaatcgcttgaacccaggaggcagaagttgcagtgagccgagatcactccactgcactccagcctgggcaacaagagcatacctccatctaggaaaaaaaaaaaaaaagaaaagaaaaagaaaatggagaggaaaacaaagaccaaggcgcacccaggccttttgaaagtgaggctgtgacccccgtgcaagcaagagccctgtgtgtggctcccacggtgcctgccacatactagctgctcaataaatggctgtgaaataaatgctgatcacaaaggacagaatgggaaagattaagagagagaaaaggaagtgtggaggagtacaagcagaaataacagcctgggcacagtggctcatgcctgtaatcccagcactttgggaggctgaggtgaaaagatcattgaggccaggagtttgagaccagcctgggtaacaaagcaagaccttgtctctaccaaaaagtcaaaaaaaaaaaaaaaaattagccagggtagtgacacacctgtagcctgtacttgggaggatgaggtgggaggatcacttgagcccaggagttcgaggctgcagtgagctatgatcgcaccactgcactccagctttgggctaaagagcaagaccacatcttgaaaataaaataaaaaataaaaaagagaaataataaccaattccactaacgtaaggcttttccacttccaaaaccctcgccatgacttgattcttatagtcaatccacagggtaagaaagagcatttgtacagagaaagcaataacatttatggtggagaagtgaagtctgtcaccagaggccacactcctgggaggtggtagggccagttctagacgaggacttccatctgccagccccatcctgactgcatgactccacgctgcttctgtcttctggaggcacagcctcaaaatcgggccagtgttgaggggcctggggacagggctggagatggggctctgggaggcatcagcacagggaagattttcggaaccacgagactggtgagaccaccaatgagcggcggggagcgcagatggagaagaggggccggaggaccgagccctgggtgcccatccttcagagggtacagagaagggacggatccgagaaggtgactcggtggaaggaaccagagggagggagtggggagtcctgggagccgcgtggagagtgcatcagggagggaagggggccaccctgccagaatataacagtgcctgatacctagtgagcgctccagaaataagagcccgttcctatttttattaatgtcttgttgagaggaggagcgagcagtgagtacggtaagagctaaattgtcatgcaccacagcacagagtaaagagctgatgtctcaaatggataaatcaagaaacagcagagcaagcgcatttagaaaagcagaggtgaatacctcaaaaacctcaaaatggtcacctcagaggggaggaggacaggtgtggaggggaggggcagccaggactggggattttaaaaaataagccttttgatattatttgcacatgtatttctttgataaagattttttttttaatttttaaatttttgtagagatgggccctcactctgtcacccaggctggagtgcagtggcatgatcatagctcatcgcagcctcgacctcctgggctcaagtgattctcccgcctcggcctcccaaagtgctgggattacaggcatgagccacgcccccagcctgataaaaaaatataagcttcaaaggacacaaaaagagggcttttgcacacgcagttgtctaaggtgattggtgaatggttttggggggctgattgcagagcccaccaggcggcagggctggcgtgcacattctccaggaccccacgttcacactcactgtcctggacatcttccctgcactgctaggacacctcgttctttattcactaagctctttcctggctcagtgagagaacattcagaggccccagcagcagaggaataacaggctccagtggagaagggaccgggaaggaagtaattggaaatctctcttcctcccaggttctatctcctctgctcactccccactgctgagggtcggtacaaaggggggtgacacactcccaccccatccttgtcacactgtgatctcccccaacgcatcagtgcctgcaccttccaggctccggaaagacgatgtgccctttctgctttggaaaatcacagttctcagaagaccaacagaaatgcatgtagaaaatgatggaaattactgggtatcagaggacacgatgacctgaatgagtaagaagatggtgggggccggggggtagggcggaagccagctaggacctgatagtgacaaatgcataactatttgcttattttcagtgccttttgcttcaaatgagaggtttctgctctcccacggtgaagtgtgaggcataaatcctgcttcattatgggggacttccaggggggtggcacggagcccaggagtccctgtggcatgatgagggggaagttgggaaagagaagcagaaagaaaatggaagggggccaaacgcaggaggtgtgaggaggaaagccaaggaagacgaggggagagggaatgataaaaaggagggagaagccgggcgtgggggctcacatctgtaatcctggcacttcagaaggctgatgcaggaggactgcttgagcccagaagtttgagaccagcatgggcaacatggtgaaaccccgtctttacaaaaaaaaaaaaatatatatatatatatatatatgtgtgtgtgtgtgtgtgtgtgtgtatgtgtgtgtatatatatgtgtgtgtgtgtgtatatatatatatatatataaattagctgggcagggtggcatgcacctgcagttcaagctacttgggaggctgagggggagggtcacttaagcccaggaggtcaaggctgagtgagccatgatcacgccactgcacctctaggctgagcaacagagtgaaaccctgcctcaaaacaaaacaaaacaaaacaaaacaaacaaaaaaaaggaatgagaggtagggtctaataggtaggaggctggcccaggaacaagtcggggtgttattctgtgcactgatgcaatgggttaacgcactagtttcctaagcccgtcagggtgagttgccacaaacgtgatggctcaaaacagaaatccaaaatccaggtggcagcagggccacgctctccccctaggtcctaggggaggatcgccctcgcccctgcctctccagctactgctggccccaggcgttcttcgtcttgccgctgcgtcactcccgtccctgcctctctgccttcacaggacctcttctcccgcgcttctccacagtgtctgtgtgtctccaatctccctcttctttctcttataaggacattagtcactggatctagggtccaccctaagtccaggatgatcttatctcaagatccttaacttaatttcatctacaaaaccctatttccaaataagatcacattcacaggtacagggggccatggactgaatgtgtccccccagaattcctatgctgaaatcctaatccctgtgtgacagtatttggaggcggggcctttgggaggtgattacgctgtgagagtggagccgtcatgaatgggatcagcgcctttatgagaagaggctggagaccgaccatgtgaggatacggggggagggtagtgctcttgagcccagaagcaggtcctcgccagaactgaccatgctagcaccttgatcttggatttgcagcctccagacggtgagagacgactgtctgctgtttaagccacccagtcttggcatttcttataacagccctaagtgataactgatttgggtgcccctattcaacccttgttttgacttagatgacattctctacagggaaaatttcttaggactattggacaaaatataaagttcttttcttgctttttggttttgcaaaaaaaagaaagaaagatgaatgggtcaatgagaacatctgaaaagtctggagtatcactgaggaaatagagggcgattgagaatccgaaagtgaatggaaacctacaacagaagtgagatatgcttttctgttgtcacctcatcggactgtgtgtgatgacacaaatgccaatagccggcaaactgcgaggaaccgaacatgatcctgacagtctcaggagtgcccccgctgaatgatttttaagttgaatatctgactaaaataaataattgtctcatttctttgttgatttaaccaactctgaagcctaaaagacacgtgtgaggccctgtgaggggaactaataggaatgtgggcgaatggcgtccttggagagttcatggtctgataggagagaaagattttataggaaatcacagccacaagaaagcagcccacaccccacacgagatggctgtgggggtttggggaagaagatagtgcacccagttgcagatatcagagagggcttcctggaggaggtagcactgaagctgggcatggtaggaggaaggatctgaatgaatatgtggtgagaggaggaaggccattgtgggcgaaggcaaaacagaggtgggagggggcgagctcgtcagggagtaattagtcgttcagtttggttggaccttagagtctgtggacaagagtagcggaggtgaagcatagtggggttattccggggctggctccaggacggccttgaaggccacgcagagttgatgccgcagacccatgattccgaggttgggagagaaggtccagctcacagagaagctccaggggctggagatagtcggagagagctcctccaaaacgcctgatgtgccccgggatgtccctcctaccatggaactgatgctctagacaatgagatccgctaacacgctctgagcagggaatggcaccgccaagctgtgctccaggaaagatgcatctgtagctccttttaagacttaacaggaggccaggcatggtggctcatgcctggaatcccagcactttgggaggccaaggcgggcgggtcacctgaggtcaggagttcgagaccagcctgaccaatatggcgaaaccctgtttctgctaaaaatacaaaaattagccgggtgcggtggtgcacacctgtaatcccagctactcgggaggctgaggcaggagaatcgcttgaacccgggaggcagagcttgcagcaagctgagatcacgccactgcactctccagccttggtgacagagcaagactccatctcaaaaacaaacaaacaaacaagaaaaccacttaatggggatgggacaaatttcatggggcactactgccatctccccagttatgtggaactgagggctgaccaagcggggtggctgtgggaagaggaaagaagcaagccgtgggctctgagcgcttgctcgtgaagcagggactgagctgtctggtgcctgtggggccgggcacggggagaagcttttctggctggacgttcactccttgtttgggttaagataatgtgtgtgcgattgtctcagcctctcatctcacaggagttcctagtgcactgctgatcccgagggtgcgcagatccgcccttgagacactcatctgttctctgatgctcctgcctcatctgttctctgttttccctacactggcagaggggaggatgaatatccacggcccctcatttccttcatttggatgacggaaagatgaaaatgtttcagcatctcttgttgacatgtgagctgcagtaaggcctgaagaatcctctgcccaccgagagctggggcagtgtgtggggtgtggcagagacagaagagacgggaagctggacatcctgtggactcgggtatcagctcaccttctaccaagcattccattcctctgctcaggccccaagtctcagaatcatccttgcctcccttctttctccctctccctcctcatccaatccgccaaatcctaccttcacaatctggccagtcagcatgggtgaaccttgaggacattatggtaagggaataaggcagttcccaaaggaccaacactgtgattccacttatctcaagtacctcagggagtcagattcctagagacagagagtggaatgtggatgccaggggctctggggaggggaaaatggggggttactgctcaatgggtacaaagtttcagttctgcaagatgaaatgagctctggagatggatgggggtgatgggtgcacgacaatgtgaatgtatgtaataccactcagtgtacactccaaaacgctgaagatgcttttatgttgtatgcatttttataataaataaattatacaataaagaccaccgacttcaagttatgatctctcattggacaagagtgacacaggagaagcgtggacaaagtcccccactaccacaaattatgcagttgagtttcctgcatttggagaaatggcaggggtcagcctacctggagtgcagtgggtgagcctcactctgggaaaaccatcttcatgatcatggcaccttccctgccagggaagtatgttatatggactttatcacaattttaaaaatacacccacatatagatttatctctatcatctatatctatctatatcatcgatatctatcatcgatatctacctatatctacacctagatctatatcatctatctccagtgctcctcctcccatggctactggcctggtccaagctgcctttatttgtcatctagatgattgcaatgacatccttcctggtctttgcctctgtaactatgttcccaacgtgtagtcacagtgatctgaataaaacataaaacagacgtgtcgctgttctgctctgaagcctccatttggcctcttatctttcttggagtaaaagccaaagggcttaccacggcccccatgggatgtccaggctggctgtcagtatccctctgccatcacctcgtgctgctctcccctgacttggcagccgcagaggcccgttgactttgctgttcctcacgtagaccacgccgagcgcgctcctgcctcggggcctttgttgccggcatccgctctgctctaaatgcccttccacacagcctcctgcccagggctctcacttcctgcaggtcccagcccagatctcctgttagcaatgaaccttccccaaataccctaggaaataaggatgccccttgccccaccccacactctctgtcctacctgccctgcccttatcaattcctatttatttccgctagaatgtaagttccaggagggcaggtctctttccgtttggttggctgctgtattcctaacacccagagcagggccttgcttttaggcactcaatatagttgttgaatgagtatattgagacttccattccttcaggcaataaatcgatcagaaagacagaggccgctctaggtatttcaagcaagaagagatttttctcttctttcttgtgaatttttgtgggtacatcgtatgtgtgtgtatttgtggggtccatgagatgtttggttcgggcacgccatgtgaaaggagcacatcatggagaatggggtgtccatcccctcaggcatttgtcctttgagttacaaacaacccaattacactctttaagttattttaaaatgtacagttattattgactacagtctccctgttgtgctatcaaatagtaggcctttttcattcttttttttattttttattttttttttacccattaccatccccacccccctactccccttcccagcctctggtcaccatcctcctactctctatgtccatgagtcctattattttaattgtgagaatatgtgatgtttgtttttctgtgcctggcttatttcactaaatacaatgatctccagttccattcatgttgttgcaaatgactggatcccattcttttttatggctgaatagtactccattgtgcatatctaccacattttctttatccactcatctgttcatgaacacttaggttacttccaaatcttggctcttgtaaatagtgctgtaacaagcagcagtgcagacatctcttcaatatactgagttcctttcttttgggtatctacccagccatgagattgctggatcatacggtagctcaattgttagttttttgaggaagctccaaactgttctctacagtggtttactaatttacattcccacccacaagggtccccttttctctgcatcctcaccagcatttcttattgcctgtcttttggatgtaagccattttaactgggctggcatgatatctcatcgtagtttttttgtttttgtttttgtttttttttttggagacggagtcttgctctgttgcccaggctggagtgcagtggtgcaatcttggctcattgcaacctccacctctgggttcaagtgattctcctgtctcagcttcctgagtggctgggattacaggtgcatactgccacacccagctaattttttgtattttagtagagacggggtttcaccgtgttacctaggctggtctcgaactcctgagctcaggcaatccacctgcctcggcctcccaaagtgctgggattacagacgtgagccaccacgcccggccctcattgcagttttgatttgctttatctaatgatcatggtgttgagcaccttttcatgtgcctgtttgccatttctatgtcttcttttgagaaatagctattcaaatcttttgctcattttttgatcagattattagactttttcctatagagttgtttgagctccttatatattctggttactaatcccgtgtcagatgggtggtttgtaaatattttctcccattctgtgggttgtctcatctctttgttgattgcatcctttgctatgcagaagcttttttacttgatgtgttcccatttgtccatttttgttttggttgcctgtgcttgcaaagtattgcttaagaaatttttgcccagaccaatgtcctggagattttccccaatgttttcttgcagtagtttcacagttttgtcagaggcgtttgaatcagagcaactccatcttgaataggatcttggtaacacgaggctgagacctactgggctgcattcccagacagttaaggcattctaagtcacaggatgagataggaggtcagcacaagatacaggtcataaagaccttgctgataaaacaggttgcagtaaaggagctggccaaatcctaccaaaaccaagatggcgacgagagtgacctctggtcatcctcactgctacactcccaccaacaccgtaacagcttacaaatgccacggcaatgttgggaagttaccctatatggtctaaaaaggggaggcatgaataatccaccccttgtttagcatatcatcaagaaataaccataaaaatgggcgacccgcagccccaagggctctgtgtgtggagtagcctttcttttatttcttcactttcttcataaacttgcctccactttactctctggactctccctgaattctttcttgcacgaaatccaagaaccctctcttggggtctggatcaagactcctttcttgtaacagtttgaggtcttagatttaagtctctaatccattttgatttgaattttgcgtatgctgagagataggggtctaatttcattcttctgtgtatggatatccagttttcccagcaccatctattgagactgtcttttccctagtgtatgttcttggcacctttgtcaaaaatgagttcactttaggtgtgtggatttgcttctgggttctctattctgttccgggggtctatgtgtcctttttaatgccagtaacatgctgttttggttactttagctctgtagtataatttgaagtcacataatgtaacttctctagtgttcttctttgttcaagcaagaagagatttagggatctaggaattagagcttcaaaatcactggaaggctagaggtgcgaaggttcaggaaagccattcattgccctcaggcccaccaccagttacaggaaaaacaacaagtttcagaacctgcagaaaccattgccagggtcacatttgcctgcagtaccaaggtgggattcactggggaaatgctcaaatgccaaggcaaactcatgcttgccgtgtttgccacctgttgaagggggagcagcaagccggcttgcctctcttctattttccaaatttcactcgagtgcctctcagcggcccaatctaagttggaatgctcctagttggtatactgggaaatatagtccccaggctttctactccccagtacagagctggcacaccagagtggagaaccagccgacgacccagcagaggcagaagatgccaccctgtgttctcttcttgcttccccccaagttatcctttttgtgggaagagactctccaagaaagagatcaatgatgcagatgaatttcaaggattgaggtctgtcagatttcagagtccacatgtggagggaatgtctaccttaaattaccaaaaggtaatgattatagcttaagtgtattgagctgtactatgtgtccagtactattctaagcctttcatataaattaccgaatttagtcctcatgaggcaagcattattattcatcctcattttattttattttatttcatttctttttttctgagacagagtctcactctgtcacccacgctggcatgcagtggtgcaatctcagctcactgcaacctctgcctcctgggttcaagcgattctcgtgcctcagcctcccaagtagctgagactacaggtgcacgccaccacgcccagttaatttttgtgtttttagtagagatcaggtttcgtcgtgttggccagactggtctggaactcctgacctcaggtgatccacctgcctcagcctcctaaagtgctgggattacaggagtgagccactgtgcccagtcttcatcctcattttatagatgaggaaagagaaagtggaggctaagtatcttgcccaaggttgcatagctagaaagctgtggggccacattttcaaccctggctttctgactttggagcctgagcttctaaacattagattacattccccctcccccataaaggggtggaaacaccagttctgggcatctcagctacaagagcatacatgaaggaaaggctttaaacgtctatgtaaatttgtcaataacataaaaataaagatgacctgaatgtagcacttgggaggtcaaaacagaagccatgagtaggtctcaagaagtatgttgctctgggtcagggaatcctgcaacagcaaagtcgcttgttcactgtggcacggagaggggtaagtagggagaagtgtggcttgcaacttggaattcgaaccctttccctgccacactaacttctttggtggtgttggcatatcatttaggctttttgtattttggggcttctcacagttctaagtgaaataacgatgttaactttatccagagaagaatatgggggaagtcctaatcacttagtataaattattctgaaaaccaaactgctaaagcataatgctctatgctggcagagaagtgaatattgcactagagaatcttccaggtgtcatttaaaattcaacagtgatgggcctccagtaactaaggaagatgacttcacagtctgctagattttacggtcattgttttcaccttgaaagcttgcctacactttcttaattttaatttaaatccatccctcctttgaaacctcctaaactaggtgtgtttctctctttgttctcacccctagacatggacttcctgaaaacagtcttgttttaccagttatttttagattttatacatattctagttgcttcagtcttcactttgaagccatcccttctaagttgtttaattactgtgatcatacactacatttatctttcgggcaataagatgttcagaacagaatgcaatattttagattaagtttcaggctgggtgcggtggctcacgcctgtaatctcagcagtttgggaagccgaggtggatggatcatgtgaggtcaggagtttgagaccagcctggccaagatggcaaaacctcatctctactaaaaatacaaaaattagccaggcatggtggtgggtgcctgcagcgccagctacttgggaggctgaggcagaagaattgcttgaatctgggcggcagaggttacagtgagctgagattgcgccactgcactccagcctgggcaacacagggagactctgtctcaaaaaaaaaaaaaaaagaaaaagtttcaactgagctatttcacatgaaagcaacgcactagattcatgatacatactgagttcctccatatacctgtaaccagagccacacccagtgctgtgctgagtgttagggacacaaagattaaggacctggctaccagcctcaaggagcttagagtcgaatggttataatgcacagatttttgaacccttaaatgggtgtctcaaatcttgagtcagagctctgtaattagcaatcattttgcaccttagctctgcacagtgggtttagaactcttcaggagtaatcaatttaatagagaaaagagggcaaataaaaacacaaatggatagcacgtgcatagctatattgttagtgattagggaagatcagattgcagtcccagagggactgtgaagagtgtcatggatcagtgggactcatcgagagacgcttcctgcaggaagtaggcctcccttaatgtagcaaaagtttacattatttctgaacattaattatgtaattaattacataattaatttcattaatgtaaattattcatttacataactaatgtaaattaaagtttacattaactacatttaattaatgtaaattaaagtttacattaattccattatctcttgcctgtctttagggagaactgctttatttatttattaaaattttattttatttcaaattgagggggtacatgggcatgcttgttacgtgggtacattgtatactgggcttctagtgtacacattacccagagagtgaacatcatacctgatgggtacattttcaacccttgctccctgcaagtccctgcccacccactttggaggccacgtgtccactgtttccatcttcatgtccatgtggactcactgttttgcctccacttacaagtgagaacacgcagttttgattttctgtctctgagttagttccttaggataatggcctccagctccatccatgtcactgcaaaggacatgatctcatgcttttgtatggctgttttttttgttttttttttgaagagatagtctcactatgtcgatgaggatgaagtgcagcggcatgatcatagctcactgcagcctcgaattcctgggctcaagagatcatcccaccttagcctcctgagtagctgggatgatagatgtacaccacaactggctaatgaaaaaaaaaaaaaattggctgggcgcagtggctcacgcctgtaatcccagcactttgggaggccgaggcgggtggatcatgaggtcaggagatcaagaccatcctggctaacacggtgaaaccccgtctctactaaaaatacaaaaattagctgggcatggtggcgggcgcctgtagtcctggctacttgggaggctgaggcaagagaatcgcttgaacccgggaggcggaggttgcagtgagctgagattggtccactgcaatccagcctgggtgacagagcaagactgtctcaaaaaaaaaaaaaaaatagcaatgtggttttaggatgctgcccaggctggtctcaaattcctggccgcaagcaatcctcctgcgtcagcctcccgaagtgttgggattacaggtgtgatccactgcacctagccaagaactgctttccaaatgtctaccatgcagagtcagggtcattgtctccgtgagtaggaagtttgatgttttggcttgccttcatgcctttgattttctcatacttttgagactccatattttcacactttattttcccttctgcaggtgtgttggcaacacctctcgatttagctcatccctgcattttatctgttgctttttattcccccttaaagaacattaagatgagagctaaggccagagccagtgctggtgtcaggcctcccttcctggggcctgtgggtcacatgtcacaatttgtggcctagagcatttggttgtgttttcaatccatgcacctgtgttcttctgggagctgagatttgctaagattcgctacagtgaaagttttatctaagtaaacatctctcacctcttttggggacttttcatctgtggaatgagtgaaacggtccaaaggtgatcaagtacgcaagacagcctcctctctctaggacctggatcttcctcgctcctcattctcatgaaccattagtgggttttttttcttctttctcttaggacatggtcacagttgtgtgcagcagtgaagctggacataagagagcacagccaaactggggctgtggggtgtttcctctcacctgttcttcacctgttcttgcccactcagagcattgtggcccctggcttttattactgcttctttagttgcctgagatgcagtcttcattgggaggagcttgaaaagaactcactagcaggacctagtgcacagcaggcatttaataatgatttgtcttcggctctctctgcaaccttgtgagtggcattgcaccctgcagcctgctgttacacacagagtcagattagctatggctagtcacggctagtcacggctggtcatggctagctagtcacggctggtcatggctagtcatggctagtcacagctggtcatggctagtcacagctagttacagctagtcagggctagtcacagctggtcatggctagtcacagctagttacggctagtcacggctcatcacggctccttgtggctagtcacggctagtcacggctagtcatggctagtcatggcttgtcacggcttgtcatggctcatcacggcttgtcccggctcgtcccatgacgggattctctgggcatcattcttctcctgggacttggtgtcctcatccttcctgtgggagcgaggaggctgcctccctcacgggtggctgtgaggaattataaaccaataaagtgactgcttagcatacggctgaatgtgaagggcaatagaaatgcttaatttcatttatttgctagtagttgggtggccacgtgaatgttgctgtggagaccataactcctgaattccccaacacttacctatgctgttgtttttaaatgaagctttacacttaaatcttgtgattttttttaaaattagaaaagtagcaggaagggtcacagcttgctctccatctcagccttttcataggaaactgtgagctgctacagtccccacctaggagcatctactgaccagttactctcacctgatccctctcttcacccaaggtcatacgtcttccatctatccatccacccgtccacccatccgtccatctgtccacccacctgtctgtccacccacccgtctgtctgcccacccatctgtccatctgtccacctgtctgtccacctgtccacccgtccatctgtccacccacccgtctgtccacccacccgtccgtccatctgtccacccacccatctgcccacctgtctgtctgcctgtctctccgtccacctgtccacccgtccgtccatctgtccatccactctgtccacctgtctgtccatccacccatctacccgtctgtccatttgtccacccactttgtccacctgtctgtccatccacacgtccgtccatctgtccacccacccgtctgtccatccacctgtccgtccatctgtccactcccccatctgcccacctgtctgtccgtccacccgtccacccatccgtccatctgtccacccactctgtccacctgtctgttcactcatccacctgtccatccatctgtccacccacccatctgtccacccacccatctatccacctgtctgttcctccatccagatacactgcatttccaactcatgagttgaatgggccccatgtgagtagatcagaactgttgattttctagtgaacctttagaattgagaggatggagacgtgatggcagattctgtgcagctgatgaggtgaagggggaagtggcaaagggaacatttgcagcagtgatggtggaggctttagcaattccgtgctggtgcccagcctcaggcagcacacagctgtgagatgacagtcaagccagggggcaacaacagcactgcttagaaaaatgggtcttgattctaagccctcattggaggaatcctggaatcccacaccccagcaagtccctctcttccctgagcaggtcctcaggttgcttccgtgtctccaccacggtctttgaagcccttctctgggctgtgtgtgcttctctgcccaccacccttacggctgactctggtggccatcgctcccacagctgaagctgctgcacctgctgcggctcgtatggcttaggtggagacagcccgtgccttactcctggccacggcaactttgttctggcagttctttacagagttcttagtatcacaactttttttttttttttttaattaagcacacattctcagttcattttctttaatggctcttctattcccaacagcaatcagccagtgtcttttgatgatcttcccagtgctggggtcccctctcccaagacgacatgaagctagaccccatggggactctagctggacatgctgggattcctgaagtgggcacacaggctaactctctctctgggacttttgcttcagagggaaaagacaactggattattgtggccatatcttttctcttttttaatgtcagttctgggatacatgtgcagagcatgcgggtttgttacataggtatacatgtgccatggtggtttgctgcacccatcaacctgtcatctgggttttaagccccacatgcattcggtatttgacctaatgctatccctcctcgacaggccccggtgtgtgatgttcccctccctgggtccatgtgttctcattgttcaactcccacttacgagtgaggacatgcagtgtttggttttctgttcctgtgttagtttgctgagaattacggcttccagcttcatccacgtccctgcaaaggacatgagctcattcttttttatggcttcatagtattccatggtgtatatgtgtattgtggccatatcttttctaaatcaaatgcatcatcttcctcccacttttcttgttgttggaaatggtatttcatctctcttgcccagctcatatgcctgaaaatcatccttgccatctctgcacatcagtttagtctccaagcctagccgattgagtgccaacagctctgaaattgatccccaatttccatcccctcctttacctctcccatcactttctaaaaacagcactattgacatattttacatatgataaaacccaccctattcaagtgcacagttcaatattttttggtaaatttactgagtggtgcagccatcaccataaatcagtttcagaacattttcatcatcccaatgaagatcccatttacaattaatccctgttcctacccccagtttcaggcaaccactaagctactttctatctacagatttgccttctgagcatttcatatagatgaaatcacacactacgtgatctgtcatgtctggtttctttcagttagcatgatgcttttgagattcatttgtgttgtgatgtctatcagtatatcagtatttcatccctttttattgcccagtaatactccatttttggatacaccgcattttgtccatccatcagctgaggcacatttcacctctttttggctatttataaataatgccactatgaacttttgtgtgcaagtctttgtgtgaatgtgaacatatgcttttatttctcttgggatagatactaaggaatgaagttgatgacggtacagtgatattatgtttaactttttgagaaactgccaaactgttttccaacacagcacaccatattacattcccaccagcaacgcatgagggttcccgtttctccacatcctcaacaatgttgtcattgcctgtctttttgatgatagtcgttctagtgggtatgaagtggtgtcctttgtatttttaattttcatttctctaatgacgaatgatgtggagcctcatttcatgtgcttattagccacacacagagcttctttgatgaaatatctgtccatgtctctcacccattttttgatgaggttgtttgttttctaattatggaattgtaaggccctcccgtcccatcactttttttttttttttgagagagggtctcactctctcgtccaggctggagtgcagtggccccagcatggctcactgcggcctcgacctcctgggctcaagtgatcctcctacctcaacctctcaagtagttgggactacaggtgcatgccaccacacctggctaattttttagttttgtggagacagggttctcactatgttgtccaggctggtctcaaactcctgggctcaagcaattctcctgcctgtaatttgagtgctgttttaaaaattttaaataaaaatgtttccaggaactcccccccgccaccccccagcaagaaaatgatattctagtctggttctcttttgaattcattggaacagtcaccaatcatataggtagtgggtttttttattcgttattttaacttttatttttggttcggggtacatgtgcaggtttgttatataggtaaccttgtgtcacgagggtttgttgtaccgataatcttgtcacccaggtactaagcctagtacccaatacttattttttctgatcttctccctcctcccatcctctaccctcaattaggcccagttgtattttattctaagttctggacttccacagctttttagctttttatgccccacctgctacccacatcttccacctcagatcctaagctgtgtgtggttcttgcttggggaccaaggaagggtttatgtttttccctggcactctccttggctttgcctttaaaaaaaaaaaagagagagagagagagatgaggcttctatctgttgtccagggagcacagtggtgcaaacatagctcactgtagccttgaactcctggctccctctcactctgttgcccaggctggagtgcagtggcatgatctcggctcactgcaacctctgcctctggggttcaagtgattctcctgcctcatcctcccaagtaactgggactacaggtgcgcaccacacctggtgaatttttgtatttttctttttttttttgagacagtgtctcactctgtcgcccaggctggagtgcagtggcacgatcttggctcactgcaagctccacctcccaggttcacgccattctccggcctcagcctcctgagcagctgggactacaggtgcctgccaccacgctgggctaatttttttttttttttttgtatttttagtagggacggggtttcaccatgttagccaggacggtctcgatctcctggcctcgtgatccacccgcctcagcctccaaagtgttgggattacaggcgtgagccaccgcgccaggccaatttttgcatttttagtagagacagagtttcaccatgttggccaggctggtcttgaactcctgacctcaagtgatcctcctacctcagcctcccaaagtgtcgggattacaggtgtgagccaccgtgcccagcctgctttgttgtatcctggctttggctaggcatgcagctgtgtgtgtgtgcaatgtgtgcatgttgctcacattgtgtgtgtgtgtgtgtgtgtgtctggatgctttgtgggcacacacatcgtttaccctctagcttcttgtgattcctctctgacactgaaacttgctttaagttccttttaatctttttctcataagaatattaaattaagaatattaaatattaatattaaattctgtcttagaaaacagaattagaggctggtcatggtggctgatgcctgtaatcccagcactttgggaggctgaggtgcggggaggatcacttgaggccaagtgtttgagactatcctgggcaacatagcaagatgctgtctgtataaaaaaatataaaataattagccaggtatggtggtgcatgcccgaagcccagcaattagagttgccagctgcttgggaggctgaagcaggaggatcacttgagcccaggagttcaaggctatagtgagttacacttgtgccactgtactccagcctgggcaacagagtgagatcctgtctcaaacaaaagtaaaaagaaaacagaattagaattagcaactccccccaaagaattgttatgctttttaatattttggtgttaaaatctaatctttttttcctgatacatatatacttttcttttggttttactgagttattatcatattgcatatactttactttttaacttaacactaatatatgatcaatatctttgcattccattattcttttatgagcatttgtaagggctgcaaggtattccactgtctgactagactgtaagttgtttatttactttttttaagaaatggggtctcactatgttggccagactggagtgcagtggcaccatgatagctcactgcagcctcgaacccctgggttcaaaacatcctccagcctcagcctcctgagtagctgggaccacaggtgtgtgccactgtgcctggcttagactgtgagttattaaacccatccccactcttgtgcgtttaggctgtttttctccccttcgctattataaacagagctacactggatgctgtgatcccttttcaaagcaggttacttctgtggaaggggcagcacagcccaaggttgtgagcatctggaacccaaggtcagtgggctgaggacacattgtctgatcctcctcgctctttttaatctttttaaagtcttttaaaatcttttttaagttttctcccccaaccccaaaacaaaataaaattaacaaccaaaaaaaaatgtatcactctgactacacaaatttggttcatatcttttctctctatctacctttatcatctgaacttttaatttcagactgaaatcaagccttggaatttagcgtggaaggaatttataaggctaaaatgattaatgattgaaatgatatttcaagagtggaaaccctttctcagcttgcaggataacaaccctcctcttataccacaataatgaccaggcacacagattcacgttaccagcttgccgatgactctctggtggcccccgcatgatcatacggtcctcagaacaccagaagatcatatgcaaatattgtctgcatattcatcaagataccacgtggccagtgtaagctgctttaattattcttcaaggagaaacacagccgtctctagcacacgcacttcagtggctctgtcggcatgttggtgcctgaactgatatggaaattatttcgaaagcaaaatattgaagaggagtgaaatctgctgtactgtacagtcaacttagcaattagaagttgccagccttttttttttttttgaacagtcttgctctgttgcccaggctggagttcaatgatgccatgttggctcactgcaacttctgcctcctgggttcagatgatcctcccctcagcctcccaagtagctgggactaccaagcatgcaccaccacatctagctttttttttttttgtattttttgtaaagatgaggtctcgttatattgcctgggctggtcttcaactcctgggctcaaacagtccacccaccttggccttccaaagtgctgggattatagttgtgagccaccgcacctggctggttttttatttctgatttatactttcagactttcaaaaacacaatgatataatatattttagctataaaatttatgatctattcacccctgagttataaataatgggaaagctaaactgcattctctgaaatataaaagtcccgtgaggcattcccaaagaagttatgtccatttaataattaagcaacaaggaatatggaataaaaatttcattcttagccaggtaatggactttagctttctttgcactttgtactcatggatacaccagaaagatatgtttttcacccagggatatcaacggaatcaataaattgatgttcatagaagctcttggtggccgggtgtggtggctcacacctgtaatcccagcactttgggaggccgaggtgggcagatcacttgaggtcaggagttcaagactggtctggccaacatggtgaaaccccgtctctactaaaaatacaaaaattagtcaggcatggtggtgcatgcctgtagtcccagctacttgggaggctgagggatgagaatcacttgaacccgagaggtgaaggttgcaataagctgagatcttaccactgcactccagcctggggaacagagtgaggctccgtcttaaaaaaaaaaaaaaaaaaaaaaactcttggcttttataagccagtatataattttttcattcttaaaatgagtgtcttttcccacctaaatcttgaagtaatagtgttaacatcctcaaatgtgaagaagaaaaacatgtatatttataatctatatcatttatctatctatgagtaatgagtaaaggtttcagttgcaacactgaaattcctcagtctaatagagaatcaaattatagctacaggctgctaattcatagaaagaaaacccttgaaacaacaagaattccaaaagcccaaggtagatctgaaaaagccaccgttaaaactagaattcgggagtatcttatgtacaacgttgaatttcccaaagaaaactctcataaactgacaacaatgaccaacccatttaagggccctggagaatggccagaagcaggcagagactggaaggggttcgaagatctaatccttaaaagaagggttctagggccctccttccagtctgctgagcactgtgactagagcacaagaaaaaagccagtcgtagggtttgaggcattccatggtgaagttcagggctgtcaagagtagctggagagggggaaggagaatccaggaaaggagagagccacactggggcagccctgaaatccactaaaatttccctcaaatctggctgatgagttgaactctgaacacccagaagagctgcaggaagtcgagagaaggcaggaactgcatggtgaaggagttgagcagagactgcaagtcctgtcaagtgcacggagcagagttggagtctgagttccaagttagaggggactggcaaagcggttaggctttccattgaagctgcagaagggctgcgcctcggggataaagaacagtcccaggactaagggattttccttagatctcagggcaaaagctagttagaaccactcaaagaaagcatgaaaccaagcctcctcaagttcgaggtgacccatcagtaacttaactgcctgctagaacaaaaatcaatactcctcaaggaagggaatagaatctagcatctctatgatgtagcatctacaatattcaatatacagttacaatttcttgaatatgaaaagaaacaggaaaatgtgattccgagtcagtagaaaaatcagttaatagaaagtgacccccaaatgagtcagaggttggaattcagacaagaactttaaatacgctactgtaaatatgtttaaggatttaaagggggaaaaaaacagagaactggaaacacacacacacacccacacacatatgcaatttttggatcagctgcatcagcttaacagcagattggaggcagctgaagcaaaggttggcgaacttaataaaggagcaatagaaatgattccgtctgtaaagaggtaaaaatgtaaataatgaacagagtttcaataacctataagacaatatcaagcactgtaataacaaacatgtaattggtatcccagaaggagaggaaaaagagagaacagggcagaaaaaaatatttgactaagtagtggctgagaatcccccaaatttggtaaaaaacttacagatcaatttacagatcctagaaattcagcaaaccctaaccaggataaatacaaaaagtaacacatatagaaatattatagtcaaattactgaaaaccagaggcaaagaaaaaatcttcaaagaactcagagaaaaaaagacacattacatacaggagactgtccatatgaattactgctgacctctcatcagaaacaaggaaggccaaaaagcaatgaatgacatcctcaaagggctgaaagaaaaataactgtcaatcaggaattctacgtctagctaaacgattcttcaaacacaaaagtgaaacaaagacattttcagataagcagaatctgagaatttgttgccaggagaccctcactataagaaacactaaaagaaatgacccagttagaaacttgcctctaaaggaaaaaaaataaagagccccagacatgacaaaactgggtaaatataaaaaacttgacattttcactgaaagacaacagattgtttcaagtaaaattgatgaaattgttttgtggattttataatgcatgtagatgtaaaatatatcaaattagtagcacaaaggaggaaggtaagatggagaggttgcaagtctacattttaggtgaagcggcacaatgttaattctaagtagcctatgaaatgttaaagattcatattataggccaggtatggtggtttcatgccataatcccagcactttggaaggcggaggcgggaagacagcttgagctcaggagtttgagaccagcctgggcaacacagggaaaccttgtctctacttaaaaaaaaaaaaaattagccaggtgtggtggtgtgcacctgtagtcccagctactagggaggctgaggagagaggatcatttgagcctgggagatggaggctgccgtgtgccataatagcgccactgcactctagcccaggcaacagagtgagcccctgcctcaaaaaaaaaatccatattataatcatcagagctaaaaagtcaacagagagatgaaactggaatactgaaaagttattcaattaacaaaaaaaggcatgagagacagaagaatgaaagagagtagagatagaaaacagacccatactagcaacaacatgaaactcaaaaacctgtgttaagtgaaaaaagccaaacccaaaagagtacatgctgtacggattctatgaattaaaaacccttccagatcagtccacactaacccatgctgatagaaatcagaacagtagtttcttatgagaggtggggattgcctgggaaaaggtagataaccttcaagagggacaggaatttatagatgttgatcgaggtggtggcctacgcagagtacacgtttgtcaaaattcatagaacttaacaattaaaatgtgtgcgtttcatcttatgtatatacattttacataaacatcaatttttgaaagcttcttaaaaactcttgcagagcctccggttataaactttaatcaacagagggcgctcggagcccaccaaacacgctttgggcccccagctacttagaaatgcaaatcagagcagctctgggctcccccgtctccgaggtggatcgcgcagctccccaacactccccctcgacaccccaccttccccacccgcggcctcgccggctcgtttcaccacacgctgctttttggctgataagcggctcgtggccaatggcgatgatgtgtttcgcggcacctacgcgaaatacagatgcgggtgggagctggcgcgtgctgcctggaggtgtacctgccccctaaggtcccctattgataggatcgcttttaaattggaagtgggaacgtaacggaaacgtccactctgttcttgccatcttccttttgacctttttacctcgctttggtggctgtgaaatattcccgcgcaggagctggagcggggaggagtggggcagagcacgggaggcacagaagaaattgtccccgaggaaggcagagtgggggcgtggccccaggcttccagaaccccgaacctttgtcttcttgccccctcctgcgtcgtccacagctcagaaggaagtcagcgaccagaaagccctgaacgtccttcgcgccctcgcccacccccgggctgggtctccccgcgggcgcggagatgccgttacaccccacgtgatccctgcgcccggccagtccttccagaggcgtctcgcggggtgttaattaaaggtcacaacaaaacagacctgctggctcaccagaagaaatgtcctcccgtgaaatgaaaaatgacaccccagagcagccacgtgtggagcctggcatacgccggcttcctgcgctcctgggcgctgcgccgggggactggggcggggggcgatcggagagggagcgatgacggggtgctccggagaccccgcggggcccaggcgcaggaagaaacgggcggcggggggcgaggggcccgatcccacgcaaggagaggccaaggccagctcgcgccacaccccctctccaggccagagtcgtccgcgtgcagcgcggcgaagccctcagtttcccctgcccggcagcggcccgctgggtcaccaggctcacctgtcccagccccgggcggcttagtccatcacagaccggggctcgggcgggcgggggaccaagggccctagtcctgcggctgcggtcggggagggtggccccccggccggcccggggtcggtagggcaattccagaaaaggtttgcccggcagctctccgagaacaaagggcggggggaggacccggcatgtttgtggacttgtttgtgactcaatcccttttgcacggcgtttcacagacagacctgcaagccttgtcaggaagagaaagaacttgggggcgggggaggctggggcaccgcatttccgtccagccacgctcgctcgcgcggcccccgggctccaggctcgcgcagcggcgtttcattagagccccgggcccgggccgcgcgccaggaacttccccgcacgcggcgagatcgacgatcccccgcccccagccccagcccggctccaggcctcgcaatgtcaggcacgagcgccgccacataaaatggatcccggccggcgcggcgagggcggcaggttcccgaggctcctccgcgctgcgcccgggcgcacacgcgcgctgtgaccgccgaccgctcccgggccacgcggagccgcccctctcccggccctcgcgcaactgtcaggcgaaacgggccggcggatattggctcggcgacacgccgaggctcctccccgagtctggatctttatattttgggagaatttctttgaactcagttaccaagctcggtgaaggagacaagttcccacagctgactcggctcggctctcccaccttcccggcagcggccgcgagccctgattgtatccctcgctttcctcgtgggggagcacggactgacttggctgaagaaaatgccagttctgtggatgtggccgtgacaagaggacgtgcggctggaagaggcagaaggggacgaggaaaagcatgctttgaagagaagaataaaccagcgaccccaaccctttctgcaaattggtgctattacttgtgggatccatttgctttcattccctcccaccccaccgctgaagaaaccttgccctgagggctgagagccagccccctgcagccgggggacgcttctgggttggaggaccttctggatgtagcgtcggtggaacctttagatactctcctctggaaaagccaccatgaattcggtagctgggaataaagagaggcttgcggtctccaccaggggcaagaaatacggggtaagttgtgacggtacgacgcggagacgcgttaccagacccatctcggcggaggtccccctttccccgggatcgtgcggccccggccccgagctctcccccgctgcagaggcgcccccggggctggcggggttgtgagtgcgcggaggcgggtcggccgcggggacgcccgcacgctcgcctcgctctcggaattttttcagccctctcgttccttcctttccacgcacccgtaacttttgccgcattcctgcacttctaggcagagtgaagccgaaggggagggtttcccatgaatgctgggcagtacctcggatcgtttagctggagccgtgagagcctctcgtttacctgcaggatccggagagttggaccccgtatgaataaaaatcctgaaatcacagccctccccctaccccccccatagggtcttccaggattttgttcccgggatcttgctgggataggtgccggcttcaaaagcgtggggcgctgaacctatggatcccccccgccttgcagaagccgtggaaacggccccgagcgagtccccttcctgaccccaggaggaggccaccggggaccagcgcaggggtcacctgggcggtggggactcacttaaggacaattaacgagacagacggagggcaatttggccgcagggcttggagaggtccccaaccgactcccgtgggcggttcgagcgggtacttggtggcgcacgtatgacccagctcctgggcgctgcagcccgccgccttgcagcccctgacaccggcgtgtcttccccgcaggtgaatgaagtctgctcgcccaccaagcccgcagcgcccttctccccggaaagctggtaccggaaagcatacgaggagtcgcgcgccggcagccggcccactcctgagggcgcgggctcagcgctcggctcctcggggaccccgtctcccggctcgggcacctcgtccccgagctcgttcaccggctccccgggacccgcctcccccggcatcggcactagttcgccgggctccttgggcggctctccgggcttcggcacaggctccccgggctccggcagcggcggcggctcctcccccggctcggaccgcggcgtctggtgcgagaactgcaacgcccgcctggtggagctcaagaggcaggccctgaggttgctcctcccggggcccttcccgggcaaggtgagcgccgcgcggggctggctggggaggcgccgggagggcggggccgggccgccacccacagcagctgctcagcccgccgcgaccttgcgcgccggctccacgcgagagcccccggcggcgctggggatgctccacacctcacggggctctagcacgcggggcgacccatgccccttcctcagccaggccgcccggggggcaggaggaccgagtcccgagcgcgaaggggcgcccgtggccacaggcctcacggcccacgggggaggcccccaggtggtctctcctgccgccccctcccagctctccctggcggctgcaggctgcgctttcgatgtttctccccacccccacctgtgatcctttacaaaaatgtcagcgggagctgtaaaagcaagctgatgctcggagctggcatttcccactgcctgtttgtggtccatcctttccgcggttgcagaaacagaaacatactcgaaagccagcattttccccttctcagtctgtgtgtgtgtctgaggaagatccggaggcgggtggctcttcggagcagtgctccctcctggcctgctcctgcgccaagcacactggttcctccatagcaaccctgcccgcagtgtgtgactggcccgagcccccaggggatagcaatgcgattgtatttgcactgttgggtccaagtactatcaaatgatcatatttactcggccacttcaaagagtttttatcagtggttagagagcaatatcaaggaaatagagtggattgctgtagaggtttttgacactgttggttcaacgtcaatttctggtttattatttccgtgactttagaaatgaaatactgtgatttcgagtaggcgtttaggaatgactgcgtctgctggcccaacctgcgtatgcagatacacacgttgatgttttcataggcaagggttaaattcaacaaatgcccacagacgctgtgaaacttaaaatgggggaaatgaccaccaggagaattggttttatgaatgcagaacttatctcaagaataatgaactcgtggatggttgtcagtgtaccgtttttgtagtttgatacatctgccgtgacatcccaaggatacatctcaaggaatcaaaaagcttatttcgctcttgcgtgctagaccttccgatttaacaccgtttcttcattcacagatttatttgctctcgtgatccttcatcaatattcattgattttctactccatccgaggcactgtgtcaggcacagcaatgaaaataccaggtccattcatgcagtccttgtccacgtggagcttagattctagtggaggatacagataacaaccacaaaatgcacagttcacaatgtcttcacatttgtggagggaatgtagggtgctgtgaggttgttgaactggatgggagcatctgataaagatggaaggaccttggttcttaaagatctagtagctgatatttggcagtcctaatacgttacagcctaccaaattattttagacctttcttgaggacctattcttataataggcttattgtggctttgggtgttcctatatgcaaaggccgatcaaaatacactcttctcatttaaaaaaagaggaggggaaggaaaatctacagaggaaacaaatgttgaaactcatacgcatccatcatgttttatggagtcctgtgaccagctggaatcttgtttttatagaaacagcctggaacattcacttacagtgtcacgggaggcagctcaatatatttgccaattttatgtatgtgataaggtaaaactcttgttggtaaactgattgtattgtcagagtgaggtgatggccccagaagaaacactggatttgctgaacccccatgctctacaatgacttcgagtgatccaaggacatctagagaagacctggcagtcatgggggcagtcacaggggatcactttaagtgcatacgtgaatgtcacatagtaccacagtcgcctgagttttatatgtgaagcagcacagtaaagcgtgacatttggtgcaagggcatagacagggctcagccaggaagaaggatgctttgcatcagctcattgttagtaatgagatgtggggcctcaattttaactacaaaatttctgcaagcctttgtgaataataattgtgtgtgtgtgtgtgtgtgtgtgtgtgtgtggtgtgtgttttaagcatttgtaccttgcatttaggtacaatttccattatacctttagcatttgcaaccttatagccaaacagttgccatgttctctggtgtaccatggatggaggccatgtaacttggataagacttttcttcttcccggagcaatattaatgaacaaactgtggaccactgtagccctcaggcacagaaggagttaagtttcattagaacaagaggtgtcactgtgactccaacatgcagttcgctcagttcgctctgaagagtaagagtctggaagataaagacatgtttttgaggagtaattaacaaaaatcatctgtgtaatttgcttaagatgcttacctgcatttgggaaatattttcttaaatagagtgttaaattctactaggtggtattaaatgtctcctaggtagatatttaaaagtcaaaagcagaatagcacatccaggaaccttaatattttaggatggatttggttttggttcttcttcaccactgatttactttgtgacattgggtaaattagttttcctctctactttttaactttcctattaatatcctaaggaaaaaaatgaatgagactattaaaacgtcattaaaatgatccaaggtaaggtctgaaaagtgctttcattctttagagaaagatatgagggttgatgattattaatgagctaagattctgttagatttatgttttacagaatttaaggtttttcttataagatattactcctgtcagtttctaatttcatctgtatattttctaaacatgctgccatatgagttctcacactgtgcctgttggtaggtagcaagccctattgaatcccccgttctgtctttggaacagttggttaaggaggggaggtgaagtagtagagagcccattccgggtatctggttggttccaggagctagtgcctggctctggtggcctgagaagaaccatcttattctgagcactccaatggaggatagggcttcatggtagaaaatgacattatttgaacgtaacggagtgggtgatagtgttggctgaggtaggaaataggaggagacatggaattggatggagctcagagggaaggatgatcatgagtttggttttccatgcagcgagtctgagctttctggaaagagatggaggcagatttaataataaaacactttgtttttggctatctcaagactggcgtgtagaagtgacagctgtgagctcacatagctctgctgttgatactctgtattcatcctttccgatagcaacttacctggtgagtagacgtttgtgcttggtggcagattgtaaaacactcagattgacttttattaccttgatcagtacaaaaagtacttactgggtttatatcgtttctcttttggtgccggtgagtggaagtggtcggataaaagaatgtggacgtgtaaagtgttgagattttaagtgagaatggcccttttacccactgtagccttccagtgtgtgaatacaaaaccatttcatgtccaatggcaagagcatctttcctgctttgtacacagtcagggcactgagccagaaataggggccaaggaacgaattgctcaattttgggctagcctagatcattctgatatctgtgacagaacttttgaatggactgggcaagtcctacgaaacaacagcccaacgaaattccctggagtaagcagtaaagctccaggttggcaaaaggttatcagacatctgttcatttccatatcaataaaagaaaatcttttatgtaaaaaaaaaaaagtgcagaactatgttcctatctgattgtctctcagtcagatattctgagtccatttatgccccagaaatatcaggaagattagccagacatactgagaagggtggccaggaatcacagagatgaaagaaaggaatgcgtcataggggttaaaaacgccaaacgtggactctaaatagccggagaccaagtaagtctagacttgaggagatatagatatccccacatgcatatttctgtattttgccagctccaaaagaggggtatggaaaaataactagacgcaaaaagtcccccaaaagccatcataaaacattttatagataggataaaacagacattgcatttcgagtacttattaattataagggacttctagctgaaatcttctctttcttctaagaacatgtggctattttcaaaaagcttcatttgagtctttctcatatcagaagtattttagataaaggagcagttagtagataatagcagtcatgaaaaagtcctacagcatttatcatttgaaaatttctgaaacattttgggagtttataaaaacattcccaggagagacatgtgagcagtaatctctttttaaggcttagcaagctgtggaataatggcagttcattctaccagactattaattgtgaagcaacatggtcagtttttatagtgacttaattcactttgcaaaaatccctggcctgcaataattccttccacacccattgcagataggattactacattagaaatgtgatttttaaatggctgaggctggtagtttgtcagcatttggaaggattaagtcaattaaaatggaggcaacatcagttgccatttgttatttggcattatatcacagattgtaccatgagtgggccaacaatagcgatgatagtaataataataatatgtaataaatggctaacaacgattgtcctacataccacgaactacactgaaacacacacacacataatctcatatattaaaatgaagatgaacgtgattttttcttttttaccctggaattccaagtgcttgatgtggttaagatcatagaaggaagcatgaagaaaaaatatgcaaggaacagagaaatccaatcacactttcccctagaagctgttaagggtccctgtgagtagaactgactgagtgagaggcaccggctcgagatggttattatttttcctgggctcacagatgagaattttacttccagtgagtggggaggttgggggaaagtatgtgagactgtcaggttctgagttgaggaattgtcttggctggaatgcaaggggcggggggaaggaacctccttatatttacgtgcacccattggagaccctgttgtcatcccttcctgaacagaaaaccctgcccgagggccccgtcctgaccttctgcgaggaagagttcttcagccggccatttcagtgccccatcggcagggcggccagacctctgctctgttttgtcctcaaaaagattgcaaattggctggtgtctgggagggttcttggtcattttgcaggaatacaagacaaatttcctttttaccactctctgcagtcacaagctattcatcagcatcctttctttcctgtttctcgtctatggtgttattgtggcgaaggagcactgttgagaatgtgctcccaatcgctcttttatacctatagatgcacccatcagaaatatcttttttttttttttttttttttttttttgagacggagtctcgctctgttgcccaggctggagtacagtggcgtgatctcggctcactgcaacctctgcctcctggattcaagcaattctcctgcctcagcctcccgagtagctgggactacaggcgcccgccaccacgcccagctaatttttgtatttttagtagagatggggtttcaccatattggtcaggctagtctctatctcttgaccttgtgatccacccgccttggcctcccaaagtgctgggattacaggcagaaatatcttattttaaagtacattcgtgtagatgcaaaaggactggggatacacctgtattcctaatgtacttttgaaatatttgtcaagatatcaactcagtttgtatccatcattggcttaccattgcctttggaactgctccagagcctatctgagaaaattggaaatgagtgattgttaaaaagatgtttgtccacctccaggtctcaaagaactcacctatgttttcttctagtatttaaatagtgtcctttttaatatttagatctctaatccattgagagattattttggtgcaaaatgaaagatatagatcaaatttcatctttctctaaatgtctatccagttgtccccactttattaaaacattcttcttacttgcagacttcttcttgtgaaaaaaagaatttatctttctcacattaattgaagataccaccattgtcataaatcaaattttcagttgtatctggacctattacaggatcttctagaatgttctcactctgttgtccaggctgggttacagtggcacaatctcggctcactgcaacctccgcctcccaagttcaagcagttctcccgcctcagtctcacaagtagctggaaatacaggcacggaccaccatgcccagctaatttttgtattttcagtagaaatggggtttcaccatgttgtccaggctggtcttgaactcctgacctcaagtgatctgcctgccttggcctcccaaagtgctgggattccaggtgtgagccactgcgcttggcccacactattttaattatggaagctctgtagcatgttttcatgtttggcagggctagctctctctccctcaaatagtgcctttcttttctaggagtttccttgcctaactccaatttttttttttgttaggaccgtgttgaatgtatacattaacctgggggaatagttggcatctttatggtgttgaatctttcccaagaacatggaataccttttcatttgaacaagtctactttttagcaatttttaagagtttcttcatataggctttgcacatttcttgttaaactttttcttaggtattatagcttttgttgctattgtaaatggagtcttcactttcattatctcttttaattgataattatttatgtgaaggatattgatctacatgttttatatcccgtcgccttattaaattctactatattcactgatttttaaaaaattggtactcttggattttcaaaaaattttgtcttcttcaaatacagatatcattactctcttcctttgctatttttatgcctctaagtgttttctcttttttgttacattggctggtactcctgacacaatgttacataatagcgatatagtgggcatgtgtatatatttttttctattaagatgttggcttttggactgagatctgtctatattttttaaagttaagtaaatatccatcaattcctactttagtgttttattaggaatgggtattatattttgccaaatgtcttttcagtatttagagagagaatcatgcaatttttctccttagatttgttaatattgtgagttattattattgattttctaatagtgaaccatccttgtattcccataataaaccccacttggccacagtgcattttgaaagatatgcttctggatccaatttgctaatatttcatttattgtttttgctttgatattcatatgccaatgaacatttttgattcctgtttatgtgccagttctagtactatgccacattataatccaaataggaaaaatactaaaattcctgccctggagcaactcacagtctagtgtcagagacaggcaaggaacgtggcgaagcgtaagcgttccagccacaggaaacggcaggcataggccaggaaggggtgatgcgtgccccctacatatggggaactgaagtcgcacatggtcaccatacacagtatttgtatgagtgcgtgacaggctggaaaggaggcagatggaggatgaaaggccttgtaggctataggctggactttatcctgtaggacgtgggcagccattggagggcactcatgaagggagtgaaatgatcagatatgcatttaagaaagattgctggccaggcacggtggctcacgcctgtaatcccagaactttgggaggccaagacgggtggatcacctgaggtcaggagttcgagaccagcctggccaacatggtgaaaccccgtctctactaaaaatacaaaaattagccgggcgtggtggcccacacctgtaatctcagctactcggggctgaggcaggagaatcgcttgagcccgggaggcggaggttgtagtgagccaagatgatgccactgcactccagcgtgggtgacggtgcgagactccatctttaaaaaaaaaataaagattgctgtgagaatgagcaagaagatgggttggaagagtggtgtcaccgagaccagttgggaggccccttgcagtggcttgagtgaagaatgacacagactgaactagggtagtacagagggaagggagaggcagctccggcctgacacatatcatatgtagaaaacccgccatggggagctgctgagatacggggccagagggagaaaagatgatgcattctcccaggtttctggccagggaaagtgtgtgggtggtgctgccagttatggagatgaagaatacaggcagagaaggggttttgttattgtgagcccagtgttcgaggatggctgtggatgttaaattgattggggtctctagagcttgaggtggaatggtccaatgggctcctgttggcgctctagagcggcttctgaggtggagatatggatctgggggatgtcagcgtagagaaggtgatggaatccacagacggcatgagctctccacagatgtgtggggtgagacgacagacagctgaacatgaagtggtggagaccattgacatcgaagggaccagtggcctgaggagctaagaagacagaccaagaaggagggaccagaaaagagggatgaaaaaccaggagaagacagtgtcatgggaactgaggaaggagtgagcttcagggcataggggtgacaaaaggtctgatgccctggagaggtcaaggaagtaaggactgaggttttctttgaactggcaaggaggaggtcattggatgtctttgttggaagaatttctggtgccctggagaaagccaatggcattgtgtccaggaatagattgagaggtgaggacatctcaggcagcatttgagttgctgaggacactgagatacaagagatccacttcttgaggctcttattatcttaaaatgaagaactacaatcaacagacttgcgtgcaaaaccaggctccgtcacttagggtgtgaccttgggcaagccttggtctttctaaacgtggttattctcatctctacagtgggagtcatgacagagccccaccaggaggatcgtgaggattaggtgaaattgtgagatgctagtcaaccatcgctttctgttattattccagtgactttccacaggaagttgaattttatataagattcctaccctccttccttccctccttccttccctctttccttccttttttccttccttccttccatctgacacgaaaatggagaaacagcagtcagagaaaatgaaagcattcagtgcgtctttgtttcttcacctccaagtggataaagcatctcattcttatttattcatttgtagagttgtcaccacagaaagtttaagggagctcagtggatgtaaatagcgactcctttgggttgaggtgccatgaatatggattgagagttttttgtcacagatggaaatcccttctttaagcccggcccctctcgtagcccctccagggagacttgcagatgtggcatttggcatttcggctccggggaatgagggagagcagatttcctccagtgactgcgcatgcgatgtgcagatctgagccgcaccaggaatttgggcttatctgccttccaatccagctttatctgtctcagacggttttctttgcagttgtactttgctgatcctatcacatcgattccaaccagaccccatgggaagtctgggaataaagaagtcaccctcccccaccaagcaggatatcctgcacatacatcagctctcagggctggaggtgaccgtggaggagagggatcctgtgagctctaatacaaaaaaccgagacattctgaacgttgctatagaggttagcaaagcagaaggctctgagggtagagtaagtattattaattttttaaatatgcagaacgataaatatgtcttaagtgttatagaccaggttacagctgagggactattttgattttccttttctacttattggagtttacgttcaatactgttgccaaccacaaaaagttattggaacaaattttagctctccacacagcatggttctaaaatctttgatggttcttacgtgtaaactttctttttatataattgtttttttttttgcttgaaagcatgagctgcaaataataaattaaaatccgcttttctatcacaggggtgacaaatagaaacttttattttgatatgtccttatctaagtgatgtctgaggtctgtatatgctaattcaggattttttttctgagctaacctaggaaccgatagaacttgagatttttctgcagtgtaattttgtctttgagttggcagtgatgagcagctacacttccccatgaaactctatcatcgtatttagagtggttgctttctttggggttataatcactacttcccaacccttcctccacctaactggtggcttcacacaagaatgggagactcacctattaactgattagaagccagcaataacaaccagcaccaaaagctgtcgagctatctaaccaaatggttgtacagaaaataaacagctgaattcaggcaaacaactggaagcagccaccattgtttaaaaaaaaaaatcacctgcccagttcagttgtgtaactttgcacagcagggagtctcagtcctaagcaggtggcagagtgtcttccccatggtaccatggctgggaattagagcatcaggtgtcctttaccaagacaggcagcgtggtgatgggggctgagggatagatgggaggaggatagaaaggagaggaataagaggggaggaggaggaggacggatgagagagagggcgaggaaacaaagaaatgggtggtatacgcatccaaggttgtctacaatcccagatatttaggtgaaaaaggactgtccttggatctggggacagaggtgcagtcctgcttccagcactgataagcattatgatcttgggagaatcacctagctggcctgtgcttgatttttcttttgtaatctaagagcatggtagtcggtgggctctaagcttctcccaagcctgtgagtctctgtgaagctgaggctttgggagtccactccgtgaacccagattccacagggatgtgcctggcaaaatccaagtgggtttctggctgaagctgttctgtgggctgccatgtttgtgggacatctcatctgcagccgccgcagcgacctccttgtccgtccagccaaggggagggaccggaagccaagcggaggggccggtagcgccgtcgttgctgatgcttctgcttttggaattcggatcataaactgacagggttcttcctgtttcttaataaagctatttgttttactgtctaatgtgtttctaagcagaaatagacaaacaaaaggacaattgattctagaagagagatttagtatggagtatttgaagaaaagtattgccttagaaataaggatgttttgtagttaattttacattaaaagttctgccatattgattaggatttagaaataacatacgaagagttcttcctgagtagcagtataggaacaccagaactctataaacattttattcatcattcttcatctgatttttttccaaaatctttttgctccctttgatttctctctttttttctgctctttcaaatgcctagacagagccatattgattaggccagtatttacatatcacatgcccctgacgtgggtttaatgccccgtagtgtttgatgctgtggtctgggaaagaatggaacaggtagctgcccgctgagtcaacgaggcccatgcagttatcatcgatttttatttttctctttaatcatttagccaaggttgcctctttaaaatatctacttcctgggggatgtttccctgactcttatttcaaatctaatactttgtatttgagtctaaacacaattcagggaatatagctattaaaagcagaacttgattttgtttaactagtccagagcgcgtgatggctttggagcagagtggagaacaggcacagaggagcacgagccccaggaacaccacttggtgcccctccctcgtccttccaccgagctctctgcacgtatcttaccagggcgtgaatggagcattctgcagccagacacatccaacccacagcaaaccctccatgcaagcttgcctgtgtcctcagacattctaccctttatttctcctcttgttctttgcccctaagtttgtccatgcactcgactttctaacgggccatggtgtgtgtgtgtgtgtgtgtgtgtgtgtgtgtgtgcgcgcaagcactttgtggaggccctgaaggcagcatgtaaggtggtaacacggtagacattctgccccaggtttcagacattgttaggctgaagcttttattggaggtcaaggcagctaataaagtgggccgtgcaattacaagagcattcagcagagaaggatggctgaccctctcggcaggctgagagcagaggaagcggttggcagctcctagtcctcccatgatggctttacaagcattttttgcagccggggtggtaaatgcgatacaaaggcatggtttcaatatatccaatgaggcactctgcttcctgtgtgaggcatccacttgggggaaggaagttgcccggctgtgggctttttgtggtggtggtttctgctaatttaccttttttatagagggctcataattattagggatcctccataatgcccctttatggtggtcaggaaggagataacaaaatgatgcagaggtttaggaggcttctccagggtcacccagaaaacctctggattctgaatctccttcaaagatttaagaggatttatttatgctgctctcttgcccatgtggatctccttgacactacactccgtgagcgtagttaatgtcctgtcttgttcactttgttttttgtttggtgcctgtgtaccaagtagatttctggtgttttgaaaaaaaaaatcacccgtccactgctgcataaccaaaacgtcactggtgtgaaggaagaggatgatagaggatgggacggtggtgacaaatggcgggatgggagatgatgcctgggtgagtcctggaaagtgccgtgatgccatcccactgacatggcctcctgtattccagcaaagagtgaaattcacagggagcacagagtaagagcagcgccttcacctcggtggagcttagtctaggcatttatgggtcggctggtttgagggtccttgcatttcttgtcagtcaatacgtccttgttttggctaagtctcatgccctcatatccacttctacccttgcagaataaagacatgtgggaatgctcactggatgcttacaattggttccaggtgttccagggacgaaacttatcagaaccaaacatagagggcaaatgtcttagccaattcatgctgctataacaaaataccacgaactgggtggcttataaacaacagaaatactgatttctcacggttctggaggctgggaattctgagatcaaggccccatcagattgagtgtcttgtgaggtctgctttttgattcatagatggcactgtcttgctgtgtcctcacgtagtggaagggactggctagctctccagggtctgttttgtaagggcaggaatcccaattatgagagctctgccttcatgacccagtttgctcccaaaggcccacctcctactaccatcactttgggggttaggtttcaacatgattttggggagaacataagcgttcagtctgttgcagcaagcatgaggtcacttgtctagacactgacccctcaggcagtgttcatgtttggtttaatttttccctttatctggtaattgattctgcactgtctccattatttggtgagatggtaacatgtgattacatcccaatggagttgggcatgagaataagaaagaaatctccctttaaaggctttggactaccttggagtttgaagagagtggaggaatgcagtgagctggttttgatcttttggtgaaagtgacaaggaggcaggatggtttttccacggacattgacagggtcgtgctggttctcccaaagagaaatagagtagagttcatcacattagttaagagcacctcttcagcacattatatctcttcagcacatcgtttaagagcatcgtctttaataattcttacatggggcccgcacggtggctcacgcctgtaatcccagcactttgggaggccaaggcgggcggatcacgatgtcgggagttcgaaaccagcctgaccaacatggtgaaaccccgtctctactaaaaatacaaaaaagttagctgggtgtggtggcacatgcctgtaatcccagctactccggaagctaaggcagaagaattgcttgaacccgggaggtggaggttgcagtgagctgagatcgcgccattgcactccagcctaggcgacagagtgagactccatctcaaaaaaaaaattcttacatgggacaaaaatcactatcctatgtcaattgaaataaaggccattagtttttaacactgtataaattgccttttctcctgggaacttcagcatattcttttaaattattagcattttataatcatagaacgatggcatagagggaacctacagggtgtccagcattgcattacagttccctgatgaagagcatggttcttggggtctggccatcccatcaggatttgtatattttgctctgccgcataccagctctgggaacctagagaaggccttaaccattttccgtgttggtttcctcgcttgcacgatggtgttaatcataataactgcttcacaggcgtgttttgtctgctgcatggtagtcattcattaaatgtgagtatccaagctcccatcccaaactgccagaagggaaaagtaaaacttacacttttagacagcgacctcctgactccagggttcattccatctcattaacagtcagttcattcatttttcatttccttatccatccacctgtttgtttatccactcatctacctgtccagcatttctttggccttcaccgtacattcgtgtgtctagacttggtggtggggatgtaaagatgactaagacgcagcccttgccctcaagtccctcccagtctggtggggggggtgggtacagaagccacgtggtaagtgcagagttaggacacttggggagcagccagcatggctccgggctgctggaacattgcatctttcttttcttacaggccccgcctaagaagtgtcatggctgggagggagtcggaaggggtagcttcctagaaggggtgatgatggagaggagttagtgagagaagactgaggaaggtgaggaatctcatagctagagaccagaaacggccttgaggggctgcaggaacccaaagaaatgcagcattgacagacaggaggtgtccaaagtgggtggcccagctgggcatggtggctcacacctgtaatgccagcaatttaggaggccgaggcgggcagatcacctgaggtcaggagttcaagaccagcctggccaacatggtgaaaccccatctctactaaaaatacaaaaattagccagatgtggttgtatgcgcctgtaattccagctacttgggaggctgaggcaggagaattgcttgaacccaggaggcggaggttgcagggagccgatattgcatcactgcgctccagcctgggtgacagagcgagactccatctcaaaaaacaaaaacaaaaacaaaacaaagagggtggcccaccacatcaatttcacaagaagtgaaataacaatgtaagatttatatgtcagttttaacaagtgatgataccgtgtaatacatcagtatagcagtacgatagccatgttcatagcagccttattcacaatagctaaaatgtagaagctacccaagtgtctgctgacacatgaatgactaagcaaaatgtggtatatccatgcaatggaatagtatccagccctaaaaaaaggagattcaggcacaggctatgacctggatgaaccctgaggacattatgccaagtgaaataagccagtcacaaagacaaatattatatgattctggtgatatgagatacttagtgtagtgagattcatagacatagaaagtaggatggtggttaccaagaattggggaagatgaaaagaattctgcatatggaaggtggtggtggttgcacaatggtgggggcgtacataatgtcactgagctgcacgctgaaaaattattatgagaggtcaatgttatgttgttttactgggcgcacacacacggaaagtagtataagttgtgtcacaaaattgtatttgacggaagtgatatccctgtgcactggtcgcccagtgacggctcatgagggtaatcatggtaatacgtacaatctggccaccagagactcccaagcacgttacaagcagtctcacgtttgatccaccctatgagacaggccactttacgggtaaagaagctcagtgaggttagatgcctggagacgcgggccggggaggctgtggtcctgcactcactgcacagcccttcctgctccccggcctccctgtgaggctcactgcagtcccttggagggaaaggggatgctattgagaattggggccaggtgaatggctatagagggatgcaggagtcccccccacctttttctctcctttctcttacttccacggaccttctgagaatagggctggccctggcagccaagagccccttagctcctccctctgcatttgccgtggtacgacgtgtgacacgggccagacccacgctgctctgttctgcaggactcagtgcaagacagctcttttatttgtgcctgtggtcgttagaaaagttttacacgggcagggcagtcgtcatcactaagtaaacacattgagccggcaaatcagtctttgtgagagcagcacattaaatggttccctgcatagtagttactgatacattactataattacatcgcacattttgcagtaaactccaaaaaaatgatttattatctcttgggtgcttgacagcaatatgctcaatggcagcataacttttccaaatctgcccacacattttatgtgtatgactcttttggaattagaccaaatggacccttttaaagatctgctgagttaacaccaccttatatttatatggctgcgttcttcaggccacactgtactgggtcattgccactattttcccacctttctctttacacccctttaaggagtatcatggccagatgtggcgtggtgtctcttaaattcacttaatagacaaaagagaaggacatctctaacagtaatacaagaaaaaaaaagagagagaaggacagagagaccaagaaactctttttttactcctattcagcaactatgtatgtacttatttatttatttatttatttactgagacagaaccttgctctgtcatccgggctggagtgcagtggtgcaatcatagctcgctgtaacctcaaactcctgggctcaaacgatcctctcgccacagcctcccaagtagctgggactgcaggcatgtgccaccacacctggcccctcagcaactatttttacagtatcgactctgtgtcaggcgctgttctaggctctggacgcttgatgagtgtcaccagtgagcttaggacagagctgacgtcttctgcctattctttggctttactccccatagggcttttctggagaagggccctttggagcttgtgggatttcagggtttattgaaatttatttacctttttgcaggtgtctcatgcttcctcggttaaggaatgggaattatcataatgtataccatggtgtctggccacagatgaagtaccacagtcatcagattatgaagcctccaagcttctcttgcagaggactccttcaaaccactctcgtggactgtggctaactgggagtttctcctgggggcccattgctcattccttgctgtctctcccggttgagacttcccaccagggtgaaaagctagaacagtggcttttgtctttagcaaggccattagatggtacagtaactgctttcagatgctgctgatgtggcccagattcagcatagtgacccagaggtgaaaggctacatattccattacaacccctagccaatctgcctccagactctagtgcatttcagtagagaaaggaaggaggatagggtgacatacacactagatagcagctagaagtaagtctgggaaaatctaagaatggagcttcaatttctagagatgcttttgtaaagtgcattacttatgtgctgtgaacgtgatcatgatggattattcaggtaaggtggagacgagaacacagagaatcagaacagggaacttggaagaggcaaagtaaacaggcatggttgcctgtttattttgaggtttcgggtggctattagccctacaaatgccagctaagggcaaatttctgttggttgagattctttgagattctgtcaatgcaagattttttaaaaagcaagtataaaagatgagaagatgcagttttgtggcaaagcgtagaaagtcactaagtccacacatgattaaaaatagtgaagagaccataattcaagtcatatgatctcttttattgtaatcatatttactcaaaagcctcttcgtttgttccatttctaattgttttctcttcttgtgtagagttaaaagagtcacgggctttattgaagggtggagaaattttattttcagaaattttgcctcaatgtttattccctgtgagacactgacattttcttctcaaaacatatatatctatatctatatctatatatttagatgtctatatatatagatatctatatctatatatatagacatctatatatatagatatagatatatagatatagatatagatattttttttgagacagagtctcactcttgttgcccaggctggggaacgagctcagctcactgcaacctctgcctcccgggttcaagcgattctcctgcctcagcctcccgagtagctgggattacatgcatgagtcaccacgcccagctaattttgtatttttagtagagacggggtttctccatgttggtcaggctggtcttgaacttctgatctcaggtgatccgcctgcctcagcctcccaaagtgctgggattacaggcgtgagccttgtaattacaggtgccttgaaggcgcctggccttcaaaacatatttgtttagggaaaagtagtgtcagatctatgaaggtcatactggaagttgctaataagtagaatgccatatttcatggaaggagaccagagttcaggaagcatccttcccacagggtctatcatgggatttagttccttctttttctgcatcccagatgttcctggaggtgcatacttgctggtaagcctggagttggagggatgaaagctaccaaaggccctgatgggtgttatataagatgccacgtgtgagccactccccacaagacgccaacaagcagggaacctagttcagcactttcatacccagtctaaaggcttctaggaaactgtgggtcagctggcccactcctattaaccatgccttcatctgtagtggaaggaacatggctcacaggatgggctagcaggcgatggggcctttgactttcagattagtcttcctgcgacttttaacggtcatgtttacttttgaatataacctgggatgaagcatttatcagcctctggtacttttgtgaattggtagtttacagcgggcttactggtagccttggccagctctttgccataaaatctttaagcatagacacacaggggtatggccattccctttatttttaattaattaagtagtttctagagggagggtttcgttctgtcgcctcgactggagtgcagcagcatgatcctagctcactgcagcctcaactctctggctcaagcgatctgcttgcctcagcctcctgagtagctgggactacaggtgtgtgccatcatgcctagctattttttaaattgcttgtaaagatggggtcttattgtgttgcccaggctggcctcagatgcctggcctcacgcctcctgccttggcctctcaaagtgctgggattataggtatgagtcactacatctggcccatgagtcactgcacctgtcccattccccctgcctttattgattcctacttccgcctaggataacactatctcttaaaagagtgttgccaagaaaccccatttttttacattctatattgtattttaaagaggaaaccctatttagagatatttttgtgggaatggttttggagtttcaaacttctgaagaacctggactatgttgggggcatttacggtggcagtgcacacggctcacactgacgaatggctcggctgagcaagccagtgaagcagagggcaggagaggtgacttcctggcatcctggatctctgcaaatgaagttgctgtagcgccattatttacctcactgtatgtgaaatgaaggggtaggattcattgccttttggttttgattttacttgtccttaggggtgtgtgtgtgtgtgtgtgtgtgtgtgtgtctttccccctggccttctggtgacggataatggtgatggcagtttaggcctgtttctgattagtaaaatgacccttcaaatgagactaggagaaaaatgctctcctgaacctctggaaccctggtttttcctatcacaagtttaatggcttcaggtcctatgtttttagccgagaaaatgaaagactcagtcagcggggattagggttttttgtttagagagaaggtaaaaaggttacatgaagatttggtgtgggtttagactggggttagcctccacgtaggaaaggtctgaagatcgagaatgaggccaggttgtgcaggtgagcagagctatctttggcagctagattgggatgtttctgggcagagatatttgtcccttaggagtgtatcaaatcacagaggtcacatctgactgtcactgctttgttacaggagaaagacctgttcatcagaataattcctacgctttgagccacttattcaagtgatgctagtcacgttcagaaaacagataacctaccatgtgtttgtgctgtgctaggagttctagagctttcaagcacaaccgtatatccgaggttgactttggagctgtcatcgtgggtttggggctgtattttaaaataagaggagcggtgtcttttgggctttgcttttttttcaaatgcttttttctgagtcccttcagtgatccattcttgagctgtctcttcagtcgtcagtctcttggtagtctttattctaagtttttttcctttttaattgtagtaaaatatgtatagcataaaatttcccatgttattcctttttaagcgtatggttcagtggctttaagtaccttcatatcattgcacggccatcgccaccatccacccacttccatcatctcaaaccaaaactccaaatgcattaagcaataacttttgttattaaagtgtttaataatcactttggtgctgtttaacctctttaccctgatttcctccccctttcttgctccttttctagtagtttctactaatagatcacctgagtaagactgcccgtgtcaagcctggtgtcaccttaggttttggggataaaggctggtggtaccgcctgtgacgtgggcttgccacatgcagtgtctgagtggagggcaagtggggccggctctacagccatccgagcagacgggggctctgtcccttactcctcaggcacctgacgttggacttgcctctgggtaaataattcttatcaagcatttacttggaacaattcttaaccatgttttttttttttaaataattactgacatttgtactttaagctgtatacaaatgttcatatttgacagatattctaagcattagagatatttaatgaaaacttgtaaataggcaaaacgacatttaaaaagactgcccctgtctttgtgaaagcagcaaatagttctcttggctcccatttccccctctccactctaaaatatttttaaataaaatagcgtttgaaattctccagagaatgctttaaagagaaagatccacgtgacctcattaagtcattcattcacgtattcatttatcacacatttatcaggctcccaatatgtgccactttctctgtgttaaatactatggattcaaaaacaaaggaggccgggcgcagtggctcatgcctgtaatcctagttctttgggaggctgaggcgcgtggatcacctgaggtcaggagtttgagaccatcctggccaacatggcgaaaccctgtctctattaaaaatacaaaaattagccgggcgtggtggtgcgcgcctgtagtcccagctactcgggaggctgaggcaggagaatcacttgaaccccaggaggtggaggttgcagtgagccgagatcacgccactgcactccagcctgggcgacagagcgagactccgactcaaaaacaaaacaaaaacaaaggagaccccaacattggtcgtgagaagtttaccaaccaggaggggagataagtgtgtaaacaagcaaacaactgtcgtaaaggctgtggcacaagagtgggtgggtagaattcgggtaatccaggaggtgtcagaaagaccaggggtggacctttcatctgagccacgaggacaagcaggtgtttgctttggagacagagggtggacaggatgttctggagagctgcagttgcggggcagaggcagtgaggcatgaagcacctggcgcatggcctgtgcgggcctgggtggtgagggcaaagacagtgagcagaggaggcagcgcctggggggcctggccagggaccccaccccctgcatcctgatgaagaactgtaagaggaccatgtctgtgtgcctggataatcgctggcagcagcaagggaatttcgaagcaagatctcagctggagacaggcaagaggctgtcgccatgcttttaaagaagtatcagagatattttgcttttgaaacatttggcttcactggaactttcgtcttcctatgaaatattggaggatgtcagatcctcccccatttctaagagtaggagagactcatgtatctttctctttggggtaaacattcagcttcagatcctgcaggtagcagagagagagagagagagagagaggagtggttaagagtgtggccattggagtccagggagtctgcgttctaattctggctctcctcttaaatagtcctgcagcttgggcaacttactcaactgtgtccttcctcaacttccacatctgtaaaatggggagaacaccttcctttcagggttataggcaaatgaggtaataatctcttttaaaatacttagcccaagtaaatgctcagtaggtgctagctatcatctccagtttctatttcctgaactgtgaccttgactaaatgtggcccagtcctttaagagaggggatttgtggtcactttaaaaaaatcttcagctgtgctcatgtggtccggagtactgtgttagttttcctgcctgtggctcatgggccagtggtcaccatggaaatggtggtggtgggggtaggggtgggggaagagaaggaagccgagctacagagacattcatacacttgttcgtgaccacagcaggatttggggtccttctagagtcactgctgcaggattctttttgtttttttcttttttagaggtggggccttgctctgtcaccctggctagagtgctgtgaaacgatcacagtccactgtaaccttgaacaccaactgcaggattcctattctcttttgtgggcaagatagggtgggggacattgtgcacccccttcttctctgtcccagtctgtgacagaccctgtcagacattgagaggcctgagagctgcaacagtggttgtgccagagaggaatttgccaaagctctcagcgacctttctgcattaaagtttcgtgccattatctctttcacatacaaattcaagcccttttttttcccttgaaatcacttttgtgctgtttaacctctttaccccgatttcccccccttctttcttgctccctttctagtagtttccagctaatggatcacctggataagattgcccctgtctttgtgagagcagcaattagctctcaccctgagaaggcggcgtgttctgttgcttggcagccttggtgtagaggatggattgggtctgcgtcttttcatttgaaagtaggttatcgattagcacggatgccaatttactacagaggctgttgccaatgcctcttgatctcattatggtgtaaattttcaagattgtatcacattagctcaggagaattcaggagagaaaaacgtagtaaagttaaaaaaaaaaaagccaaaaaaaaaaattcttccattatattatagcccaggcaaaaataaacatggctacagctggccatgttcggaaaggacctgcggtgtgtgtgtggctgggttggttatgagctgtaggaaaacctagcgacaggtttcaaagtacttcatgtttttggtttattccttcgatttcttttaggactgattttcttgggaaatggtgatttttagggaaactgcagactgttgggtctatttttttatgacaagagccctctagtctcagctttgtgagacagaaaaaggaggcagggacagtgagatggcagaggaggagatgctggcgaccgtgctaatgctagctaatgctaattttgaggaccagatagtttgggtgcaggcctaactgttgttcagttaggaatctgagatcattcccttccaaaaagtggctttattgagatacaatttatgtgccataaaattcacctgttttaaacgtgtgcgggcctaactcttggccaattaggaatctgagatcattcttctataaaaaatggctttattgagacaatttatgtgccatgaaattcacttgttttaaatgtccagctcggtgcatttccatttattgccaggtctgcagccatcatcactatctaattttagaacatttctgtcactccacaaggaaatggcccattatcagtcagtcttcaccctactccactcccaggcacaggaaaagactaatctgctttccgtctctgtagattttccttttgtagcattttacatgaacaaagtcatacaatctgaggccttttgcagatggcttctttgagttggtacagtgttttcaaggctcaccctgttgtagcatgtatcagtacttcatttctctttattgcctggtaatattccactgtataaacataccacatgctgtatatccattcaccagtcgatggctatgtgggctatttctagtttttggctattatgaataatgctgttatgaacatttgtgtgtcaatttgtgtggacatatggtttcatttcttatggatagatgcctaggtgtggaattggtagttgatatggcaattctatgtttaacattttgagaaacttttttttttgaaatagagtctcactctgtcgcccaggctggagtgcagtggcgccatctcggctcactgcaacctccacctcctgggttcaagtgattctcctgccccagcctcccgagtagctgggattacaggcacgtgccaccatgcctggctaattttttgtatttttagtagagacagggtttcaccgtgttagccaggatggtcttgaacctctgaccctcgtgatccacccgcctcggcctcccaaagtactgggattataggcgtgagccaccacgcccggccccattgagaaacttccaaactcttttcccaaatggcagcaccattttatattcctcccagcaacagatgaggctttcgatgctagtatcaccctgtagctttgatttgcatttcactaatgaccgatgaggtatagcatcttttcgtgcttattgaccattcatatattttctttggaaaaaacatttattcaaccttttggtgttttttaattgggctatttttgttgttgttattgagttgtaagtctttaatatatcctggggtataagtctcttatcagatatatgattggccagtattttctcctggtctgtgagttatcttttcactttcttgatggtgttgtttgaagcacaatagttttctgtttgatgagatccagttgatcaatttttcttttattgcttttggtatctaagaagttgtctaatccaagatcatgaagatttacttccagatttttgtcttaagagtttatagttctggttccaacacttaggtctatggtccatttcgagttaagatcactcatttttcttgcataaagaaattttccagactcattcaggtttcaagaaaatagacttagaatgaccactgtggattttcttttctgtccttcattttctaacaaagcatatgtagtggccgtcacatgctgggtagaatcaagattgcaaagactgacgtaagaatttggcacatgagcaagctggagttggagatcctgacagaatctctaacacatcttctgagggtgggagaactgtcacagaagcaacctgcaggtgtgagatggactccagggccttggcactcatcagaagaaagcttgacctcctcacctgcatggggttggggaacaaagcaaattaagcatcagagaaagacctggcggtatgacacgattaagccataatggcaccagggcacagctgccaagcaggttgtcagaagggcagacagagtgatggagttttttgttggggtactgtcatatagttatttgatgaagccatctctctgtttttgactacattcttgctttcattggattttttcctacatcttgacccctaacctcctgcaacaggtatgggtgggagttgttgtttttttttttttttttttgagctttcttaagtatacctgtggttttcctccaagtcccccaaggatcagttatagctctgggaaagtggggggaagtgagatgctagacttatttttaccaaaatccaagactagtgacacaaggtagaagtcactggatggaatgaacttgtaggatattcccttttggggcactaatcacaaaggcaaattgaatggtagagtgtcaaggtgaactttaatactttgtaacatgagctccaggccaggtcttaaaacatcttggacatattgcaagaaatagctcagccctatagcacattgaatgagaatggagagtggatcctgggttggctttagactctggccttggcgtttgtgtgtacacatgtgcgtcgtcatctgtgcacacaggtacacaaatgtgtctttataatctctggggaagcaggttcacttttaatgttctttcatctgctatttgattttaaaatcttgggggaaagtattgaaaatcaaatgtactcatctgtcctgtgtaaaaataggagtcaaaattttaaaatctgaatttatgcaacaaattaaatatggagtgttacttctcatcacaaaataatctagccattgttaccttcaagagagcagtttctcattgatgcaattaaaatgaacttctcagggattcttttactataaacggaggtgcacccaaaccttatatctctgagaaaacagtggctgtgtaatgagtggtgaattgtttttggcgagtgtggctgccaggttgcttcctcctaaatctgagatggtagacagaggtttattattgctgtagcagatagagagcgtcttgcttgcactgcagaagtctgcccagagcacttaattagacatttctgtggctatttgcagcccagtacaatgggagatcaggggattccagattggaatcctagacatccaaatccatagttagcgttcagagccaaattttttattgcttctctgggattatgctaatcattcaattcaaatttattcaactcacatttttgacattctgctgtgtgctaaggtggtggaaatactttttttttttttttagacagagtcttgctctgtcgcctaggctggagtgcagtggtgcaatcttggttcactgcagcctctgccccccgggttccagcgattctcctgcctcagcctcccgggtagctgggattacaggcacccgccaccacacctggctagtttttgtatttttagtagagatggggtttcgccatgttggccaggctggtctcgaactcctgacctcaggtaatcaggtggcggagatacttaatgaaacctggttccaaccttcaagaatagcacaaggaagggaggggggtctggataaaatcgaaaggtacaagttgtgttgggactaagtggatctaaacatgctttctgaggctgtcattaccccaaaagtcagctttgtgtcaatcaacaaacactgtggtctgtcttttctctcagcaaagtctgaaggagtgggacactccaactgtgtgtcacaggaatgagctgtcatctggcaatttacagaccagcttcaaggattccatttaccaccagtttattcacttgtatttctaatatttatattttcttaagatgatcccctctcccatgtgtgctaattttctaaataacagccacatcgacaaaatgccccctttgatgagtcatgggctgagctgggttctagtgatgctggctacaaccttgagagttaaagaaaagctatttatattttctttttattattttattttattttattttattttgagacagagtctcactctgtcgcccaagctggagtgcggtggcgtgatctcagctcactgcaacctccgcctcccggattcaagcaattctcctgcctcagcctcctgagtagctgggattacaggtgcccgccaccacgtccagctaatttttgtatttttagtagagacggggtttcaccatgttggtcaggctggtctcgaaccccttacctcgtgatccacccaccttggtctcccaaagtgctgggattacaggcgtgggccactgcgcctggccctatattttcttaagatggtcccttctcccacgtgcgctaattttccaaataacagccacatcaacagaatgcccccttcgatgagtcatgggccgagctgggttctagtgatgccggctacagcctcgacagttaaggaaaagccactttcgcaaagaatggaccctgcttccgtaaccttgggttaaatgttgtctgcgagcaccttactgagtttcttcattttttgctttatttgggtgcagctaaaccagctaaacagccttaataagttactccctgggatacaataagctccctgcatctgtgaggtgaaaggcagcccagtgaattctgtcgacagtagctgttctgagaaagtgagcttgaaagggggtgtaggagtcaaaggtgagaggtcatgacgtcagtagtccaaacacctggaggttttagtctaacttcctttcttgttacttagccaggcagtaagttacgtatctctaacttggccttctgtaaagtgggactcttagtacttgccctgcttatctttcagacagaatcaaatgaaatagcagaagtgttttgtcaattaaagtgacatcagatgcaaagagtattattatatcatcatcatcatcatcaccaaaggaactatggtaatgttggataaaaagccaaatacttttttttttctttctttctttctttttttttctgagacagagtctctctctgtagcccaggctggagtgcaatggcgcgatcttggctcactgcaacttccacctcctggattcaagtgattctcctgcctcagcttccagagtagctgggactacaggcgcgcaccaccacgctcagctaatttttgtatttttagtagagacagggtttcaccatgttggccaggatggtctcgatctcttgacctcatgatctgtccgccttggactcccaaagtgccgggattacaggtgtgagccactgcactcagccaagccaggtacttttctaagtaatttaattctctagaagaaaagatgataagatctttgcctggaactggaggccattatcttaagtggaacaagtcagacacaaaaagacaaatactgcgtgttctcacttataagtgggagctaaataatgtgtacacatggacaatagagaaagacagacagtggagattgcaaagatggggcaggttgatgaggaatgagaaattactgaatggacaccatgtagtttattccagtgatggatgcattcaaagctcagacttcaccaatatggaatatgtccatgtaacaaaattacacttggaccccatacatttatacaaaaaaagacctttgacactaggcataactagtggtttggttaatgcagaggagtattgctgtggtcgctttcttttaaccagcttgagagacagtacaagagaaggttcaggttcttgtcttgacagaagtctcagtacacccacctgtactttaggagaatgtggattggaaggctcttggtgtttcagttttctgagtgggtttgagtaattatgttggagagggggaggttgatgagagtgtaacacacttttcgtggctataagagatgataataaagagttattagaacatttattagacacatgatagggaaagttggttaagggccttgaagaacaggcaaaggatgtggaattcatgtttttgagctctagatgatatgatgaaaattgtggttgaggattatttttctgatcttgaggaaattcaagtttgaatgatgaggatgaatgaggttaatcaacactgaaattggaatcagaggcaaattcaaggccgggcgcggtggctcatgcctgtaatcccagcactttgggaggccgaggtgggcgaatcacctgaggtcaggaattcgagacctgcttagccgacatggcaaaaccccatctctactaaaaatacaaaaattagccaggtgtggtggcacacgcttgtaatcccagctacttgggaggctaaggcaggagaatcacttgatcccaggaggtggaggttgcagtgagcctggatcgcaccattgcactccagtctgggcaagaagagtgaaactccatctccaaaaaaaaaaaaaaaaaaaaagaggcaaattcaagacacagtagaacaggggtgtggtcggtgaagccgggagagtaggcaggaagtgaggccagtttgggaaccagcaaagcccacctctctctcgaatagcccctatttgtcccaagatcttactttcctaccatcatgtttggttttgactgaatagctcaattcagagagacatttcaactttccctctgtgctttgcaaactgatgacgaagatatgttttaaggaactagctcccaagttagttcctcttacaaagatgtacagattttaaaactgaacatgtgtgtgttgctgctgagaatgtaaaatcatgcagctgctttggaaaatgatacgacagtttttcaaaaaattaaacaaggaattacatatgattcagcagttccacttctggtataaacccagttgaattgaaagcagggactcaaacaaatatctgtacacccatgttcgtagcaacattattcacagtagccaaaaggtgggaacagcccagtgtccatcatggatggatgagcaaaatgtggtctatgtatttacaatggaatattgttcagaaaaggagtgaaattctgaaacaggctacaacatggatgaaccttggagacatgatgccaagtgaaataagccagtcacaaaggacaaatgttgtatggctttgcttacacgaggtacataaagtaatcagactcagacaggaagtagaatggtggttgtcaggggctggagttgaggggaatggagagttattgtttaacatacagagtttcaattcgggaagatgaaaaagttctggagatgatggtggtgatggttgcgtagcaatgtgaacgtactgaatgccactgcacacttgaaagtggctaatatagtcaagtttacatgtattttaccataataaaaatggtgaactgtcattatcttgcattgttgatgcttttgttcaaatcctgggaaatatgatataataaatctcttcttatgttattccaggtctggaaagtgaactctggttaacttttcaatatcattttccccaggaaaacaaaagataatgatgtttcctaggccaaacacaccttgttaacatttccataacaaaacagcaaactgtcatttaaagtttatctcactgttattcttgagccacaaagaagcaatgtttacagacgattttacactaacaattggatgtgctggaaatgggtatttgggtgatctcagggttcgtgaacctcaggctgtggagtgttcttgttctagatgtccgctgagagttttctttctcaaggggctcctaaattagaggtaagccccctaccacctgtgtgatcccccagaagttagaaccttgcgccttctctgtggcagggaggagacctgtcctctctagagctggaaggttgtgtgttaacaaagttgaaggcagtcatattagtctgttttcactttgctgataaagacacacatgagactgggtaatttataaagacaaagaggtttaatggactcacagttccatgtggctggggaggcctcacaatcatggtggaaggtgaaagtcacgtcttacatggtggcagacaagagagaaagagagtgaagtgaaagaggagaactcctatgagaccatcagatctcgtgagacttactcactaccgtgagaacagtatggggggaaaccacccccgtgattcaattatctcctccccggtccctcccacaacacgtgggaattatgggagctacaattcaagatgaaattaacctatgaaaccatcagatctcgtgagacttactaccatgagaacagtatggggaaactgcccccatgattcagtcatctccccctgggtccctcccacagcatgtgggaattaagggagctacaattcacgatgaaatttgggaggggacacagccagaccatatcagcagcctatgggatgttcccccgagggctccacagccgggtgctcagattgctgggactctcttgtcaggacttcttccttcttttttgcctaggtcttatcagaactaagccatttggtttgtaatctttcctgtaacactggctgcagggtctttagcctggattctagattggagggtacagggcagcagcctcacaggtgcccattagcacatcccacaagcagtcacggcactgcacttgcactggaaacagcttctcattttcccgggagtaccttctgccaactttgagaacaccaattcctaattcctgttccagtatccactttggttttatacataggacatcttttcctataagttttccctgaatgttttgttttgtttttttttttttttacatttcttacagatgtctattaaaatctcagcattcttataaaatactctttgatttgaagaaagtagtcattttcccttaggcttatgatgcctcagtctccctataagagataagaaccaggctgggcgtggtggctcatgcctataatcccagcactttgggaagccaaggtgggtggatcacctgaggtcaggagttcgagaccagcctgaccaagatggtgaaacaccatctctactaaaaatacaaaaattagccggtgtggtggcaggtgcctgtagtcccagctactcgggaggctgaggctggagaatcgcttgaacctgggaggcggaggttgcaatgagccaagatcgtgccactgcactctagcctgggtgacaagagcaagactctgtctcaaaaaaaaaaaaaaaaaaaaaaaaaaaagagataagaaccagatatgcataaatatgaatatttgttcatttgtaatctggctcttcctgtgataagatgccaccaatatttgggtagaatgctggggagaagttacctcccaacattgaaaagagtaaaatcccagcactttgggaggccgaggcgggcggattacctgaggtcaggagttcgagaccagcctggccaacatggtgaaaccccatctctactaaaaatccaaaacttagctgggcgtgatggcagacgcctgtaatcccagctactcgggaggctgaggcaggagaatcatttaaacccaggagacagagggtgcagtgagccgagatcacaccactacacacccacctgggcaataagagtgaaactcttgtctcaaaacaagcaaacaaaaaggattaaatatatataaaaaaatctagaaggaaatatatggataaagaagtttctaagcttgatagaatagaaggtatcacaagagaaaatatagacaggtttgactacataaaaattaaactctgtatatcagaaaacatttgtacgttgacaaaatcaaagggcaggcgacaatctgcagagaatgtaaaaaattacaacgaagcatgaatatctttaatatagaatttttaatacaaattgctaatgtcaacattaagaccgcagtagtttaagggacaaaggcagttgaactgactttgcaaaaggggaaacaaacacacatggctaccaaacgcaagaaaaattgttcaacttcattagtaatcaaataaatgcaaatcgaaacaacagtaagctaccatttttgatgcagcttaacaaagattttgtaaaatgtgatattctttcatataatgaaggataaattaataccattttggaaagcagtgtgatgaaccttaaaattattcttactccttgacctggtagttctatttctgggaatctatcttaaggggataatcctaactaccaggattaatgcacaaaagtatttcctgaagcatttaaaaaaaataattataaagaattagaaagaagctgcatgttcagcattagggaaatggttacagaaattatgatcaatctatttgatcaaatgctgtgtggtctcttaaaataacatttgtaaaatgtttcccatgtttcaggggacgtgctcatgatataattaatgctaagtgataaaaaagcaggatataacctcaaatgtaagtattttctggtctagacagtttaaaacttcacaggaaagaaaaaaaaggatgcttgctacaatattagcagagaataatattgatggctgctggtctcccctagtaaactgtgtttcctaaaagggcatacattactttaaaaacatttttaattttgagatattttgtaaaaatttgattctcatatatctgtcttaagaatttattatataaatcatccttgaataaactaagttacatagttttcaaactctgtctcctgctaaatgatcatctatactgatgactttttaaaataatataaacttccaggagggaggaaagaggtatgtttattttaggggcctccagagcccacagtaactcttccttcttggggagaggagtctaaagataacaggcctgagtttgtgaactctcatctctagtatacttgacttcttctatgtatttattgattgtgtggtatcacagatttggggggtgcgtgtgcaggtgcacgtgtcccgttctgtagtggtggggattgggtttctagtgtacccatcacctcaatagtgaacattacacccaacagataatttttttttacttttagtctcagggcactgtgcaggtttgtgatacaggtaagttgtgtgtcatgggatttgctgtacagatgatttcatcacctaggtagtaagcatagtacccaataggtagtttttgagactcacccttctcttaccctccaccctcaaagtaggtcttggtgtctgttgttcccctcctagtatccatgtgtgctcattgtttagctcccacttataattgagaacacacggtatttggttttctgttcctgtgttagtttgcttaggatgatggcctccagccccatccatgttgctgcaaaagacatgatcttggctgcatagtgttccatggtgtatatgagccacattttctttatccagtctactgttgattggcatctagcttgattccatgtttgcactattgtgaatagtgctgcagtgaacatacgtgtgcatatgcctttatggtagaatgatttatgttcctttggtacttgacttcttattgccattgtgttcaccaaagacaatcatatgactcagtctgtttcaattggtttgaaagcttaggctttcctttttaaataaaccggaaagcttaggctttcctttttaaataaccttttttcaaaatttcatatttttttctcattttaggaatgtaataatagtcatcatgcgttaagagctttcaaagaaccagatcctgttctaaacactttatatgtgttacatcatttaatgttcacagcaatcctctgagatgtaggtactgttatcatcccagttttacagatgagaaaactgaagcacagagaagtcaagtaagtggagaagcccatgttcaaacctgagtcatctgtcgccagagcgtccctccactgcgccagatttatgacaacttacttgttctttatgaaggcagcaactcaggcacagtaggccaaggctgccatctgatgaaacaactggcaaatcaatggcagagaaagattcagagcagagacagggctgcgtccattgatcgtgttaggacctggaccatggggcgctagaaaatgacatggacgccagaaagtttctttttgctgctgactgatcatttatgaactttccatggacttttgaaaataatatcaaaataataccactagaattgttaaagcattccacgtaggacactgggtcatttgatttctgtaggaaaatgtgattttgtaggaaggcgtatggtagtttcttccatataaggccattatctcgtctttgaacctaatttctactgcagttcaggtttggagaggcctaattcatcgtggtggcacagttttaaaatttgcccctcatttggaattgatttagagtttccgtttacatagagtgcttgatgcaggaggcagttatggaaagggaggccctctctgagcacggtgcatggggttagagttgcctagattttggtaacatagtgacactgcaaacaaaactctatggaaacaaaataattttttttttctttttggacacagagtcttcctcatgcagcggtgcaaactcggctcactgcaaccccttgggttcaagcgattgtcctgcctcaggcccccaagtagctgggactacaggcatgtgccaccatgcctggctagttttttgtatttttagtagagatggggttttgccatgttgcccaggctggtctcgaacatctgacctcaggccatccacccaccttggcctcccaaagtgctgggattacaggtgcgagccactgcacctggcctggtttttactttcaaatctgatattttagcctgttagtgttaaccatgtttaactgactcaaatgaaatgctggccctggctcccatatagccagaagaataagaatgctggtaatcaggtattggcgtttcttcaaaaagccaaaatctgttgtaatagaaatactggtaatttcttcactctgtgaagtacatgtgtatgggggtgtgtgtgtgtaggagagggttgaagattttaacagttgtttgcccaaggttactatataatctaaacatatataaggctccaaggcatttagcttatggggaaaattaaatagtggctattttataaaggcaactagttgggaggcctcaatcattgttactttttatgggctctactaggattttatgtaggaaccagtgtgatctggggaggagggattcctttacacacatccttcagaaagccaccattgtattcctgttgcatttgatgaatatccctagtaggtttcttttctccacctgccacctaggtagatcaccactgctgcatgtcacttttactgaagtgagtaaaatctctgctagtagtgttttccaattatgcatatattttcttagtgcttatttggcactgactttggggagtcgtagtctttctgagatgggaataacatcatttgtttgttgcgcctcagttccaccgtcatttaaataggaggcgtgtcgtgatggtgggcaaccttgttcccacctgaccttgtgagatgcgctaggtggattatggtctttgaactacacattgcttgaattccttgggagacgtgggtcacataaacaggagcctgtgatttttcaggattgacggggaggggcatcttcctttcctaaatccttcctttgatctcctcagcggaggtcacttaagcaacagctggctcttctttgcccctggggctccgcttcagggccgggggaaggaggctgagcatgtcgagtgccctgggaaggcccatctgcctgtcaggtgttgtttttccgccaaacaccgaaagagctatgttttgttcctcttaaagagtttaccatccagaagggaaaaataagatagaaagtaaatagctacagcacacagtacctctgaggataggggtaataggattgtggtcaaagcagggtgtgctcggaaccatttgaggcgaccggcaatcatttccttaaaagagtagccttgagaaaagctctaatagatgggtaagattttgatgggattttggtaggagccaaggagagtaatcaaagtggaaaaaggagggactggagcccttgcctggggcttgaggttatcctcgaggtccttcaggatgtccttctgtggcaggaggatgatagaactatttgtttctagtgttttgtatggttttagagccttatatattatggtgacagatccaaggacacaatgatttgatggtgtccctgtaggaagaccccgtttaacaagaccactattttcctggtaaatgagatataagatgtatagtcttttgtttcctcccagcagctactctgtggatacatcctgtgaacttccctttgcaatgattaggatgacagcccctgtctctaagcttctacctgggctccctaagtccattttcttcccattcctaatagctctgaaaacaaccttccactgtgtttcctccagcatatttccgagttgattgtcaagcacagctcttatgatatcactgatctgctcaaagcccttccctggctctcctgttgaatggtgacctgggtgtaaatgcctcagacctctcggtctcctcccacctttccaagccatatccccttcattgactgtgctccaggcaccacctccagagtagacctggggtgggcctcagaactcgcatttctaacgggtttccaggtgatttccgagaaccactgccatagccaagccagacaggtgtggcttaacggacctcagaattctcccttggatatttttttaagtgcatcttccttcactttgattactctccttggctcctaccaaaatcccatcaaaatcttacccatctattagagcttttctcaaggctactcttttaaggaaatgattgccggtcacctcaaatggttccgagcataccctgctttgaccacggtcctattacccctatcctcagaggtactgtgtgctgtagctatttattttctatcttatttttcccttctggatggtaaactctttaagaggaacaaaatatagctccttcggtgtttggcggaagaacaattttgagataagaaatcctactcctcattgattctgttccgcatttggagatgttggcaagtgcgtcgagccactcagagggcacggattagattttattcatattagaatcctctgcatcacccgaccaattatttgcccacagtaagcccatcataaatatttggtgattgaataacaaccttccacactcaagatgttgcaagcctgagaagtaagaagaaagcgctgcatagtcttcctgcttctattcttgtaatcctcttataaaccatgggccttctaagagaacaattattatttttaatgaactggtgtgtggcatagcttaaacctctttattatccttcagcacttagctttgaataggattaatcagccaggaagatctgaggaggggcagggcaggcttcgttcccaggttattgcttttccagtgaaaagcactttgaagaggacagtggagactgatcttttattttaattcaatataattataactttgttttttttacacacatcacacacacacgtgctcacacacttcagaagtctcatggctaacgatggggctgtgtaagttattcattaggaagatttgagaagcagggtcaagcaatggagaaaaggtatatatttttgaggatttatttttagtatttgatataaaaatgtatgagtaatacatgctgattataaagaatgaaaataggacagaagaagatagagtcaaaagttaaagtgcccccggggaagtgtatttatataaagtgacacaggagatattttgaaattttaatgcccaaaagtaaagtaaatgatgttcaccatatagacgacaactaggcacagtttcaccacccaggataattaatgtgtgatttttctggtgtcctcaaaattattagcactcccatgcgtactggagtttcacagatggatttcactttcacatttgagcatttctcagtggtttccagcctcagctctctcttaagcagatgactttagccaagctgagggcagaaaaagctaaggaatgagatcctgtcttgtctcttcctcccctgctccctcccttcctcctaccacccacacatccttcccttttgcagcagatactcgttgagggcttactatgctgcctcactgaggcattgtgccaggtgtcaggaatacagtggtgagcaaaacagacctccagtacttgtgttttgggagattcaaatcaggataccagagtccatgcagtctctggagcagacagcctgagttcaaattccagatcagtacttactatgctatgtgccctcagacaagttacttgtgtctctggcctcaatttcctcatctgtaaaatgggaatgataaaagcatctacctcaaagttatttaatatagggattaaaataaataaagatgtaaagtgattaaaacagagtgtaatatttggtaagtgcttggctgggtgcggtggctcacgcctgtaatcccagcactttggggggccaaggtgggaggatcacctgaggtcaggagtgcaagaccagcctggccaacatggcaaaaccccgtctctactaaaactacaaaaattagctgggcatggtggtgggggcctgtaattccggctagttgggaggctgaggcaggagaatcgcttgaacttgggaggcggaggttgcgtgagtcgagatcgaggtcgcaccattgcactttagcctgggcaatagagagagactccgtctcaaaaaaaaaaaaaaattgtgagtgctcagtaaatgttgttatttacagtcagggtgtgggcagacatttaacaaataataataaataactaggaagttctaactgagataaaggaaagatgatgctctggagagtgtaacgggggttctaatgtagaccggggggtcaggaaggcgtggtgtgcagctggtggtggaaaggaagcccctgcggcagcgtcgggggaggcgggagagtgtggccgctgagctgagctgagctgaggctggagtcccaagcaggggacagactaggtggggcctcagggcatctaagttcacttcattcattttacagatgaagaaactaaggtccagaaagataattgctttgtccagatcacaggctggtgacagagctaaggcaagacgcaggtctccttactcctggtgcactggtgaggaaaccttttaacctcaaactttcatcattttctgtctctatcagatgcaaatctaaatgtccttacacttgttcctggtagggtgccctcgtaccaacagagggcaaatacacgcaagtgtgcacatatatactcccctccctcctccctccctcctcccttcttgagggtggtggtgctcagggtgtatgttggatggtagtgcgtagttgattaggggagaattcaggttgcttctttgtttccagttttaaataatctgacccatgtgtctctttattcatccatcatacctgttcatatatccacatatctttggtttttttttttttgagatggcctctctgttgcccaggctggagtgcagtggtgtaatcttggctcactgcaacctccgcctcccaggttcaagtgattcttctgcctcagcctcccaagcagctgtgattacaggcatgcgccaccatgcccggccaattcctttggtatgtttaaatagagatggggtttcaccatgttggccaggcttggtcgcaaactcctggccttaagaaatctgtctgcttcagcctcccaaagtgctgggattacaggagtgagccactgtgcctggcccatgtatccacatatctactcatccatctgtccatccatccatccatccatccatccatccacccatccacttgttcattgatttattcatgcaatccacaaatatttattgaagggcagatatgtgtcacaaatttgtgttaggtatttttgatggtcagccaaacaaacccggcctctgccctcatgcagtttacagtctgtcagcagcaaatcgaaaggaacatatcctgtgtctacacttccgtgctatcattgtgcgatgggattttaaaaaattcacgagattgttctaacacccacaaggaatgcacactctcgttaatcccacacgactatttctttagtggcttatttgtgtttaatttccaagataggggcggtgatattcccaaatcccatttctctcctaaatctcgttttcacagatgctcagcaaaggatgtagggcgactactgcagcagcacacagcattcaaccaggagtggaatttcatgaactgctctttatttcccttctggtctcttgagtctggttcatcttgtctagagctctgataatctccgagacaaaatatttaaatcttctgcagctctagggactttgaggaaggaatattgtggctaaaatcctaaatattttggaatatcattaatgcaagggttatacagcagatgctgtctggcacaatctccatcccaagagaatgtgtcaatatctttgtatatggaaatgtacatgtatactcataaatttctccagcctcccaattctgtatctctttcccctttgagactgacttttacttcccttctttagcccctgcttactttaatatacattttttctctctgttttcagaaaggggtaaaaaattgttaccataaatgattgatagaggcctgaatttttattgttatctcttccggagtggaaacctgccttttcatagagaacgcagctttaatccaaaggatggactatctaattgttgaatttcaaatataggcagggctgattgagggtatagggtttttcaaacgttcttaaaatcacaatgtatgagtaaaggcataatactgatgggaccacagtacaggacgttttccaaagggcgtgaaagtcattgtgtgacccctgttgatgcctctttattcttgttttgtagaaaaagtaactgatttcttaaaaagcatattaagcccacaccctgtgcccagtatttctttagaacaaccctaaaaaggagacaggattatcttcactttacacccaagacagctgaagacgacagcagctaagaggcttgctcaaggccacacagttaagaattagagttgagcctcagagctggctcttgggtctggaccacctccctgggttaaatacagtcctgtctcagtacacacactgcctcgcctcctgatttttaaggtattacaagttaaacacgcaacaaatagtctagatcagtttcattttgaaataacatagcagttataatgtggatgatattatgcttgaaataaaataatcctgatcatggagcaagcacagtgacctgccttaacagttagatgttagtagagaggacacagagatcatttaaatgctagtaagggcttgtgactgcgttctgaatgcttagtatttttagattcctccaatcgcttctaaccttcagccctgccatggttttttctgtgaccactggaattctaaattcagaaaggttgttagccacctggataattgcacctttgtaacttttaagacaacaacctagaggcagaggataactacaataaatgacttgtaatttcaggtcttagatctctgctttcacataaaaccagctttccacttccttaggttcaccacctgaagaaatcaaagctaagcattaccagaagtcattatctactatttaaagcctgttctaagcgggagacaagccccctttttaggaggcgtgggggcggggggaaggggatccatttctcattttgccatgtttctgcaggaatgtttttaatagggatcctttttacccccagctactctgcagcacaggagtacgactgtatttgaggaggcagcttgacttcatgctccagggagaagtcttttatttcctgttggggttttaaagttgcccttgcttaggtcgttgctgttttataagtcagcctgaatatttaaaggcaggaggcctgttggtctatgttatgttggccttggggcattagaatgacagagcagctttatttaggattgcgaggcaggccatatgtactcaattatcccattttcgaggacttggccatttgtaccacatctccctgcaagccctttcatgagagccactattattattcacattcagtaagacctgagaaatattattagccaggaaagctctcatttacctcgccatctctcgcaacgttactcactgccctcactgcagagcactccttgtgtaccctctaccttaactaagtttgtcccaagaaaatgatgagaaattcttttacgctggcatacacagactaatcaggtttagtgggaagagcgtggcctctcaagtgtggcagatctaggttcacatcctgatctaccggtctgagcttggaaaacattacttcatttttctgaacctcagtttctctgtttgaaaatgggttgaagtggccgggcgcagtggctcacgcctataatcccagcactttggggggccaaggcgggaggattctttgaggccaggagttcgagaccaacctggccaacatggtgaaaccgcgtctttactaaaaatacaaaaaattagccggacgtggtggcgggcgcctgtagtcccagctactcaggaggctgaggcaggagaatgccgtgaacccgggaggcggagcttgcagtgagctgagatcgcgctgctgcactccagcctgggtgacagagcgagactccatctcaaaaaaaaaaaaaaaaaaaaatacacacaaaaacagccgggcatggtggcgcatacctataaccccagctactcaggaggctgaggcatgagaatcacttgcacccaggaggcagaggttgcagtgagccgagatcccactactgcactccagcctgggtgactagagcaagactctgtctcaaaaaaaacaaaacaaaacaaaaacaaaaaaggccgggcgcggtggctcatgcctgtaatcccagcactttgggaggccgaggagggtggatcatgaggtcaggagtttgagaccagcctggacaacatttttagtctctactaaaaatacaaaaattagccaggcatggtggtgtgcgcctatagtcccatctacttgggaggctgaggcaggagaatagcttgaacctgggaggcagaggtttcagtgagccgagactgtgtcattgcactccagcctgggtgacagagcgcgactctgtctcaaaaaaaaaaaaagaaaatgagttaaagttacaaggaagctgattttggcatccataagaaaaatgggcacaacgatcgttgctttttgcgtggattgccacaagaatgtttttggattcacagatgtttaatactacacatcactttctccttctcctacttttcccataggttttcattcaacagatatctgttgattatcttgtggtgtttcaagatgtgtccatctgcattttagctgggcatatgcccaaacagcatagatttcaagctgtcacaacccaccatgggacagatacttcttaaagtgtgtgtgggttgcgttactgggacccccaattgccacaccgctagcatttgtccacttgtaaagattttcttacttgtcttccttgttgaatcaggaagtggacttttacatggtgcatgcagtttttgatgcgcttcctctccctgctccctggaggtgccgcatgaaagcgcttttccctggacgttcagttccctctccactccttgtctctgtgcatcctgcatcttggcatctccccccgtgacatttattcctgtgaatctgaaaacttcctgtatgttttgtggctacattcgtattccagttgctagagcagaggggagcgggtgctgccacgtgaactttggtgttgaaagagcttcaggataaagttttcagaggacctgctatcaaccaaagctacttgaatataattaggaactaggtccagttcctaatcatactccagaggaggataaatccataggctgtccccaagccagttagctctgagtcagcaatgagcttacatcttcacacgcagatgctgtaggtttacttcatatgtccttctgcagtcattgtcctgcacggctcaggtggcagtgacatactggctagggacatggagaggagctctcacaagggatctggaaggtacatcaggcctaggagagaggaacaaatgaaaacggcactggggcttcatggatggtaataattcatacaggagactttccagttagagcactaagtatcaacactatttggagcatcactccaaactgtactcatttcaaactataatgaaatgcgtcttctctgttgtaagatctctctttttttttttttgagatggagtcttgctctgccacccaggctggcatgcagtggtgcgatctcggctcaccgcaacatccatctcccaggttcaagcaattctcctaccttagcctcctgagtagctgggattacaagcgcccgccaccatgcccagctaatttttgtatttttagtagaggcggggtttcgccatgttggccaggctggtctcgagctcctgacctcaggtgatccacctgccttggcctcctaaagtgctgggattacaggcgtgagccaccacgcctggctgttgtaaggatctcttaaatttctcttatggcttcgtctcaaccacagagcaaataatccccttaaaaatcttaagtttttagtttttccagggctttattttgtgtgattttttttttctttaagagatgaggtctcactctgtcacgcaggctggagtgcggtggcagaatcatagctcactgcagcgtcgaactcctcagctcaagtgatcctcccacctcagcctcccaagtagctgggacctcagatgcacaccaccattcctggctaatttttaacaatttctttttgtagaaatggagtcttgctatgttgcccaggctggtcttgaactcctgcctttgagtgatcttgctgccttggactcccaaagtgttgggatgactggagagagccactgtgctgggccttgtttcttaattgttcatttaacaggcctggttggggtgtgaaatggagtccatgtgtgtattttgcatcctctgtaaatatggccgtagagtacattctaaacacagcctttctgatccactggcttttgtgcataccagggtatgacatcgtgttaaaaagaccgttagtgtagtgtattgtttttgtaaatgcagtttattctaagcacactatatgctggaattatttctagagttcatagtggtattatcattaaggtgtatggaaagtatactaattcctattctataggcaaaaacaactggagcacagcaatactactgccttattgaatcttataagaatatagggggaataatacttgaagtgtacaataataataataatatgctcaaccagcaacactaattaccataagaaagatgtggttgagaactacatttccacaataattacacaattgctacactcacttggcaaccttatggtatggctggtatgctagcaaccaaatcttcctgtgtaaaactacttccatgatgttcctgccacaggatttcgtgctgggctgacagaacagaacagtttcctgaggaacgttttctttttctttcttttcttttctttttttttttttttagacatagggtctcgttctgttgcctaggctggagtgcagtggcaggattatggctcactgaacaccttctgggctcaagtgaccctcctgactcagcactctcccccacccccacccacacccccacccccaccaagtagctgggactacaggtgcccacatctggctaatttaaaaaacttttttttaaagagatggggtcttgttatgttgcccagggtggtctggaactcctggcctcaagcaatcctcccacctcaccctcccaaagtgcaggaattataggagtgagtcactgagcccagcccccaaggagacttttctgattgctggtctttgccatcctcagagaaccaggcggggcacccagggtccctctttgttgactcataccttgggttctcttatatttactcaaacataatgtcctgaagttatcagtagtcccttcttattctccagctccctgtaaaggcttaaagcataactctgggaaaatgttttgcttgggtgggcagaaatggtatatttgggtacagatgtgggatgtgaagcctcagctgtcactgcacctgcacccagagtggtccccacttcttccactctttgcatctgtcctgggcaccctcctttatctttgcacaaaggattaagcatttcatgtgatatgccttaaattgattttccttatgagtagggaaagggagtggggatagaagacaattgtttaatccaataatcatgcaagaatgtgttcttgacattaagagaacaactgtagtctgtggagtagcctaagacacagttgcacatagctatgcaggcagttattgatctgaagaatgaaccgtcatggctgctttgaggaataagatgcatcactattgaaggaggccgggagaatactggagagtggtctccaaccctggatcttgatgctgctgtttactgcagccatgcaaaggaatgtgtgcttcaggtctgagtgttcaaggcaggaccagcaaatttccatgaactctctgaccgtaggccacctctgttccattttgcttctttgctcctaaaaaaattaaatatcttaagttagtttataaaacattatactttaaacaggaagtgaaaatgtttttctgtttttaaaagtaatatatgccattgtagagaatgtggaaaatacagaaagattcagagatcacagaattaagaatccaaatgattttgaccagctggaatgatcaagtctgaattagcatgatgatatttaaatgggatgtgttttgctttgacgatttcggcttagggtcctcggagagagaagcctgtgtcccttaagcctagcaaggtacttggcagagaagggcagagtggggcattcctgaatgaacaaatggatgaataaatagaataggatgcatggaattaaggcaggactccctgtgttggaagcaaagctaggagtcacaaggagaacgagcactcaaaaaagagatttctcagcaaggcaaatttacttctgcagaagggtgcttctcacaggactggttgccacgagagcacaccgaacacaggagggaaagggtttttttcattcctaacgcagcttgtccttactgctgtgtcctgcctccattggctggagttggaccgcacaatctaaactgaacccgattggctaacttgaaagacaactttggcgggaagagctgccacagcaggaggggtaaattacagagtgagtagcagacgtgggctctgtagataaggacttacaagggacttacagtccggtgaagaactaaacagcaatggcatctaataaatacccaaggatgagcagttggtttcatcttcatactccctaaggaccggtgggagagttgtttactggacccggaagaaacatgatagaatttctggggcattcactttggaggaaaccatgggatggtctacattgaaggcctgaggaacttttccctcctccgtgctaagttggtagtttccactttccaccacccacttcccacagctccccccaaacacacgtacacatcgtttttcacaccatcatcctttttggtaaagagatgtgtccatttctgtcctgcattagtgagttccttaccaggtgcaaacactgttagatgtcctgaaaaatgtatctcataaaagagctgtagcaggagggagtatcagagaagagagtagctttccttttgctgtctggctgcaaaaccatctggaagcccccgcggaggtgggctgtgtgcccgagccctaccttggagagacacttggttcccttttccagcagatttcttttcctgacagataattctctgttaatcgagggctcctcaaatccgaatctgagcttcctcttctattctcacctctgtgccagggaaattttcttggcaattgaaaccaaagcgataggctggcagtgggactctacttggctgggggtaaaataagcaatgattgcacataattgcagaaaacaattttgaattttattaatgaggtgctccaaacaacatcttttagtccattgtcccacttaacagccaattcaccggagttcattgtgctgtaatttacatctatcttcccccattgataacaccaggcccttgtgttctgtaattgacacaagttggtcattttcaggggtgtttctctctctaaggacataaaataaacaggcttgctggcgagtgggattgagttagcctcatccacagagccaattggctgctgctgcttgacgctcattttccttcctcaggagaggtggcacagccgtgggtacgtgcacagaaagtcctcaggttaaagatgttgaggtggaggcctggggaggcaagcggatgtcgatagtgagaaaacgagacttctttgcctttcctttgcttcttgccacccaggacccaacatctccaggtggagctgatttttagtgtgcgcagccaggctttgggggcagtagaggtaagattcaggggagggtttccaggaggggatataggccaccacctccttcagcatctcatctcaaaatgtagcatgtgtgagtcgccactataggtcccagtgagctcagctagcccagctcctaccttctttgtgtgtttacagcaaaaacgctgtcactgctttcatgtgtctgtttaaacactgtgtggccatcggctctgtgttgggcacttagggagtatgaagatgaaaccaactgctcatccttgggtatttattagatgccattgctatttagttcttcgccagactgtaagtcccttgaggtcaaggatctcgtctcctctgttcttagtatcctctatagaaccgataacagagtggacacttagaaaaacattaacaggccaggcgcagtggctcacgcttgtaatcccagcacttttggaggctgagacgggtggatcatctgaggtcaggagtttgagaccagcctggctaacatggtgaaaccccatttctactaaaaatacaaaaaattagttgggcatggtggtgtacacctataatcccagctactcaggaggctgaggcaggagaatcgcttgaacccgggaggcggaggttgcagtgagctgagatcatgccactgcactccagcctggctgacagagtgagactacatctaaaaaaaataaaacaagaaaaaaaataaaaaaagaaaacattaacaaatggatgaatcaaatggagaagaagagacaagtacagaaacacgtgtagaagtggaaaagaaaaaacaaaaacataaagggagctctaaaaggttacagaaagagctgtgggacatagagagaggtgtttcttttccctggggtgagccgggaagccttcatggaaaggctggcctggagcatgagagattctcatcggtggacggtggaggttgagcatttcaggggtaaattccgagaacattgtacacacataagaaataatgcaaggtgcctatggctttgacttgagcatttggtatgtgcaaggaagtgactggagatcaaaagggaaatgcagattggaaacagggcctgggggtcttgtggcagcttgtgggtggccatgctttccctgggcactgcccgacccaggggactcagctgcgggtggcacgctcggcgtgcaaggcatttgcttactggaaactacacccgtaagaagatactggggtcttgggaaggaaggtgactgttaacctgtgggggtcagcttacagtgtgagtgttggccagaatgatcaagctctccagccttagcccagatcaaaatccagaggccaggaaggatgtaagcctagctctgtgccatgcagctggttggaacagaggtgcagatacaggctccacccctctgggaccatcagctcccagggtgtctgcagcctcacagcatgactctctcccagtcagcccacccccaaggccccgcagctgcagcttctgctgtgctttcattccagggatgggcagggtgacatcaggccacccgcagcctctggcctcagcctctctgcctaggtggcaccatgggctccaaccagccggggcagctgctgggaccaccccgcacaggcccactctgcagtgagggaaggaccgacaggcttgcggctgctggattactcagtatttttcactttaatatcctaatcctgaagttgttctgcgatgtggtgttctggtggtaaatataatcttttggcagagtttttgaactgtctggaacccaatatcctaagctttttttttttttttttactgtatttggattatattgtgggatttttttccccaaggaggaaaaaacgtattttaaaatacaacatgaagtgagtgaaaaaatttgtttaatgcaaataaaagaattgaagctggagggtgagtgtttccagaggaggccatcaccgtaggaggagaagctggactcagagccagggagtcccagagcctgtggtaggccctgtccttgtgtggggagatcagccagttccaagtgcagggaccaaggacattcccaagcccgtcctcagccagctagtcctgcagggctgttcggagcatccaggtcttctgtcattttttcttccccagacaaacctcctagacataggaagccctttcagaagacacatttgcctctccacagctccacccattatcctttaccactggcgatgttctgttcttcttgggacaccacagcgttatttgtctttccagaccaaaaatatatccctcaggagtatggcggtttttaagctcacaccaagggaatgcttgtataggccttgtgtcttcttgtgatgtttcccagcgatgggcctgaacgggagagactagccaactgttgctgaacgcgatattcttttgtgaataaaaaggccctgattccagccaaaccgggatctggtttggctgggtgtgggacgggagcagtcaccgcaagatccccagacatgtgtctgagcccctgtgtggcctgaggctctcccagttagtcatggcagtagaaagtctctccctgctcgagatgcaaaagactcaccatccaaagagttgggccatcccctgcccgctgtgactgtctagctgtctgccccttgacagggcccaaaatgatccagtgctggaggccggctttgcaaacccaaggcagggtctcactgtgttgcccaggctggagtgcggtggcccaatcagctcactgtaaccttgaactcctagactcaagcaatcctcctgcctcagcctctcaaggagctgggattacaggcatgcaccactaagcctgactcatttctttactttttgtagagatggggtcttgctgtgttgcccaggctggtcctcaattcctggcctcaagtgatcctcctgcctcagcctctaagagctctgggattagagatgtgagccactgtgcctggcctcatgataactttttataaagaaaaaaatttaaatcctctgtttcttctcttcctcatcttcccttactttacccacaaacaggggaagaactttctagcaggaaccatttagttctgtcttgggagcacttgtttccttctcagtttcttagaaagtgcagagtctgcttgctggcaccgcaccgtatcaaatgcttgtgatttccattcggcctgcacccacggcagtgggctctgcccgactgctcctcagcgggggcctgggagggggctgaaaagcctggggctggtgggaagtggtactccctccagcatggcggtttggagtcttgaggaagggtccccccttagccgtggcccagggacactgcccctccccacccccagacccttcccgacaacactgcctgcttgggatgctctaggcagaagtgggcggtggggctggcctccatttcagtgcttggtaattttacggttggggtctccgtcttagaagcaatttcccataattccacttgggagagaagtgtctttattgctcatccccattttaaaggtgggtaattgggggcctcaagagattaggagtcttgctcatgataaaacaggaagtggtgggtctgcgatttggaattctgcgttcctgcaggacaccctgccgcccgtgccacctgttctctcccacgtgatgggcgcaaacccctgagaggtcccttttcagctcttgctccattctcagctgttgtgtttccctctccagatcccccacattgacacaagagatgtgatgcctccgggcagttaagggtgaaaagcgaatgcaggttttctctctcctctttgcccccaatcctacgggtgaatgaggcttgcatctctcttttgctaccatcgagagcagcagctcagtcagctaacttccgtttgcctgccggcatgagttcagcgagtttccccttggttttagagccaaagcctgagcacttggtgtaactttgcgtgctgtcgccctgagaggcggcaccgtcgggccccgagtcagccgtgtgctcgaaccgccccactttaccattcctgttcctcaccggtcactctttagtagagtcccgtccacttaaggagcacttcatacccatgaattgagtaaaattattttacagcatatggcatttttcatgactataattacaaaggattctagacgtcattgatgggggttctccctggcgctaacactgagtgagaagttgacccagttagattaaagctcaagttaataaacagcattcacacatttctaggcctgttgaccaatatcctttaaatcagtgtggctttccaaggggggagcaaataaaaccctaaggtagccagagtgctgttttttccaattaaccttgttcgttttgatttcctttcggttcagaacaatttaggtcaatcttagatttttaagaatgaacctctggagggagaggaaattaactaggccctaagggggcttggttaccacaattaaccccaaaagacagactctcaggctggtggggggcctggagaggggccacatgaccacttcaggccatctgctcacatggagaccctggtgggagtgtcctcttttctttcctgctggctggttaaataaactctgcaggctaccacgctgacgaagggtctgcccatttctcatgctccttctgtcttttagccaaagctgtgttccctctctttctgagaagagggatcagcaaacccttaactcccagagatcgctggtggagttcagggatggaagtgcctgatccaggcagacctaaagcagaggtaatggaagagagatgggaggacagagaagaaaagaagggcgtggggcaggaaggcagggccagactcctttctgtgttaggagcagagccttccttcaccggagcctgggcagtcaatcaccctgagagcgctgggagcctttcatcatcatcagaaggcgttgtgcgtggtgtggatgcacacgtgaccgtgtgccgcacctttgttctgcccgttccttactccttatttaggtgatgaaagatgtggtgccccaactttaagttccacttgacgcagaatttcctgattgaggatggagcctggggctaccttgaggtaattacgggatagtcgttgtacctggaacgtacatttttctaaagttgccacacagtaagactcccacagttctgtccacaccccttcccatgacattattgtttcttcaaaagggaccagccgctgagattttgttagcagggaaatctgtttcacaggaaggagggatgtgtagatgggacctaaacatcgaagtttataatttggtgaaaacctgataaatgggaagaccatttgaaatagatgtttcagtggctgggagtcccagatacccttgaatttaacactgctcattacatacctcagtgaccagaaattggagaccagcctgggcaacatcgcaagaccccatctctacaaaaagtaaaaaaaaaaagagtcaggcttagtggtgtgtgcctgtaatcccagctccctgggaggttgaggtggaaggattgcttgagcccaggagttcaaggtgacagtaagctgattgggccactgcactccagcctgggcaacactgtgagatcctgcctctaaaaacatttttttaatatcatcataaactctgtcagaaatacaaaggagcataaagaatgtaacaaacaatctgtatccacaatctggcctaataaataacacattaccatcccatttgaaggctttttgccagacagagggcaagtccttgagcgggcgtccagtgcaggtgtgctgaagagcccagcctcaagcctaaaatgggatagtacaggacatgaacatgtgaggcaagtggatcacctgaggtcaggagtttgagaccagcctgggcaacatggtgaaaccccgtctctagtaaaaatacaaaaaattagctgggcttggtggtgcgcacctgtaatcccaactagttgggaggctgaggcaggagaatcgcttgaacccaggaggtggaggttgcagtgagccgagattgtgctgttgcactccagcctgggttacaagagcaaaactccgtctgaaaaataaataagtaaataaataacgacatagaagacagaatatggtaggcggtaaaagggaaatgctgagcagcagaatgagagtagtcagagttaagaagagggaggcatcttgggagatcggctgaatgagggcaaacttgatgaaggaggtggcatgtcagttgggccacggagaacgggtaggattatctactttgttctgcatacatctccctaacccttcccttaagcttctcttccaaagtttctctgggaagtttctctttcccttcccagactaaagctctttccctgctgtttgtcctctcttgcttggctcaggctatgatggaaaacgtcctcaggctgggtttctgggtgccagatggcagccaccatgggaggaagggtggccgagtactctcagggcccggctccttggtgaccagccaggtgccctccagccagcggccccagcatgacacggtccaggtaacctcccttcaccgtgctattgggagggtgttttccaggactggtgtgaagtagattcagttcccgagaaggacagagctgcctgatgcgtgaacaggcctctctgagaccagggaggccacagctctgagacatgaagcagatgctgctcctcagggcctgtggagagagaactctaccctcttccatttctgaaagccagtggaggcttctcctcctctggaggattcatttcatttgttagttaacgcatccattccttcaacatagattcattccatgtcagctctgccccaggccttatgctgggctcggggtgtggaaaatggaatcgaagctggtctctgctcctgagaggcttacagccccttttagggtatgtgctggatctggaaagctgggatagaagaaattgggtgactgtgtattgtctttgtgcttttgtgtttttttagaggcttctatgatcagaatatttttggactaatgatgtgagttccttagataatttgaaaatgtgcccctatattctctactgtttagagtggtataatgttggcatgacctcatcttcctttcaagattacatattaaaagaaaatttgactttatattaaacgaagtcaaagctgggttcagtggtgagcacctgttgtcccagctgctagggaggctcaggcagaaggatcacttgagcccaggagttcgagtccagcctgggcaacataatgagaccttgtctctaaaaaaaaaattaattaattaaaaaataaataagtaataggaatcagaccccagcatcatagttgtgcatattacctgttatttctttaagagatatcccttctccttgagttccatttttatgggaattacttgctttaaaaaaaaaaaacacacacacacaaaaacttcaaagatacagcattgacatgacgataaacttccatttctttaaataagctccttgcaacatctgatgtatctgtaacaaaaagaagggcaggagaaggagcttgcatttatgtttatgaacagggtaaactcagagacttgcaacctttaccccgccctcccccaccccaccctcaagaagtcccgaagaacaaaaggcaattcagatggcagaatattacttctgttgctgtagcaccaaactattaaaaataaaactgtccctcaaggcaaaacatttcatttattttcctttgaatgagtaacttgtttattaagatgaactaagtggctaaatctagatggtacgcaggcaagaaaaattgatgtattgtagcctttcggaaagtatgctttatgttccctggaatcatctctgggttttaaatgaagaagagctcgtttagtcagatggggagctgctctccctggaaataggcatcacccggctctgcaatgtggaatgtcatatttgaccttggttctttcgcaaattggttctttctgggctaaatcagtgtgttgaaagagttagctaggtttagtgatcttcaaaggaggaccacgttcctgcctcaactgcgtctgcagttttttgaagtgtttaatataaaatcgtttcacttttgccttatttcatatttgagatcactgtgctactgcatctgttagagaggcaacacagagcacagggagccaactgcagtccctggagcttctgagagagctccctttgttgcttcctgacccagcctcagaggcatcccgcccacagggaaggatatttgtctcagcagggaggttccccattactgtctcctcatctggggacacaaatgtgatgtccaattcccctctgattgaggtctcatttgccctaaactaatgcaacttgaaaggagaaaagggtgtcaatggttaaaacaacaacaatgacaagaacaacaaaaacctccacccaatttagcagtgaaacaggaaacgccgtattgaggagagaagcttttagttggaaaaaaaatttctctttagaatttggacaacaaatgactctcactctcttttctggtggtgattgttttatttgttaatttttttttttttttttttgagacggagtctcgctctgtttcccacgctggagtgcaatggcacaatctcggcccgctgcaacctccgctgctggggttcaagcgattctcctgcctcagcctccctagtagctggcattacaggtgcccatcaccacgcccagctatttttttttgtatttttaatagagacggggatttttaccacattggccaggctggtctcgaactcctgacctcaggtgatctgctcgcctcagcctcccaaagtgctaggactataggcatgagccactgcgcccggtcgattgttttattttaatatcacgacacacatattattcctgatttgtaatctcacgatacccgccttgctcgccaagagtcctgagtgctggcctggtaaagatgattatctccatctttcagacgaggaaaccaaagttcagagcacaggtccgcagaacagtcacagctgccagcagttgcacacccacatgcgccatcccatttgatcatcaccaacctgccggttaggttttcttgtcacccgaattttacaaaagtggaacagaagcaccgagagaataaatgagctgcctgagattcatcaactgctggtggaactgggcttagtcctgcattctttccaaagcccccatgcggtgactcagtatttggccatttttctttatcctttttgcctggtgactctgaagagagcccacctacagtccagcatgtctggatcctgtgcagcgggcagaggccagaggccatggtgggggccccagaactcaggctgggaatcccaggggctactccagctttcatgtcaccagagcagtgacattcgggccctcgggggcagactgtgcctgtggcttctcagtggggtgccttagggtcccctcagcagatggatcccatctcctggtctggttagcataagataaacagggatagtagcagcagttgtcactctgagggagggaaggggaagggagggctcaggtgaaaagcagaagggaactctatggctgtctttcttctccctgtttacctgtccacccatctgagagataaaagaagagcagaggagggtgagtgaggaaaaagcaggagggtattgggtgtggggccgatggttttcactcaatccgccgggagatctgaatatcaactctctatggaagaacaagaaccgaggtgtctcttctgccccatttctagcccagggtgaccccaggagctctgcagtgtgccgcatggaatcgcctaagatgggactgccttggaacaaacagtttcaatgtctatttcacatgtgcgctctagctcagaattttaataagcaaatatacatggtaccttgccgtaggggggctttatgtttctaaatctatgaattaataaacaggatgagcctttttaaaaaagggagcttggggcagaatgaaccactaaaaagttattggctcttaactcctgctttttgtagaagcttgacaggcagctgactcagccagacctgaaaccctttccccggttcttgttggcatttctgactttgccatttcagttggcactgacccttccaagactgtgtatgccaggagggagcatctgcccccatctactctctgggaagatgtcctctcccaagagtcaagagtgtcttgttctgaccgtgggttacttctctgtgtctgtctgagaggggaaagcattgtcatcacacaggaggtagcaaatacctacctctttttttttttttttttttttttttttttgagacggagtcttgctctgttgcccaggctggagtgcagtgatgcgatctcagctcactgcaagctttgcctcccgggttcacaccattctctcgcctcagcctcccgagtagctgggactacaggtgcccgccaccacgcgcagctaattttttagtttcaccgtgttagccaggatggtctccatcttctgaccttgtgatctgcctgccccggcctcccaaagtgctgggattataggcgcgagccactgcgcctagtctgctctggtttctaatagaagtaggtatttgcagctaggcgcggtagctcatgcctgtaatcccagcactttgagaggctgaggcaggcagatcgcttgagcccaggggtttcagactagcctgggcaacatggagaaactccatctctacaaaaaatacaaaaaattagccaggtgtggtggcacatgcatgtagttccagctactcaggaggctgaggcgggaggatcacctgagcctaggaggtcaaggctgctgtgagctgtgattgcaccgctgcactctagcctgcgcaacagagtgagatcctgtcccctccaccccaaaaaaaagaaaacaaagaaagaaaccagaacaccaggtgtgtcttcctgagttttcaccctgatcactgcctctcctgccagctccctgctttccagggaagagttggctgcgccaggggacagagcactgactcccacccaggccactgggacagccatatctaggcctcaaaagactatgggggttcctagcaaattccaccttatttgacttctccgaacagcccaaactctgctgggcttcttcccttgccttcataggagacttgatgcagggggcagaggtgagagcccagggggacagctggccttcaggaggggtccttgctgggtgtttccaggagagcttcggcctctctctccgcaccatgttccaggtggcgttgaagaccagtgggtaatttggggggtgtgggaacagaaaatcagaggaacagctagtgttttcttccttgagacttgtttcccctttgacagtttagatggatagtaacaataatcaccgataggaaagtcatcctgactggggtctgaagccttccgtggatgttcccgtctaattctcacagtaaccctgtgggcttttaaggtaagaatgatcactgactccacttttcaccagtgtcggaactgagacttggagaggttcagtgaccagacgatggagtccagggtccagggtccagggtccagggtccggggtccagggtcttcacagcctgtgctccctccccttccgtttctcctcttgctttgggtttgggaagcctccgcggggtgaggtggagagtgcgcctcactagtcaggcaccccgaaggagtaaggcatgtgactgtacaatatcccaataaagcgtgtgggtggtggggatgggtgggcgaggttgagatccattctttaaggcattaaatactgtctctttcaaaaggaggttgtgctgttttgcagctggttttctttaactaccagaaacaccagcattgtttcagaaagccacagaatttccaaacacaatgagaattccaagaggatggggtgtgggttttgggggctggggtgggtatggacaggcttttggggagggaagaccacagcctgagtggttttgtcccccacgggtaatgaatttcacacggctccactgtcctcagttttatctgcaggatgctcaagttgaagcctgggaaagaaggggatcgggaaggagcaggccccagggattacagtggccataaaaaccaaacagtgacccaggacagccccatttggtgtgacctctaatgactgccttccctcagctggtgtcagaggaggcacatggtgtcagttaagttccaaagtgacatttgtataaataagtttgttaatgggaaatgagtttttttttctccctctccaatcttaagaaagtgtgtagcctatatccaaatatttctgaaagagcatcaacagtaacggcaaacaggggagctaatgtcaccaacaaaacttgtgaggtcaacccaaagaaagaagggaataaatgagcaaaactttggaaagagtttctcacatgctgaaaacactcagcaatatttctaacaagcgtggtggcccttcagtcagaagtggcctttctctgaagtttgaagtaaaaaaaaaaaaaaaaaaaaaattctgttcttcctgcttttttttttgagatggagtttcactgttctcacccaggctggagtgcaatggcatgatctcagctcactgtaaccttcgcttcccctgttcaaaccatctcctgcctcagccacccaaatagctggaattacaggcccctaccaccacgtccggctaatttttgtatttttagtggaaatggtgtttcaccatgttggccaggctggtcttgaactcctgacatcaggtggtcagcttgcctcggcctcccaaagtgctgggattacaggtgtgggcacaccgtgcctggcctattcttcctactttttatactttgtgtttgcattcaacttgacaaactcaggcagccttaccagatagcttggtatttgtgagattcagttctgagttttgaagtaaaattttaaatgtgattgtttttatcctttaaagtatagagaagtcaatagccttggcttctaggtctgactgactgttctatggataatggatatggataatgtgaattggaatttatatccgtggaatcaaacatgttcaactgcatgacatgcatgacagaaagtggcacttggcagagacagagagggaaacagtcattctcccgagctgtgaagagtgcaactctagagtacattctcagttcttttatctgtggaggaaaaggcacgttgtcatggttaagaaatatcacatgccaacttagtgacgggggaaagaccctcttaacaaatggtctgggccgggcctggtggctcacgcctgtaatccagcactttgggggctgaggcaggcggatcacctgaggtcaggagttcgagaccagcctggccaacatggtaaaaccccgtctctactaaaaatacaaaaattagccaggtgtggtggtgggtgtctgtaatctcagctacttgggaggctgaggcaggagaatcgcttaaacccgggaggcggaggttgcagtgtgtcgagatcgtaccattgccctccagcctgggtgactagagtgagactccatctcaaaaacaaacaaacaaacaaaaacactaacgtatactctagaggcttacacaattaattgtagaaaatgaaactctgaaagaactagaagaaaatataggtgaatttttatctaatctcaaaatagagcagccttattaaaatacgacagaagggaagcaaaatcaataaatgagcctgaggttgaattacagattacttgtacaagaatattcatagcagcaccacagcaaaaccttgaaacaacccaaatgttgcatattgagagtggataaacaatagagtttttcacacaaaattttcaaaaattttaaaaacaatacccccaaatcgacaaattgtaatgacatataatcctatggctaaactttacaatataatattaagtgcaaaaaacgttacttaatacacaatagcctttcttaacccaatgttttaatatgaaaaatttcaaacattcagtaaaactgaaagaattttctcgtgagtacctgtatgcccatcatcttgtttatccctttcacactttgttatgtttgctttctcacatactcattcattattccctctaattcagcagtcctcagcttggggtgattttgccccccaggaatatctgacagtgtttggagacagttttagttgttacagctgggatagggtactactgacatctggtgtgggtagaggccagggacgctggtcacagcctgcattccacatggcaagcccccaccacagagaatcagctagccccagattgcagcagtgctgaagctgagaacccctgctggaatccatcttattttctgatacatttcagagaaacctggattcactggtatacttcctcctacatatttaagtatgtatatcattaactagatttccatatttatttacagtgtttttcttttgatgtgaaatgtacatgcaatgaaatgcagaagtcttaagggtacattcactgagctttggtcagggcatgcacctgtgtaacccagactcctgtcaggacagaggaccttaccattggcttagaaaatcccccttaactcgtctccagtcaagcctttcagcctcctttccccaggaggcaacaattattctattttttttccaccatagaaaaaagttagaacagtggttctcatagttttgtgtgttttagaattgcatataaatggaataacaacagatgcacgctttgtctgagacttctttcactccatagcacagcagttctgcaagtgtgttctgcagacctcttaggttctccaacactccttcagggggtcccatatgtcacagctattttcattataattctgagacatttttctcctctacactgtgctgacatgtacgtagatggtgcaaaggtaacggtgggtaaattgaggcagtagcaccaaactgtacctttgtcagtgtgttcttcatcaccaccaacttacagaaaaaggagtcagcatcacttaaaaatgccctgggtgaagcagaacagatgtgcatctttttaaatctcagcccctgaatacatgttcttttaatattctgtatgatggccgggtgcagtggctcacgtctgtaatcccagcactttgggaggctgaggcgggtggatcacctgaggtcgggagttcgagaccagcctgaccaatagggacaaaccctgtctctactaaaaatacaaaaattagccgggtgtggtggcgcgtgcctgtaatcccagctactggggaggctgaggcaggagaatcgcttgaacctgggaggcggaggttgcggtgagccaagattgcgccactgcactccagcctgggcaacaagagcaaaactccgtctcaaagaaaaaaaaaaaaaattctgtatgatgtaatggaaggtcctcataaagcacttccactccaccgtagtagcacgattgtcttcaggaagggcgtatacgcagttgtttgagttgccagccaagctagctgcttttctcatggaacaccatttttacctggaagagcaactgaccaactacagttattcaggtttgcgtatgtggcagtgaagctgtcacttcaagggaaacagctgacagcatttgttgctattgatacaacttgaacttgcaaggaagaattagaatttttgaaaacttgtatttgtcaccatgaacttgagagcttcccaataactaacaatttttctgacaagattggtggtgatattgacatatgatttaaaaacataatgacatgcatcaacatttgcaagatatgtataactcactgaataattattttctaaatgacctgtgtaggatattatacagttatacacaggtaaaagttccattccaactgtggcgtagaccaatggatttccatgtagtggagtagaaaaagtttactgataacggtttcagggcccatattgcaactaacctttaagaaactaccacttttaaagttttggtttgtatcaaagatgaatagccataattatctgaaaaggctattaaaatagttcttcatattcctacttcatatctgtgtgaggctgagttttctctatattctccaaccacaaaaacttccagatgagtttccaaggtagtttacaccattttacacttctaccacaatgtctgagactataatagcctttttacaaatttacaacagcaaaacacacaatttcagaattcatagagatgagatactactgtgtaaaaagcaaagctggggactgatacccacaggacttgaggtggcagtaaccttgggtgggagagtcctgcatagccagatgtgtacctggtgaagggccagttaaagcgctgttgtttaaaccaaggagaagggtcctgggggtgccctttgccataggaaactatttcccatagtattagtatctgtggctaacaacatggccacaggctgtactttcctgtccaatctctgtgtatctaagtctgctgaggctgcagattcctgcaaagagcagtcgatggccctctgcaggagggctgatggagaaaacatgcgtcggatgcttacaccggccgtgtcagagaagaggaatgagcctattgctcctgccatgtaatgattcctgttgggagtcagtgactccttttctgtggggctaccctcacccatccacatttctggctttccttgctaggggttcttccctcgtcttccaagtcctgtgcaggtggctggaggccagagaggactcatttggctataatcagaggcattcccctttcctcggtccgtagggatggaagggtttgagcccgagtttatttacccttagcaaaacacaactaggttttattattattattattttagtgcttgggataaaaaggcccataaaaacaatagcataaaacagcttttactgatcaaacgtcatgctgatttatttgtgagtgaaatctgaaccatatggtctggcttcccttaaaatgcacagggggttcaggattaagggaacaaactcttggcaaatttgttttgcgtttcactgagcacatcatgttagaaacaaaatagagcaattgttgagtgcttactgtgtgcaggaaattgtgcttagtgattgatgtccatgatctcgcttcatcttcacaacgatccatgcagtcagcagcgttccccacgaggggcagcagcagtgctgagctcagggccctcatgacctgcaggaaggtgggcaaagtggggaagatctggaatccagtggggaagagtcgtccaccagtgacagcacttccacctaaagtcccctgatcgtgaaagagatgaaactgcaaacgaggacgtgaacttggggcctgtggatcagctggccttctcaggttgcagagagccagctgtgcattgtcttattcccttgtcccagcagagactgaacgctaagtctttcccaccatcaaggcatgaggtttctctctttgccgcatttgtgttgggcatctcagccctcagtctgtattcttgtggagggtgcacctctttttttttttgtttttttgtacacacagttttgctcttagttgcccaggctagagtgcaatggcgcgatctcggctccctgcaacctccttttcccaggttctaagcgattctcctgcctcagcctcctgagtagctgggattacaggcatgcaccaccacgcccggctaattttgtatttttagtagagatggggtttctccatgttggtcaggctggtctcaaactcccgacctcaggtgatccacccgcctcggcctcccaaagtgctgggattataggcataagccaccgcacctggccagatgcatctctttgagtttgggaacgaaaagggtatgatggcagaatcatgtgctgccagtcatgatcacagtgatgttcattctggttcctgggcttaagcttctaatttgctgtaagaaagctcagtgggcttgccctttgcctaagtgaaaccagcttatttccacttttcttcaggcaccctcacggacatccagtgccacggtcctgctttgtcaggcagcatctttcagattcttgaaagacaggcagcttgtttcgaatgacccacagggaatggtgcaccattcactcagtccacccctagcacgggccagtcctatgtcgttttttggcatttttgaggaacagctcccttttcagtaccaggtgacattattacccagatccagttgcggagaggcgtgtgtgtctgtctggttgagctgaaacgtgggcagatcagaaaggaaggaaaactggattaagccaggatttgcttacctggaaggtccagaaagaaattccccttccttccacagccagaggatttcaagtctataatgttgctaaaattagcagtgtaacaaaacttcccatgtgatgtagcacaggttgatggggtaagccagtgtaacatggaaacccactggcacctctgcatctgggcctaaggctgcggcctccgtcctcttcgccatcattggcctctcttgtttcttcccacccctgtcacaccgcccttgaccatggttgtctgtcatgtggattcctcacgggcagagatactaccctctgagcttgctccctgctttgctctggagtgtggaatttaaaacttgtaatgataggagaagggaagaacacagttacagtattagactcactgtttcctgagccactaaatgtatcagactgttatatttgggttattttccaaaaaccttttggtagtcattaaaaaaacactctgaggctgggtgtggtggctcacgcctgtgattccagcactttaggaggctgaggtgggtggattacctgaggtcaggagtttgagaccagcctggccaacatggtggaaccccatctctactaaaaatacaaaaaattagccgggcatggtggcgggcacctgtaatcccagctacttaggaggctgaggcaggagaatcgcttgaacccgggaggcggaggttgcagtgagctcaggttgcgcctctgcactccagcctgggcaacaagagcgaaactctgtctcaaaacaaaacaaacacactgtggctatatttattcatggaaacaatgatataacattcttagacttgccttcaaaggccacctgtattaatagggtcccacgcatgccacttataacatggattctgtagcacattgggacatcggaagccttctccattcactctcccttgctctccctattgttccagcacctcctgagggggccctctttcaggagctttgatcattccctgcacttgtacatttccataactagcaccacctttgtatctagatgtttgcatgcaaggggcatctccaggtatcttcccatgtatccttagttgcccaggcgggcggatcacctgaggtcgggagttcgagaccagcctgaccaacatggggaaatcccacctctactaaaaatacaaagttagctgggcctggaggcgcatgcctgtaatcccagctacttgggaggctgaggcaggagaattgcttgaaactgggaggtggaggttgcagtgagccgagattgcaccaccacactccaccctgggcaacaagagcaaaaactccatctcaaaaaaaaaaaaacaaaaggcagtttccgcagttgtaagtaggactagaggaaagagtgatgataatattgataacaataaaatacaattattgagtgcttactgtatataggagatacacttagtaatttacatgtattatctcacttaatcttcgcagtaatctgaggagataatgttaccctcattttgcagctgaaatgtagcaggttgcttcacccctggaggctgcacgcctagtagtgatggagcagaggcaggagcctagcgtcacctgactccagagttcattctccaatcaccgcatgatactgactcctaatcgtagcctgatggctttaacaagagaaaataaggttaccttccagctagagggatttattattattattattattgtatttctttatttattttgagacagggtctcgttctgttgcccaggctggagtgcaatgatgcaatcttggctcactgcagcctccgcctcccaggttcaagcgattcacatgtctcagcctccctagtaggtcagactacaggcacgtgccacgatatctggctaatttttaaaaattttttttagtagagactgggttttaccatgttggccaggctggtcttgaactcctgacctcatgtgatccacccacttcggtctcccaaagtgctgggattacaagcgtgagccaccgccccctgccggatttatcttacccatgtgtctctgacaggatatattgtcaaattcccaaactgtatttttaggggggttgcaaattttgcttccaaatgatcttctaagagcaggatattctctgcctggagtgatgagggtaccatttctaaaagaggtacattgtagttcaaactcctgcaggtaaggagccgtgacttactaactttcaactttgacacattcgcaggtaagagcagagctacgcactacagcaaaatccaggctgtccgtcagcagctgatgtgcccggtaccttttgtcttggccatcctgttgttcattaatctgatgtatactcactgtgtttgcgtttattttcctaacatttttagcctcatcctattcctataagtgacaggcactgtaactattgaaagtactgattaaaagtagtgtttgattattctgtaagcaaagtaatactttggattaaaacaaagtgactgtcatctgaatcttaatttctgttattttccaaatttctttattcattctcctgttgatgtatatgaagatgaacaaagagagcaaataaaaccactcagaggccgggttcggtggctcacgcctgtaatccccgcactttgggaggccgaggtgggcggatcacaaagtcaggagttcgagaccagcctggccaacatggtaaaaccccatctctacaaaaaatagaaaaattagctgggcgtggcggcacatgcctgtaatcccagctactctggaggctgaggcaggagaatcgcttgaacccgggtggcggaggttgcagtgagccgagatcgcgttattgcactccagcctgggcgatagagcgagactccatctaaaaacaaaacaaaacaaaaagcaaaaaaaaaaaaacaacaacactcagaacccacacctacagtgtaactagagacgaggtgtaccgcagacttggggaaataaatgtcccgaagcagcagagctaactcccagctcccaccaaaaacgatgttacttccaaagatactgcacttgaacaactgaagagagtgctcttgaaataagaaacttagaggcacccaagggatttcagacctatttttgctggtctaagaaaatccaattgatgtaagaatgaccagaaaatggcagcaaacatccataaaaatttgctataaaaagaaaactgccgggcgtggtggctcacgcctgtaatcccagcactttgggaggccgaggcgggtggatcacctgaggtcgggagttcaagactatcctgaccaacatggagaaaccccatctctactaaaaatacaaaaatcagccgggcatggtggcgtgtgcctgtaatcccagctactcgggaggatgaggcaggagaatcgcttgaacccgggaggcagaggttgtggtgagccaagattgcgccattgcactccagcctgggcaacaagagcgaaacttcatgtaaaaaaaaaaaagaaaagaaagaaaggaaaaagaaaacgaaggaaggaaatactccctgaaaacaaccatgaagaaaatgaaaattgttaacaccacctccaacatgaactaaatataattgcacaagcatttaaagaaatgaaagaaaacctaataccagaaatttgaaaaatctcaaacaaaatgctggaaaatgtaaaattaaagattatgacatgccagaaagaaatggaggaaaaagacaaaaaaaaatcatctcaggcatgaagacgagattacaagatgtccattcagattctactgaaaaaaattataagggatattgagaagaggaacgaaaccattcaagacaacaaaaatgagataaagagaggtgaaaagaatcagagaaaaagtgatatataagctaggcaaagaaagtccaacacacaaaattgaagttgaagaacaagcagatggaataaaactaatatttaaaactacaatctaggctgggcgcagtggctcacatccataatcccagcactttgggaggctgaggtgggcagatcacctgaggtcaggagtctgagaccagcctggccaacatggtgaaaccccgtctgtactaaaaatacaaaaaattagccgggcgtggtggcaggcacgtgtaatcccagctacttgggaggctgaggcaggagaatcgcttgatcccgggaggtggaggttgcagtgagccaagttcgtgccactgcgctctagcctgggtgacagagcaagacttcgtctaaaagaaaaataaataaaactagaatccaagaattctttatggaaaaaagaagatgtgactctacatactgaaagtttctacatgcatctgggaaaattgacccagcgtgattaaattctagatgtatcctcataaactttgtggttaaagatgagggagaaggaggaggaggaggataaggaggaagaggaggaagaaaacaaacctctgggcctccagtcaaaaataccaagtcacttaaaaagaaaaaaaaattagattggcatcagccttatcaacagctacgtgcaaagcaagacaaggatggaacaatgttttcaagaaaggtaaggaccatctgaatcaagaattttaaatccagcccatctgtctttcaagtatcaaagttatcgaaaaaaaagttttaatcctacgagaactcagggactactgtcctaacaactccttcctaaagaatatgccagagggttgttaccatcaaacagagagaagactaaggaaatttgtcaaaataactggtggtttgaacaaaagatgcaaaactactttgaaagagggcttcatgtttcagagattaatcggacgtatccatccataagatccttgccaagaaagtttgaataataaaacaatggagctagattgcaatgttttcaccaaatccagaatctctgaagaaattaggatatggctttggcagctctagacgccaaatttgtaaagcaagagaagggaaaaagtgcaagtaattaatggagcttggaaaagacctgaagcaggacagtcaggagtagatgaaagggttttctaagaaaagaagtagaaatgtggaatttggtaaattttattgagaaggcacccgagtagatttaggcttgtagttcttacaaacattaaaaatgttttattgtattaaagagctaatactccttaattatgacttcattatttatgttacagagaagatctagatgcactatttacctccttttgttcctaacctagaaatggtagcaaatacatgtggtttcatttgttttttttttttttttgagatggagttttgctcttgttgcgcaggcaggagtacagtggtgcgatctcagctcaccgcaacctctgcctcccaggttcaagcgattctcctgtcttagcctcccgagtagctgggatcacaggcatgagccaccactcccggctaattttgtatttttagtagagacggggtttctccatgttggtcaggctggtctcgaactcccgacctcaggtgatccacccgccttggcgtcccaaactgctgggattagaggcatgagccatcgcacccggcggtttccttcctttcctccaaagtcacgttgcacatcaatatgtgatttggcaatggttctctttttcactgagccccagtgaagcctcagaattctactcaacgtagcacacgaggcagccattactactctatctgcatttgttggaagttgaaatatatttgctatccctgccctaattgtagggtctgtagcctgattacttggcatcttcatctcacttgtggaaactaacgggattacagacgcactttctcagcaagcgttcattagtcactgagtaaatgacaaacaatgtatgaggctctgggcataatgaaatgattaggacacatttccatcctccaagaggctcacagggcccagaaggaagtgaatgattctgtagaatttgccttgtgaatgtgttactccttaagttatatcgaacattgcagtgatcaagaaatattctactttgtagaaagatcctggaatcacatagaccccaagttttaggcatggcaaaactttatgcacaatttcatatgtaaagtgattttctctgtcctcatccttagtaccttgctactcaaagcgtgacctgaggaccagtggaaagatattacctgggtacttgttagaaaatgcagaattccagtcccataccagatctcttgaaacagaattctcattgtatgaagatacccaggtgacttgtatgtacataaagtgtgagaaacactgcagactcttagtgtccagctagaacaagattgatttgccacctgccacttttctttctccctacacacacttaaaaaaaaatctcttaactaaccacagacacatattccaaatctcatgttctctctgtcataattttcttatttgtaaacttaacatgggaacactattagtacctgtcctgtctgatgagagtgagcatttgctgagatcatgcatctgtggtgttcagtagagtgcccagcttcataaatacatgttatttgtgaatgatatacatgatactagtttaatggaaaattgggacttagaaataatgtttcgggctgggcgcggtggctcacacctgtaatcccagcaatttgggaggctgaggcgggcagatcacctgaggtcaggagtttgagactccagcctggccaacgtggtaaaaccctgtctctactaaaaatacaaaaattagctgggcatggtggcgggcacctgtaatcccagctgctcagggggctgaggcaggagaattgcttgaacctaggaggtggaggttgcagtgagccaagatcgcgccactgcacttcagcctggcctttagaacgagactccctcttaaaaaaaaaaagaaagaaaagaaaaaagaaatttcaacaccgtagcctgttcccagtggaggaaattctgaactttctcgttgttggaactttgtttgatacctctaagtaaatacccaataaaatggtatctaacgcccccctgccgggctgggtggtacccacacttgtacctcgcactcacactcacacacgtcacacacctgtcagggggcacagccccaggtgagcctgagtgctgtgcttgcctcgtggggtgctccatggagatgggtctcccaggcctcagggcttcctgggtgcacctcccgtttctgcgtgcagggagggatggctacaggactgggcgggagaactttcccagtgtggtgaggcgtgctggtgagacagcagtgtttcctgggttacatgtgggcaggactgggttggagatgggcccgcaatttggcctcctgacttggggtgctccagtctgcaggtggaagttcttcccggcggcttgcaaagaagaaaagcgaggagaagggcactgatttattcagcagggcatttccttggtttggctgaaagcttttgacttgcgtgagctcagcaggggagcgccgtttccaggcctcgcaacaccggcctgctattaagtgtttctaagagaataaaagcctgttgtgttaaaaggacttgccctccgccagcagcagtgggcccattagccaatccgttggacacccggtggcacacaggctggctctgcaggaggtcctcctggcctcctgcccctgtgtctttcagaaggcagagtccgtgggagagatctgcttccccatcctcctgcctggtggagctgagagtgtcaactgacactgtcccttcggcctcctcctctgtccctactgcgctgggttgagttgcctgtggaggggctccgcttcccttcctttgtggagctgatgtgttcaggaaaatattcgaatatgttagatttgtataaactaggtcattactctcttgctttaaggttatacttcaaaggccatagttaattaaaggtaggtgtcctttgtcattcaaagtgaacatttgtgtcagttcaataatatttgcttttaaatttccgttaagacatacgggttgggtgtggtggctcatgcttgtaattccagtgctttgagaggctgaggcaggaggatggctcgaggccaggagttccagaccagtctcggcaacatagcaagatcctttccttaaaaaaaaaaagaaaaattagccaggcatggtggcattcacctttaattctagctactcaggaggcagaggtggggggatcgcttgagcctaagagtttgaggttgcaatgagctatgatcacgccactgcactcgagcttgggtgacagagactctggaaacaaagaaaagaaaagaaagggagagacggagggagagaggcagggaggaaggaagggttcagaatatagaaagagggaaggaaaggagggagggaggaagggaataagggttcagaatatagatagaaaggaaaagtccacagaaaactggagtaaagtctgaagctcctgaaataatagtcagtgtgctaagcaggaacagtgtgtacaattttaagacatgagagtgaaataccgggtttgtcatttgcataagtttttgagtagttagaataaacagtgcttatcgccttcccaaaacaccccaccactataagctgcttgtacacactgcatcacttatttttttttttttttttgagacagagtctcgctctgtcacccaggctggagggcagtggcaccatcttggctcactgcaacctccacctcctggggtcaagtgattctcctgccccagcttcccgagtagctgggactacaggtgtgcgccaccatgcctggctaatttttctatttttagtcgagacggggtttcaccatgctggtcaggctggtctcgaactcctgaccttgtagtctgcctgcttcggcctcccaaaatgttgggattacaggcgtgagtgagcctctggcatcacttatgttttaatgaccaaggtgtatacaggtaagaaagttaagcatgtaagtgccaagttcatgtcttggttctatcatttaccagccatgggctttgggcaagttagttttaacctcattcagcctcaacgtcttcaactctaaaatgggaataaatgttgcctccatcatagatttattgtgaaagttaaaggatattgcgtataaaatggcttagcatagttcctgggacgtaattgacaatcaatattataattattaatatgtgaactataggatttttattatttaaaagaacctttaagtgaatttcttataaacctataatgttagcaatgctatgaataaaatttgttttataaggttgaagtttggtatgttgtattttcttgaagcaaattttataatgcatgcgacttgatttttccttgtcctttcctatttttggtaagaatgtctaaacctgaaaacaatggagtgtagaaataaaaatacatgatgcggaatctgagaatgccaatgctaggggaaaggaatactgagtgtgtgtggccgtgagccccgtgggggctgggatttgctcgctgctgtatccccagggcagaacaccatgggtggcatgcagtaggtgcctaatcagtgtgtgttgcttgaataaatgaatgagaccacatagcccaacaccttcattttgtagatggaaacataaggcacagagaagtaaagtgacttgtctgaaattacttaaggccgatctgggactgagtctctggtccgtgtgatcacaaatgcttctaaggctcacaacgtagcagaatttgtctgcaatgaagatcgtggtgtcttcagcagcacactggctggctggttatctctctttcttcctctgtcctctgctccctctttctacttcttcccttctttcttcctcccattcttgcccattgcccctggtggcgtgtcctttgctaaatgagggctagacagatgtaacttacagctctgtctcataccacgcaactctaaagtccatccttagactacgacttagagcagatgtgaatgtttaacctcccttctctctggacatatggcatcatcttatttctctgttagctggtctgccctcctgccacccatttcaaggcactgttggctcctggaagccatctggatggagtttttgtaacgggaaagtgctcctccagcacccaggaagccttgggtgggtgatggtccctgtgatcacccagccgtggtaaggcctgcttcccttgcttagcaaaaccgtaccctggtggatggtgatgctgcagccggggcccagggggtctatgagcatcatggcaaaaaagcctttatgggagctcccagtttactactttcagcctttcggaaacacacacatttccttccattctttactggcaacactgtcttttgtacagactgtatttgtttggattaatacagggagtctgcaaatttttgttcaaataagaatattgtagctgggtgcagtgttccacacctgtaatcccagcactttgggaggccaaggcgtgaaggttgcttgagctcaggagttcagagccagcctgggcaacatagtgagacctcatctctgctaagtaaataagtaaaaattaatcaggcgtggtgacatgtgcctgtggtcccagctacttgggaggctgagatgggaggatcacttgagccccggaggtcgaggctgtggtgagccatgattgcactactgcactccaacctgggcaacagagcaagaccctgtctcaaaaaaaaaaaaaaagttgttatttggccaggcatgctggctcatgcccgtaatcccagcactttgggaggccaaggcaggcagatcacctgaggtcaggagttcaagaccagactgaccaacatggtgagaccccatctctactaaaaaaaatacaaaaattagctgggcatggtggcaggcacatgtaatcccaactactcaggaggctgaggcacaagaatcacttgaacccaagaggcagaggttgcagtgagccgagatcgcaccactgtgctccagcctgcgtgacagaaacttcatctcatctaaaaaaaagaatattgtcatttgagaatcacaaaactctgatctttttaaacataggagagtgatatagagcagtgcttctcaaactgtatttgatgaaggaccagttttcaaattttccatatcgtgttgcagatcaacctatccatcaaagacaataaaaatgaatagaaaaatggaaaaaaatcccaaacccaaaagacattaaaaagtcctcaattttttttattactcagaacaattgggctgggcatggtggctcacacctgtaatcccagcactttgggaggcagagacgggtggatcacttgaggtcaggagtttgagaccagcctgcccaacatggcaaaaccccatctctactaaaaatacaaaaatttagctgggtgtagtggcaggcgcctgtaatctcagctactcgggaggctgaggcaggagaattgcttgaacctgggaggcggaggttgcagtgagctgagttggtgccactgcactccagcctgggtgacaagagcaaaactgtctcaaaaaacaaaacaaaacaaaaaaaccccaattgatctaaaattatacatattgctgcaaaaaattctaaatgcttagtctcaatttctacacttccttctgggtgttggtagcaaactctctgtagacccgactttgaggagctcttgatatggagacgtggtttcttacgtctaatttcgttttccaccatctactgcaagagttgtattttctgcctcacgtcgctgtccttctcccagcccattcattttacttcccctctcagaatggcctgtgtagtgggaggcccaggacatttagtggaagatggacatgggcaggagttaacgcgtcctccagagaatgcctccatgttcttccgtcatccgtgcagatatcaggctgcagtcccgcagaaaatgatgatgttgcacaaggcgaagaagcagatattgacatgaggccaataaaacaggtcatgagccaataaaaatgaccatctgattcactttccagaagagctacgttttaatgatttactagaaagcgaattctttctttgcatcaatttttatcaaaaacttaatgccattaataggtgaagaacacatttttgattcattgactaggattatggttagtaaaatgattttcttttgtttgggttttcattgttgttttagacagagtctctctctgtcgcccaggctggagtgcagtggcgtgatctcagctcactgcaacctctgcctcctaggttcaagcaattcttctgctttggcctccatagtagctgggattacaggtgcccgccaccacgcctggctaattttttgtatttttagtagagacgggttttcactatgttggccaggctggtctcaaactcctgacctcaggtgatctggcctcccagagtgctgggattacaggcatgagccattgtgtcctgaccagtaaaatgattttctgaatgttttagtgtttttccttccaaaagttgtctttcctgacagtgtatttttattttactatataaagagtcactttccggccgggtgtggtcactcacgcctgtaatcccagccctttgggaggccgaggcgggcggatcacttgaggtcaggagtttgagaccagcctgggaaacatggagaaactctattaaaaatacaaagattagccgagtgtcatggcgcacacctgtagtcccagttactcaggaggctgaggcatgagaactgcttgaacccgggaggcggaggttgcagtcagccgagatcgtgcttccagcctgggcaacagagtgagactctgtctcaaaaaaaaagagagtcatttcccgtgaaaaccacgtggtctttctgcatccctaggggttattctggtgcctaacgacttcctgagtccactttcgccgcttccatggccacattcgctttatttttctcttcttaggggaggggaaggcagggcatagttgctgtaatttgtagagttgggttgatcagtcgcaccttagtgtatatacctcagtgtggaaatgtctgaaaattgtaactttgggtttgtagaatttgttttccatttcataagtcctggaattttaaagtcctgcattttcggttcgtttagaggaagctgcatatacacatacatgtacagacatacgagtgtgtatagaatgtggagaaataccactgccctcagactctcgtgagattatatttaatctttttccttctagggaaaatttcaaaaaggtaggagggggctcgtgatatattaacatttttaccaaaagctctgttagggctggaggggagacagcagagaagagcaacaagggaagttttagtgagatatagccatatcagaaaagcaacaatacatttagggaagctgggagaggcaggagatgccgctgtgggagggagctggaaggctacagggacctgccagagggaggctggaggctgtgggccaggtggctcagggaggctggaggaaggtcagaaccagcctggcagagagcctgaagtgacttggagaatgaggtggaaagaaacttgcttcctctgtgccctgagctcaaagataaaggactctggcccggcccaaggtccctgcccccagagtccccgcccagggatcatggatctccaccttttcctactcttgggtctcacagggcctggggattgggaaacagagtattgccaagccttattaagcagctgtttattgggtcagaatacacctgtcaggaaaatcatcggtagtgagcagtttcttcccgttaccagtaaatgtcggaatttcctgagtgcagctctgaaggatttagaggtgtcattcccagagattagcagggacctaatctgtgaagtgaaggtggaatgaccaggatggccagagccagaggaagaccacgaagccagagggtgccccgacagaggaaaagcggccggtgggttttagatcctcatttggccagagggaggcagctggatcggcttctccagagcctgctggctggaggttggctgtccgtggtggtctggttctaagtaggagaagaggtggaacttggagctgggcaccagctggcactgctgtgttcagagcatgggaggaagcagcagcagcagaatcccaggacccccaaagtgggagaagggctcccaggtgccttacaggtcacagtcgagggccttcttaaaagctggcccaaacctgccctttccttgcagcccaatggcctcaggagacagtgactcacgctgtgtccacctgtgtcatcctgtggacagctggaggtccacgggaacagctgctatggcggcggacacagccccgtccagggcccatggcagccccagctggctgcccgctccctcctgtgggcagtgcttcacagcggcagcgggagcactgggtgcagcctctggaaggtctggaaggtgcttgctttggggactcggccctggtggatccccttagcctgtggtatgagctcagtccccatttctcaggtggccttcaaggctcattcctgactcacccagcctcatctccagccattcgagatgcaggcgttgtcattccttgaaattctcacgccttctagatcctctgtgcttttcatcacactatttcctctgcctggaatgtctgtctttgcctgggaaacaaaagagaaaaatgcctgactgttagatttaaaatagcatctcaaagctcacgttatttttaaatatttcaaacacatagataagaatagagaataacataatcccagtgctttgggaggccatggctggaggatctcttgaggccaggagtttgagaccagcctgggctacacagcgagaccctgtctctatgccttccccccccaaaatagggaacatattgaatgtccggcattagcgttatcagatcttactgctatgccgtatgtacttcaaatctcgttttattttaaagaatgaaacaataaagatttagctgaggcgctcagggtgccctttcccactcctggtctccttccttgcaaaggataatgtctacccttgtgttaactagcccatgtatggtgttctcatttgagctagatattctacctaagaaatctaaacacatacattgtattggactaataaaaagttgtatgtaaattatatattgtgcatgaccagcaattggccttttcactcaatatgatgtttttgaaatttattcaagttgacacatgtatagtattagcagctgcatggtgttccattgtatatatatgtggttttttgtttgtttgtttgtttgtttgagatggaatcttgctctgtcgcccaggctggagtggagtggcgtgatctcggctcactgcatcctctgtctcccgggttcaagtgattctcctgcctcagcctcctgagtagctgggattacaggcacgcaccaccacaactggctaatttttgtatttttagcagagacggggtttcaccatgttgctcaggctggtctcgaactcctgacatcatgatctgcccgccttggcctcccaaagtgctgggattacaggcatgagccaccgcgcccagccatatgtggtttatttacttctcctatggatggacatttcggatttttccctcagttacctacagtgctgctgtgtgcattcttgcatatgtattcttttgcacctacatggaagttctctgatatattcagaggagagaggaggtaaactgtcaagtcataagttgtacatgtcttcaactttacaacttatcaccaaattgctctccaaagtggctgttccagttggacatgcccatcctgtttctcccttgccaatacttgtctttatcaaactttaaatatttgccaatcacatgggtgagaagtgctatctcattgttttaacgagcatctccctggttcctggtgagattgaccatctttgcaaatgccagttgtgtttccccttccatgacctaaatgttcacatcctttgcccatttttccatttgatgcatatgttgtccctactgatgtagggtatggattctatatatatacatacatatatatatatacacacacacacacacacacacacatatatatatacacacatacataaaaggatcttttgttggctatgtgcataacgtgtttctcctcccagtctgtggttggtcttttcacagtgtttaaagagtctttttaaacaaaagttttaacttcaataaagccaaatttacccccattcttctgtattgcttatgctttttgagtggtttatctaagaaatacaaactccatctgtaataaaaatacaaaaaaaaattagccaggcatggtggcacacgcctgtagtcccagttactcgggaggctgaggcaggagaatcgcttgaacctgggaggtggaggttgcagtgggccgagatcatgccactgcactctagcctgggcaacagagtgagactctgtcttgtaaaaataaaaaagaagaaaaagaaagaaaggaaaggaaaggaaaggaaaagaaagataccctttctatagccttctattttttatttttcccttttttgacttttgagacagggtctcactctgatgtccaggttggaatacagtggtgtgatcatggctcactgcagtctccagctcctcactcaagcaatcctcttgcctcggcctcttgtcctgttgagtagctaggactacaggcatgcaccatcatgcctggctaatttttatttatttatttattttttgtagagattgggtcttgctatgttacccaggctgatctcgaactcctggcctcaagcaatctttccaccttagcctcccaaagtgctgggattgtaggagtgagccactgtacctggcctccttttatatttttttctaaatatcattctatatgttcttctaaaagcccatttgttccattactctgaaagacaatccaagatacgtcagagtctcttcttgggaaatatggaatgacgtcttgcatattgtcatgatatgtagtgggtgggtaaaatccgtgaaagggtgagtattttgcttttaaagttctgtgactatgggatggcactctaagcttcagctgcagttgggaaagacttttgctgtagaccaattttattgtacttagtcgagttctagagggagccaggcccagaaaatgagggggacatttacgtcatggaacacagaggaagactcatgaaatggcaagagaccctcccctcccctgacttccaatgtgacacccgtcttctctgtcctctctcttcatactgttgtcttaggtgttccttgtaaccagacttcaaactatctgaaaacgtttgtgagaaggaacacacagacacgcacactcacacacacacacacacacacacacacacacacacagaactgctttggacttggatacttcctagtcctcctgttattcctatgaacgattccttctgttcttctaagtcccttctactttattcagagattatcatcatgactgctcatgatggcagtcagtttatccagatcacaagtcagaagggtgaaatcggctgaaaagaggatgaaatgttttaaacgctcaagaatttccagtcaccacagtcctgaggttcgttgtttcttttctgtctgaaagctgtagaactccatgcagggagcctgtgagcctcggtgggctgatgaaacactcagaagaaaaaagaacttgatggaggcagttgcctgtttagcagacgggatctgaatggaaggtctgagggtctgcagatgtcagagctgtccatggctttgcctggtgtctgtctgagcgatctggcctttgtccctgatgcctaatctgcctgtttgtctctctgagatagccaccaggtggtctactgatgatcaaagccctcgatggtgcagactgctgtcacccctcggctgagtcccaagatggggagtttgagaatgccgagtcttgctgttgccctttctgaatggggtgatgcctggtcagatttcagtttcctggaacatgtgttaatggttctcagcagagggtagggctttatttacacacctggctcagtctagactgcagacctttcaaaggtttgcagagcggccgggcgcagtggctcacgcctctaatctcagcactttgggaggccaaggtaggcagatcacctgaagtcagcagttcaagaccagcctggccaacatggtgaaaccccatctctacaaaaatacaacaacaaaaaaaattgctgggtgcggtggctcatgcctgtaaccccggcactttgggaggccgaggcgggtggatcacgaggtcaggagttcaataccaacctggccaagatggtgaaactgtctttactaaaaatacaaaaaagccgggcgtggtggcgggtgcctgcaatcccagctattcaggaggctgaggcagagaattgcttgaacccaagaggcggagattgcagtgagccgagatcacactactacagtccagcctgggtgacagagtaagactccgtctcaaaaaaaaaaaaaaaaattagccaggcatgatggcagatgcttgtagtcccagctactcaggaggctgaggcaggagaatcgcttgaacctgggaggcggagcttgccatgagccgagatcgtgccactgcactccagcctgggcgacagagcgagactccgtctcaaaaaagaaaaaaaaaaaaaaaaagaaaggtttgcagagtaactttgtgtggctttcttgatcaactgtgggtggacttaagatttacagccgaataaaggacttaaaaatacagccctggaatttttgcctcttcaaatgtccttcttgaaaagaacccctttcagaaagttccactttttaggtggagccccctgagccaacgctctgctcttcggaatcattgatctgtctggggatgagcaatgctgttgtcttcatcatcctcgtcttcagcagcatcaacagcaaggtgaatatttagctggtacacatacaggtggccacaccactcaccacctgttaaaatattgagacactgccacacgtgttggtcaagagctgctgctctgagtcccagtctccccaccacccaggccctgcctctgggatctctgggacctccccacaaatcagcaatgaaagcgttggcacctgaccccacagtgggtctccagggctctgctcagcactccagctggtttatattctggtaggaagacagacacccacacacccactcccatagtcattgaggaatccattctgattgatgcccatgccacagagttgttaaatatcgtgaatttcaagtcatcctaagacaaaaatctgggctcttttctttggttagaagacaaaggaattccagcgtatgcagagctgtgtactgggttctttggagacattataatatatatagatgggccctgaaaggcttgcttgtaagggcagaacacacacacacacacacacacacacagacacacacacacagacacagacacacacagacacagacacacacagatacagacacacacacacacacagacacagacacacacacacacaaacttaaaaaagcaacatgtcaccacattgacactgatgtagattgtaagtgcagaggggccagagggtaaagatctagacagattgttcagagtgtaaatcacttagttttctgtgttcttaacagtgcctgccactgtggctgcttaggatttcttttctttttttaatatttaaaattttggctgggcatggtggctcgtgcctgtaatcccagcactttgggaggccaaggccggtggatcacttgaggtcaggagtttgagaccagcctgaccaacatagtgaaatctcatctctactaaaaaaaaaaaaaaaaaaaattagctgggcgtggtggtgctcacctataatcccagctactcgggaggctgaggcaggagaatcgcttgaacctgggcagggaaggtggcaatcagccgagatcctgccaatgtaccccagcctgggcgacagagcgagactgcatcttaaaaaaaataaaaataaaatttgagatgcttggaggaatagaaaattggtgaatgtttgaggcaggacgtgctaacgaagagaagaggctgacattctgcccgagaagcagggcacgatggcgtggcagccctgggctgtcgctggagcgagcttgtttatggaagtaagaggaagtgggcccgagggatgcagagcagacttgcagggtcctgaaggctggaaactagattttgggtgtattaggaaaatcatgaagacatgttgaagaactatcagccatctcttaaactagaaggcaggccttgccccagaacaattaagtcatctgtttggagaagagggaacagagaggagcctcgtggcctcaaccactattttatcgtgacattctgcagaaatcctggccattttttcttttgctctctgtacctttctgaacttctctgcagggaagtgttgcagcagatgccctcagctcaccagagcccgtgttagccctggttccggtcctcagtctcactgggtgataagggaagatgagggaaaactacttctatcagtcacagcaccaacagtgccaacacggccgtgcacatccaaatggcttcattatgctcaacagcctgggtgagtctgagccttacagctaagatgcattgctttttttttttccctcggtgtgataaaaatgctggtagtatacttttataccccaaaataactgagcacattgagaaagacacggcgacctacttgggaacttcagcagtattagctggaacgctgtctggacagtggaaggactttttgcagggagctgccgtcagaggactgagagccagcgttcagcacggcatcactgagggcgcctggcatgcctccgcctgcccgtgagaaggcacgcttaccttctagatttctcacactcctccagagttgcattctgcttccgtaactgtcctagaacagcatttcctgtatgaagatacacaggtttggccagagactgaactctggttacttcctgaacttgggaacaatcctcaccaaatccactaactattaatcatggtcacagacactctcttgcttttgcatgctctgctgtgatgaagattgttgacgccaagaactaaatcgtaatgagcccacgtgctcttcacagcaggctccgataacactttgtcgcttttatggttaaacctcctcgtaaaatctctctttaagcgaacacgtgattatccccacggtagtttaaactgaacttgatttgtgagtttatttcttcttttccatctgagatgtttgccaatatctctgacatatattctcctatggaaatagccagaaaatgatggatcgaggaaatcaagtgtaaatcagtctgtacctccgagtggaaaccagtcagtgggatgtgaatatacttaatatgttctgttgtcttgtgtattgaaggagccttcatggagattttatatctctggagaaactcctgcaggttgcctttttagagagaggtttgaaataagaacaaagaaagtgagttcgctttagctgagtaaggcagggggcaagtgaagcagtgttagaggaggtaatgtggcagctgtctataacaggtggagcaaggtgatttttgtgtgtttgtttgtttttggtttatttttgagatggagtcttgctctttcgcccaggctggagagcagtggcatgatctcggctcactgcaacctctacctcccaggttcaagcgcctcctgagtagctgggattacaggtgtgtgccaccatgcctggctaattttttgtatattttttagaagagacagggtttcactgtgttagctgggatggtctcgatcttctgaccttgtgatccgcccgccttggcttcccaaagtgctgggattacaagtgtgaggcaccgcgcccagccacaagatgagttttaatggccaaacagaattcctgtttcacaacaattgacattgtgtcggctcccttgtttgtgcatatgtgttaatctattttttttttttttttttttttgagtctcaccttgtcgcctaggccggagtgcaatggcatgatcttggctcactgcaacctccacttcccgggttaattatcctgcctcagcctccctagtagctgggactacaggtgcccaccaccacgcctggctaacttttgtatttttagtagagatggggtttcaccatggtggccaggctggtctggaactcctgagctcaagtgatctaccttcctaggcctcccagagtgttgggattacaggcgtgagccactgcatcaaaatgcaatttattttggatactgaatgcacagaactgatctgggaagcattgctttgttttggagtttgtccaggacaggttagaataatattaacatttgatctgaaggcaaccttacctagattatctataaattgttataccacgagacagaagaaatcctattttcccacttaatatctgtgttaaaaattatcctccaaatatctatcaaattttaaaaattatgaaacatattaaaaaatttaaatctataggaaataatataacatgatccgtgtagctttcatgcatatttagcatgttgacatactttcttcagatgtgttttttaatagaaacattattgtcgaaggcttcttatttccctcttctttccatcctgttgcactttctttttccttagagataaccaaaattagcctcctacatacttttatgggtacctacatctctttgtaggtaggcgtattatatatagtaaagtacaataccgtatattttgtatgctttaaaattatttaatatggtaagatgctccacatatcagttgagaacttgacagtttcaagatttatctatccatttggtttatttgaactgtggtataactttctgatgaatgactgtaccttgatttacttagcttttcttcctgtgatggacactgttacaagcggtgctataataaacttgtgcaagtaactcttcatacctgtcttggtcatgtaatgtgctggctcacaggacacatacatagtcttcagcttaactagatgttgccagtttgttctccaaaatggcttctctgcaaatctcactaccattccatattttcagattctaaaatcctgccatcctcagatgaggataaaacgatgttttcttgttttgagatggaacatcttttcatagttttattgaccatgggagttttctcttttaagaattgcctattcattttctttgcccgtgttttttctcattgtattgtcttatttgtgtccattattgtaattgaattttaggatatttgaatgtaaatcttttgttatcgtattgggggttcccaagaccacttctaggctcagtaactcactaggttgctcaagaggctcagcctatagtcctactcacagcaaagacttattacagtaaaaagatataaagcaaaattagccaggggaaaaggcacagagggtggagtccagaggaaaccacgtgcaagcttccaagagtcttctccagtcacataggacacacttcgtttccccagcatcacattatgacaacaggtgtgaagtgtgtctaccaggaaagctcattagagacttagggaccaaggtttttgttgggggctggttatataggcaacctctctgccttgcctgtacccaaattccagattctcagaaggtaagcaggtgtttagcataaaccacactatttgtacaaatatttaggcacagtgagtcactcttaccagttctaggaatggtaggaaccctcctgaaatcttaagttctcagatgccagccaagagtcaaccttgcaggcaggtcttctaactttctaattttaacttttctctgcacggttatgttcatttcaaatatcttctcctaatctgtgtttatattgtcttttgctcatccagcagtaatatctgtctttttcaacgctttataattttaatatcatgcaaaaaaatccttgcctaccccattcataaaggtagctccttatatctttctctaataattttaacacattcctttttgtatttaagactgtaacctaactggaggttatttttgtgactggtaaaagatatgaatctcatttatcatttttggcatagaagtagccagttgtttctgcactgtttattgaatggtctatcatatcctcatggatttgtgatgcttcctctggcataccaagttctcctgtttgtgttatctatctctgaactaaattccacaccatttaattgagtttataaatcttaatatttaatagcataaattgtcccctgccttgtcttattgattcttggctcttatgactggcttgtcaagttctgccaaaaatatatatatatggttaatatatattaagattaatgtatatgaatttttctgtcagaattgcttggaatttttagattaatgtaaggataatttacatctttacaaatatctggtcttggcttggcctggtggctcatgcctataatcccagcactttgggaggcagatcacttgagcccaggagtttgagaccagtctgggcaacgtggtaaaaacccgtctctgctaaaaatactactaaaaatacaaaaaattagctggatgtggtggtgcgcatctgtagtcccagctactagggaggctgaggtgggagaatcacctgagcccaggagtttgaggctgcaatgagtcaagattgcacctctgtactccagcctgggcaacaggagtgagaccttgtctcaaaaaaaaaaaaaaaaagaaaaaagaaaattggttttcccatatatgaacatattatatagctcttcattcatgtatgttttctttattacctttcggtaaatgtttatattctccataaagacattaacatgttttgttggaattcttcttaggtactttagggttattatttgttactgtgaatggattgttctttttaaaacttacattttctaattgattgattgctgttgacctgtatgggtttttactattaatgagatatataacaaactgaactcttttattaagtctaataccttgtggatcctcttgaatattccatgtagattatcatgtctgcaattatgactcttttgtcataattgcagataatatgtctgcaattatgactcttttgtcataattgcagataatatgtctctttctttttaatcctaattcctcttattgacttttcttgtcatattcttctagctagggtctctagaaccatgttgaatagaagtaatgatggtgggaatccttgtcagttctaagttttgtaagggactgcttctatcacttagccattaagtatgatgttcactgtgtgatatgggtacacatgctttatcaaggtcaggaaatttttgtcccagtttgctaatattttttaaatttcataaatcagaattgaattttatgaaatgttttctctacatccattgaggtgataatttttttcttaattttttttttttttttttgagacggagtcttgctgtgtcgctcaggctggagtgcagtgacatgatctcggctcactgcaacttccacctcccaggttcaagcagttctcctgtctcagcctcccgagtagctgggactacaggcgcccaccaccaagcccagctaattttgtatttttagtagagatggggtttcaccatattggtcgggctggtctcaaactcctgacctcaggtgatctgcccgccttggcctcccaaagtgctgggattacaggtgtgagctactgggccctgcctcttaatatgttaatgtaggagttacattaagagatttttttagtgttaaatgatttttatattatttgcatcaaagatgctttggtcattattattattttaaaatatattgctggatttgacttgctaacatttcatttggaagtttcacatctgtttgctagtgaatgtggcttataattttcttttcttgcactcccttcatttagtttggtttcagagtgatactagctttaggaaataagttggggtatgtttcctctttttctactctctgaagagtttacgtaagattggattaatacagtttggtaggatttgtctctaaaggcatttggacatggggattattcatgtgtcaattttgaactactaacttaattttttaaaatggttataggacttttcagtttttatatttattcttaaattatatatagattaaaaaattttgttttaaattttcctgtctatagactttgaagtcctgctttttttttttttttttttttttttttgaaacagagtctcgctctgctgcgcaggctggagtgcagtggcgcgatccctgctcactgccagctccacctcccgggttcacgccattctcctgcctcagcctcccgagtagctgggactacaggcgcccgccaccacgcccggctgatttttttgtatttttagtagagatggggtttcaccgtgttagccaggatggtctcgatctcctgacctcgtaatttgcccgcctcggcctcccaaagtgctgggattacaggcgtgagccactgcacccagctgaagtgctgttttttttctttaacattatgggcattttctagatcattcaatatttactgagaagatgacctgtaacgcattgactttagcagtagtttttctttctgattaactttatttctagaattttattaggttgcatatgtcccatggatagggtggcataagtggccgtgctgggcacatggtagacatatagtaatttctgctggatatcgtacccagaactactcaggcgttgtaactttccagagcaaaaaattggaatttcctcatgttttacagggggagggtaaaggcgattctatgaaaattaacaaagggggttgggggaggagggctttcctttttgctaaaggaaaaataacacattcttttcgaatgatgacttatttttgaaaggcatcctggctgaaatgatgagctcaggttttgggtctgagcagttcctattgaaagatacttgtggagatttccaaaagtgcatataagaatggcaggttcttagttctgggggaagagtgactggggaggaaatacgtcttccccttttattgatctcagttacgtgctatgacatcacatgtaattttttgtggagctgttctgatgccccacatgaggcccgtgtcctttgctgccagtgcattccaagagggctgtaccctgggggctatgcaggcagctattcttgtgtgggcttttgccatgcctgtttcaggtttggaactgtatacctttcaggagcatggcttatgacatagcaattccattttcttaacaaaaacgaaccctatttttactttaaaagtaaacattccctctgctgtggtttgaatgtgtccctgaaagttcacatgttggaaacttcatcctccgtaacagtgttaagaggtgagacctttaagaggtgattaggtggtgaggactcgccctcatgaatggattaatgtcattatcttgggaattatcttgggtttctgataaaaagatgaggttagcctccttctcttgctctctcttgttcatgtgatgccctccaccatgttatgacccagcaagaagaccctcaccagatgttggcttcttgatcctggacttcctagtttccagaactgcaaagaaatgagtttttgctctttataaattacccagtccaaggtattgtgttatagcagcgcaacatgggccaacacaccctctatccatctctccaccggccaaaatcaactaagtgtccagcttcattacagccagtgtcctttggaggagaagtctctgaacattcctgttgagattcctgattggagctgtgtgaaacccatttagattgaaatcagaaacatggtcaggttgtgagttttccttttggagagccctcccttattttcacatgctcattctcaaaagcactttgtacatcatgtgatttgtatgttttttgcttggtacgattacacagccctttacaacccactgcccacacatgagctgacccagtggcttcgtgctgtaaaggcagatccagaaggcagtgctgccaggctctcttacaaaaatcagtttgtcttcttttgagatattcctgttctgagagttaaaacaaactcttgaaggcagcagtatattatagatgcaaaatctcacataaaaaccatttaagaaaatctggggacatggaaattgtttttttccctttaacaagatggtaccactaatgtattcttatttttttgcccagagagtagcaatttctaaattgttagacatggttcttctttggtttcacataacccattccttcatggtacttaaagttagtaaatggttgaaatacttccttgagaagtagaaatgaggaagcatgaagagattaaatgagtcacttaaagccactgtaaggaagttttccttcctttttattggtttctgcctttggtgttctgctgcttaccctccctccttcctacctgccttgtgctggaaagggccgggatttgggtatgcccttctcagctgtgtgacttcgaacaagctatttgacgtctcaaggtcttacatttctcatctgtaaaatctaagatccttctcttcaaatggctcccaggtcacccctgctgcagaccaggaatatggctaacattttgggatttgacatcaaatcctgagttgactttacgtaacctgggtccatgacatgtactagctgcaaacaagaagctgatgtgcacattgtctcaggacacctggaagcaaaatgttgaatgttagatttagaagggaccttcatcttccctgagtccaacagccccatcgtccggatgaggaagctgaggccaaggttagcccttgagggctgcagtgctgaggtcctgtgtccttgcccctggccagtgctgctcagccttccccacttttaggagagttggttgactttttgtaagacccaggtgggtataaaccaacaataacattctgagctccccaaccaactgaatggacctctcctctccgcgaagggcattctaaagtcagcctgaaatgctaatccaggcggtgatgggaatgggctgtgggacgtgcctccattacagcctcctccccttggaattcaggcacagctgaccagcattcacattaaaatagagacttcagactgacaaagcggactctttgtagcaatgagataccaacttgacagatagccggccccaaaagaaataaaagtattttgcctcaaaatatatttctttgatgtattttgaaatgtccctgcaaagctgtctcttgtggggaaaatctacattctgtggagaatctccttcccttcccaggtctttttcctgatccagtagagaattaactaagaatctggcactttttgaagtctgataagaaacatttaccatctattctctccaaagcctgctacctggaggcttcatctgcataataagaaccttggtttccataaccccttatcttaacccagacactcccttctattgattccaggtctttagataaactcaaccaattgccaatcagaaagtgtttgaatccacctgtgaccaggaaccccctcagcaatcctctgagttgtcctgcctttcaggaccaaagcaatgtacatcttacatgtattgattgacctcttgtgtttccctacaatgtatacaaccaagctatagcccgaccacttgggcacgcattctcaggatctcctggggctgtgtcacaggccacggtcactcatatttggctcagaataagtctcttcaaacattttacagagtttgactccttttgtttacatgggattgacagatgatatcccctgcctcgagggaatacgtgtgtgggcatctgaaatgtcatctcagctcacctctcaatgagtgggaagagactggaacacttttctccatggtccttgaatttttgtcgttaaacgagttactcttcagggcccgtcgtgtgaaaagctttgctgcacatcagcctggaggaaggctggacaggagaaatagcttcccaccaaagccctcccgtgtctagaagcatcacagtggcccttgcttaggtggcagaggacaggggtagatatttgtgatcaagaaagttggtcaggccgggtgcagtggctcatacccgtaatcccagcactttgggaggccaacgtggacgaatcacttgaggccaggagatcaagaccagcttggccaacatggtgaaaccccatctttactaaaaatacaaaaagtagctgggcatggtggcacatgcctgtaatcccagctactcgggaggctgaggctggagaattgcttgaaccgggaaggcggaggttgcagtgagctgagatcatgccactgcactccagcctggtgacagagtgagactctgtcttaaaaaaaaaaaatgttgctcagaagcttctcgatcttgtcacattctccggtggtgagttgagagcagcccaggcctggggtcctagggagcttgacgtggctactgttctagacagtgctgagtttgtcatcaccttgctttcattatgatttcctcctcctcgtcaccacctacggtgtttatggagttcgctgtacatgaagccccagcgtccagaggtgtaagacagagccccttctaggagctgctgtccatcccactgaaaggcaggtctgacacagaagagacaaacaaccatactgggcctctggggccccgtgagatgtgaacttcaggtaccagagtgcatgcgggaggaggcctgggtgccctggggacccaaagcaggagctcatttctgacctgcctctctcaccaagcttcctttgctgaatgccgtgggcaaacagtggtgttggtattggagcaggatcaaagctcattcctggctaacctgcaaaaatgagcaggtaaacaaatgggatccataaaatagagactaaaatgaaagtttgtcttactgtgattagcaactggcccctttccaaattccacctgctctgcgtggagctgtggcgtctcattccaagagccttctcacagcatctgacccgggcctggggtaacagtacactggggtttgccaaggataaccatagcaaggcagctacaggagcacagcatggtgggggggcatgaaatcagaacaagcaggacccacgggcgggggtgagagcaagtggctgggaggcagaggcagaagtgatggctgctgactcaccgtgtgtctgccaggttgcttaacccatctccgctccggttttcccatgcgtgagccctctgcagtgtgtggcatgctgatcggcctctggcatgaagagtaaaagcaaggccacataaaaatcacaggtgcccctcgcttcgtgcaacatgtgtgccagtccagtttctgcaacagccccccaggcgctgagcctgctccatgggttgggagatgttagacctcaagctgtgcccctagctgggtgggtatgggaagttacatggcagtgctggctgcattctgcttatcactgaaagaagtggctttggaatgggtgatttcttaaggtgtttccccactcagttcttctgttcatttttgtacattattatctcttcattgttgtacatttgttggagcttagccccaacagtgcctgcctaggtggtgcggactgaggaatagagatggagtaatcatgatatccaatgtcttatctcactggcctccccgccccaccacatcccttcccattggacggtgaggactgaggctccatcgctgaaatgcacacgtgttaccaggcagggttgtgagggccagttcaatgaacataaatacccttgtcagatcagttgtcatgattctagagaataaggccggaggaagtgagcatgctgatactaaagaacaggggagagaatactgggtttggttgtgcctggtcactaaaagcaaacttcacccactgagaacctgctagtcaacctcctatgatgttcagaagcctcttgaatgttgataattaatggacagggtgagcttggccaggcaggctggctcatgcctgcagtcccagcactttgggaggtcaaggtgggcagatcgcttgagctcaggagttcaagaccaggctgggccacatggcaaaatgctgtctctggaaaaaatacaaaaaaaattagccagatatggtggcatgcacctgtagtcccagctccttgggagggtgaggcagcaggattgcttaggcccaggaggtcaaggctgcagtgagacaagattgcactgctgcaccccagcatgagtgacagagcgaggtcctgtctcaaaaaaaaaaaaaaaaaaaaaaaggtgagcttttctctactgagtttcttgaagtgtggcacaactgaggcatagcatagtgggacaggatgctgttcatttatctgagaggtgaaaggatgtacctcctgctgcttttttggtgggatggggtcggaggagagcctgatgagccaggcaaggagaggaggtaacagaacactggtggagttgatggtgagaagctggactctctcagtgggctgtttgcctgcccctcccttcatttcccataggcttcggtagaagcgtggcctgcagaatcaggaaacagtgctggttaatctgtaagtatgcaacattcttgggcctttctgtcactgaagagcataatgtaattcaggccagtgcagtactgagatatggagtgtggccagcacccatggcaggtgcttggaggtttatcctagtctttctgctaacttcctggcccaagtgcaggtcacttaccttttctgggattcaggtacctgtaagaagagaagtgagtgtgttggactccctctagggaactggaaggaataagcaataagtatactttgacattttataaatagaacatgtttaatacatgcatttcaacgaggcctataggattaacaactttggaggcatgtgtaccggtttgcggtcagtgctcacaccacctggtggaatttccttcctttgactggcaggaagagggaagtacttctcacacatctgttaccttctgccaagtgtaaatgtcatgctggcatctgtgtcttaattgtattggcattcccttgtactgggcctggatggggtgggtgctcaacccacacagacagaaccaagctcccgactgcagacacacatcattaagtttctggacttcagccacagtatctttgttattagattattaactcaatagccttcttgtcttttagcctaggactctggacatagctctctgtagatgcttattgatgactgattggctaacagatgcaatcacagagtcacagatgtcaactcttgcctgtccttccttcctttccttcccttccttccctccttccttcctctctgtctttctttcttttctttctctctctctctctccttccttccttccctccctctctccctgcttccttccttccttccttcctccgttccttccttccttcctctttctctctttctttctttcttttcttttttgatggagtttcactcttgttgcccaggctggagtgcaatggtgcaatctcggctcaccgcaacctccgtctctcaggttcaagcagttctcctgcctcagcctcccgagtagctgggattacaggcctggctaattttgtatttttagtagagacagggtttctccatgttggtcaggctggtctcgaactcccgacctcaggtgatccgcccaccttggcctcccaaagtgctgggattagaggcatgagccaccgcgcccagcttgttcgcgctcgcttgcttgcttgctttttctttctttctctctctctctctctctctctctctctctctctccctccctccctccctccctctctctccctctctccccctctctccctccctccgtctgtccctctctttctctcgttctctcttttctttctttctctcaagacagggtctagctgtgttgcccaggctggaatgcaatggcgtgatcatagcttactgcagcctctgcctcctgggctcaagtgatcctcccacctcagcctctctatagctaggactacaggcatgcgccaccatgcctggctagtttttgtattttttgtagcgacagggttttgccatgtgcccaggctggcctcagattcctgggctcaagcaatctacccaccttggcctctcaaagtactggggttatagacgtgcgccaccatgcccggctcaacccttgtatttcttgatggttttcacatgcagaagcccaaaatctgggagataccgatggcccctggatccaacactagagttatttctctccacagcagtttgcctcatgctcctttggtcactgataagtgttgttaacatttttcaaatatcctgtctgcactgaggtgtgacgagcacattattacctctgattcccatgctgacacacagatcgggcatgtctttgtgtttgtctttggagagccttatttttctcatgtgatatatacaccgaaatacacaggaatcattattgtacagaacataggagacagccactatgaaagcaactgtccggctgatggaagaaaagttcaggggcttctcattttgattacctgtgattttgctttgcatacaattttatttccttggtgagagctgcttcttccttgctgacttttaagagacattggaagacatggggcgggtcttctgaacatctacctgtgcgtcactttttaatttcttttccaggtagagtctgcagtgagggaatgagttctttttttgtttatttgtttgttttttatttttttttgagatggagtttcgctattgttgctctggctggagtgcaatggcgcgatcttggctcactgcaacccacaccttctggggttcaagcgattctcctgcctcaggctcccgaatagctgggattacaggcatgcacctccacgcctggctaacttttgtattttcaggagggacgtggtttctccatgttggccaggctggtctcaaactcccgacttcaagtgatcctcccacctcggcctcccaaagtgctgggattacaggcgtgagccactgcgcctggccaggaatgagttcttaatgagagactcttgagtctttctctggaagtagaatggaatttttagaaggatgaaagacagatgttcatttcacagagcaggctgctctattcacatgcagcctcaacaccagtgacattccaaccagtgtttagggtttagttagggagagaacttcatccccattagttcatatgtgtgtatgttaaagcacttagaaccatacctggcacataagaaaaattctgtaagtattcattgttcttgttattaccatcatccttgtaattcagtgattcatggcggggtgcagtcaaggagtgtcatgacaagcgaacttcagaagactgcatcagacttacaggtcactgcttttgtagccccagtacggtaggagaaacatccactgggaggtgggtccctcgttagccctgaagagtggattgctgatgccttctgcttcaccctctgcttgtgctccttcttccaagctgttaatttctctgaaatcttgtgtttctttacgcaggggttcacatcctgattgcttgttccactcggaagggaaggcagagggcttgcatctgaagccatgcctccttcatcagtgctgtatcgagctctaggtttgggttcttggcacttcggtgcttcccttctcactcagtagtcataatgttagcacggttgatgcattgacacgctctagtgagcagtttgcaggcatctatcatgaactgttcaaagagatacgcagatacatctcacaaacactgatggaatacttagtatgtgctaggagggcactagggagagaaagatgaaaggcagcgcctgctgttgatttcatttgcatcttgccctcaggactcaggttaattggtctaggagcttatagactattaggcttcctagaccccttgggagacatgggacttgccagacccatttccccaaaaaaggtaagcactgtggaggattcttctcctagagtctagcatccatcatttcaccagtgtggctgattccaaaaaatgcattttgacaagaagagaaacacagttagttaacagacgtcagaatgtgaaataactttggctgattggaggagttaaccggttcttttgtcatcttgtggtccgttctgtgtgtgtctgcttagctttctcacgctgagccttttccctcaggatcttcagcagttttttccagtatgtagatgattcaactcacagatggcagcttctaagttattatgccactgattaaagaattgttaaggcagacttatttctctaaatacaaacacatgcaaaactgagattttgaccaaaactttgctagacacaatagtgtattgtttctctcttcaaagtgtgttccatgatagacttgtgttttataaaacagcagtgcttggcatgtatattacgaggtctatcaccaaagaattctaagctctttttaaaaagacatttttaaggtaaatgaccatttaaaaaagatactccgtctcttctatttttttcctttcttatatcttcagcaacatcctaaatgtgacaatgtacgtaaaacactactgcatagagtgaatgttcactaatgctgatgactgtctttattggtatctctaatagttggatttgtggttaaacatatatgcttcttgccccaaatgactacatctttgttttctgttcgggcaaacagagaactggagttcactgtgatctcttcactgttaacactatttaagtgttattcaaagaaaatggaaacttttggtctcagtgtcatgccaacttgttctagattattgttcttaaaaaaaaaacaaaacaaaaaaaaacagagccccaggctggatgccgtggctcacgcctgtaatcccagcactttgggaggctgagacaggcagatcacaaggtcaggagatcgagaccgtcctggctaacaaggtgaaaccccgtttctactaaaaatacaaaaaatagccaggtgtggtggcgggctcctgtagtcccagctactctagaggctgacgtaggagaatggtgtgaacccaggaggcagagtttgcagagagccgagatcgagcgactgcactccagcctgggggacagagcgagactccgtctcaaaaaaaacaaaaaaaaagagccctggccaggcacggtggctcacgcctgtaatcccagcactttgggaggccgaggcgggcagatcacaaggtcaggagatcgagaccatcctggctaacacggtgaaaccccgtctctactaaaaatacaaaaaaaaattagccaggcgtggtggctggcgcctgtagtcccaggtactcgggaggctgaggcaggagaatggtgtgaacccgggaggcggagctggcagtgagtggagatcttgccactgcattccagtctgggtgacacagtgagactccatctcaaaaaaaaaaaaaaaaaaaaaagttgagaaatacggagagacttattatgaagcaataaatagttatgacacgatgttattaacactgggagaaacaaatagaccgatggaacaaaatagatagctagaaatagacttctacgtaaggaaacttggttatgcagataaacattgtggacaagtgggagaaggaaggattattcaataaatagtgctgagacaacttaaaaatcatattttcaagaggttgcaatgaaggtcctcacatatcctatatacaaaaaattagtttgaagtagaccaaatacatcaatgtgaaaagcaaattctaaacagtttagggaagaatataggaagatattttcatgagtggtgtagagaatgactttttttttttttttttaaagacagggtctcactctgtcacccaggctggagtgtagtggcgtgatcagcgctcactgcagccgtgacctcccaggctcaaatcgtcctcccaagtgatcctcccacctcagctaggactgagactagctggggctgcaggcacacaccaccacacctggctgatttcttttgtattttatacagagatggggttttgccatgttgctcaagctggtttcgaactcctgagctcaagccgtctgcctgccttagtctcccaaagtgctaggattacaggcatgagccaccctgcccgacccaagaatgactttttaaagcataagcaaaaagcataaaccatgaattaatgattgctaaatttgactgtattaaacaaagaatatcagtttatcaaaagacaccataaagtaaaagagatccacaaacttagagaagttatttgcaatatatataactgaaaaaggatttgtatttagagtatgtaaagaactattaaataagaaaaagatactcaaaagaaaatgggcaaaggacttgaacagggattttagagaaaataggaatagttaataaacctatgaaaaggtacctaatcatcagaatttaggaaccccaaattaaagccataatgatataccatttgataccaaccagactggtgaaaatatgagtctgataatattaagtgctgacaagggatattggtcagtggaaattctcatacacagctggcaggactgtaatttggcacaacttttgaaagcaatttattcttacctctattaccacacagttctgccattccactcccaggaacagaccctggtggaaagagaataagctttggagtcagtccaggatttgaatccatcttttaccattttcttttctttctttctttctttctttttttttttgagatggagtctcattctgtcacccacgcggagtgcagtggcgcaatcttggctcactgcaacctccgcttcccgggttcaagcaattccctgcttcagcctcccgattagctgggactacaggcgcctaccaccacgcccggctaatttttgtatttttagtagggacggggtttcaccatcttggtcagcctggtcttgaactcctgaccttgtgatccacctgccttggcctcccaaagtgctgggattacagatgtgagccactgtgcctggcctgttttaccattttctaattgtgtgcccctgagcctatgactttctcagttcccttatctgtacagtgagagaatgttgtgtttagtaactgaaaattcatggcatatagtaaacctcactaaatgcagacacttttattaacatgtgactgaagggcaggccccctgtgggcctggtcttatccttatcctttttagtatatgcacttcttctccacagtgcatatgctaatactaggtattcaagaaagcaaggtttgatttggatttgcagtgtctcccctaaatgctcagctcctgctatatgcatttcattctgcacaaacctcctcgccgcctgccacatctaagctatgatacaaatattcttcacgtgtgaaattccttgctcactgcttttacctcactgtggccatcttctctactaagaaagtcagctgtggtatcaacacacaagaatgtgtgcagctggtagtgtatacattcagaataacaaaggttattacactgaaaggatgtgttttttctttattactgggcatcttaattgcttcttggatgttacaagcccagcattgcgaagtacaccgtagagcagaggactaatctgtggattgagttgaggcacaaccctgtgagtgccctttctcagtgcagcagtctcagaggtaattttactcttttctgaaatctcatttcttattttggtgtgtgcagaaaagctcaactggagttacctgcaaatgcaggcatatgtgatagctctgctcagccacgtattaagccacaagcagccaagaacagatactactggcgacagctaagtaatgcacacacacacacacacacacacacacacacacacacacacacacacacaaaaggagaaaagtgataaagaagcaagaattccaagtgagttacaaactccaaggacttggaacatattctgaggaattcttaaattgaggcttacgagtgagaatatataatgtgtctccttaaacgttttggggtgacagatatttctgggttgtgggtgatatttttagggagctttaaagaatgaattcaggagacttgcagcctgatgctggttgtctgggtattttgggacatttcttatagcccagctttttattgctcaacacagatttagaagcttgtcctaatcaccaggaagatccttaaagactggcaataaagacaggaatttcaggagccaggcacagtgcctcatgcctataatcctagcacttcgggacatgggggtggaaggatcacgtgaacccaggaggttgaggctgcagtgagccatgattgcaccactgcactctaggctgggtgacacagcaggaccccgtctgtaaagaaataataacaggcctggcgcggtggctcatgcctgtaatcccagcactttgggaagccgggccaggtggatcacaaggtcaggagatcgagaccatcctggctaacacagtgaaaccccatctctactaaaaaatacaaaaaaaattagccaggcatggtggcacacgcctgtagtcccagctactcaggaggctgaggcagaattacttgaacccagggggcagatgttgcagtgagccgagatcacaccactggactccagcctgggtgatggagcgagactccatctccaaataataataataataataataataataataataataataataataaagttttttttttaaaaattgggattttagaccaatgtgagggaagttagcagcatggccctgagaagccatgtttccagagtgcactgttaggactgctgaaacagtttaagtacagacatacaagtcagcacacaggaagcagagcccgggaggattagacctgacatttgaaccagtccgagcccctctgtctaggtatctcctccaatcctccagtcatccctggttaaatattttgatttcttttgttaatactgtataataattctaaatctttctgagccaacattaaggtgaccaaacatcctggtttgcatgggacacaggactttcagtgctaaaactgggacagttctgagcaaactgggatgcttggtcctagcggacaactgctttgtgtgtctggtacaggtgagccacagctgtgtatacatgtgtagtgggttgaatagggacccaccaaaaaaggtgtgtccacctagaatctcagaatgtgatctgatttggaataaaggtcttttttataacaatgacaacaacaaaatctaccctttcaactaattttaaagtgtacaatacaatattgttaattatatggacactgttgtacaatagatctctagaaatttttcatcttccataaccaaaatgctgctcccaccgaacggctcctctccccctcctcctcccacccaacggcccctctccccctcctcctcccaccgaacggcccctctccccctcctcctcccacccaacggcccctctccccctcctccctgctctgtggctgccaccattctactttctgctgctttgattttgactacattagctacctcatctaaatagaatcacacagtatttgtattctgggactggcttatttcacttagtataatggcctcaaggttcattcatattgtagtgacaggatttcctttttttgttttttgtttttttgagacggaggttagctctgtcgcccaggctggagtgcagtggtgtgatcttggctcactacaacctccacctcctgggttcaagtgattctcctgcttcagcctcccgagtagctggaattataggcgcctgccaccacgccaagctaatttttgtatttttagtagagatggggtttcactgtgttggccaggctgatctcgaactcctgatctagtgatccatccaccttggcctcccaaagtgctgggattacaagcgtgagccaccgcacctgcccccaccccctgccacctttttttttaaaggctgaataatattccgttgtctgtatagaccacattttctttatccactcatccatcagtggatgttcaggttgttcccactgttttgctatcgtgaacagtgatgcagcgaacatgggaatgcaaatatttctttgagattctgttttcaattctattgaataaatacccagaggtggggttgctagatcacatggtagttctgtttttaattttctgaggaaactccattctgttttgcatagcagcagcattatatattctcatcaacagtgaacaaggatttcagtttctccacatcctaatcaacacttactttctgctgttcttttttcttcttccttctttccttcccttccttcttcctttctcttccctcccttcttcccttccattccttcttcttttcccttccctttcttcttcccttccttcttcctttccctttcctttcttcttcccttccttcttcctttcccttcctttccttctttccttcccttcccttccatcttcccttcccctccttcacttcctttttcctttcccttcccttcctccttcccttcccttccctttttctttcccttccttctttgtttccctttcctttttccttccctttccctttcctttcctttctttttgtgtttctataatcatggccatcctaacaggcatggggtgatacttcattgtggttttgatttgcatttctctgacatttgtgatattgagcatcttttcatatacctgcttgtcatttgtatgttttccttacagaaaggtctatttaggtcctttcctttatgtattttaaaaattggtttatttgcttttgctattgagttgtaggaattccttgtatattttagatatcaatctcttttcagatagatggtttgcatgtattttctcccactgcacaggttaccttttcactctgttgatgctttcctttgctattcagaaggtttttcgtttgatataatctcacttgtctatttttgcttttgttggcatatccaagaaatcattgccaagaccaatgttttgaaactttccccctatgttttcttctaggaggtttgtagtttcaggtctacatttaagtcctttaatccattttgagttgaggtttatgtatgcgtaagataaggatccaatgcttcttttgcatgtgggtatctagttttcctagcaccactttgtgagacaatcctttccccactgtgttgtcttggcacccttgctgaagatcatttctctgtgtatatgtgggtttacttctgatctctctattctgctccactggtctgtgtgtctgtctttatgccaatgtcatactgttttgattacagtagctttgtaagatgtttcgagatcagaaagtgtgaaaattctagctttgttcttttttcttcagattgttttggctattcagggtcctttgtggttggttccatgtgaattttaggactgtttttttctattcttcaaaaaatgccattgggaatttgctaggaatttcattaaatctatgactcacttcaggtactatggacattttaacaatattaagtcttgtaatccatgtacataggatgttgaattttcatatatggactttattatgttgactttttatatatggactttattaagtcttgtaatccatgtacataggatgttgacttttcatatatggactttattatgttgaggcaatttcctttttttcctggtttcttgcagttcttataatgaaaggatgttgaattcagtcaaatgctttttttttttttttacatattttgagatgatcatattatttttatctttcagtcttttaatgtgatgtaccacattgattgacttttgtatattgaaccatctttgcatctctgggataaatcccacttgaccataatatattatctttttaatgtccttttgattcagttttgtattttgttgaaaatttgtgtatctgtattcatcagggatattgggctgtatgtagttttcttttcttgtagtgtctttgactttgttatcactataatgctagcctcaaaaaacaagtttggaagtgttcccttctcttcattttttaaggagagtttgagaaggattggcattaattctttaaatatttggtagagttctccagtgaaaccaccttgtcttagacttttctttttgggagatttttggttactgattcaatcccatttctagtaaaagatctgttcagattttctgtttcatcatgattcagtcttggtagtttgtatatctctaggaatttatccatttcttctaggttatctaatttgttggtatataattgttcactgtggtcttttattaatactttttattctgtggcatcagttgtaatgccccctcttttatttctgattttatttatttggaccttttctccttttttcttagttagtctgcctaagagtttgtcaatttttgccaggtacagtggtgtgtgcctgtagttccagctatttgggatgctgaagcagaaggatcacttgagctcagaagttcaagaccagcctaggcaacatagcaagacccgcccccttcatctctttaaaaaacaaacaaacaaaaaacagatcattaattttgtttttcttttaaaaaaatcaagtcttggtttggttgtttcttttttctattgtttttatattttctatttcatttctttcaattataatctttattataatttccttccatctgctaactttggcttagtttgtttttttctttttctagtttcttcagttataaagttgggttgtttatttgagatctttattcttttttaacataggtgtttactactataaacttctctcctagtattgtttttgctacagctcacaggttttggtgtgttgtattttcatttttgtttgtctcaaggtattttctaaattccccagtgattgttttctttgactcagtggttaagagtgaattgtttcgttttcacatatttgtgaattttccaggttttcttctgctattgattttcagtttcattccattgtggttgaaaaaaatgtggtatgattttaaacttcttaaatctgttaagtcttgttttgtgccttaacatgtgacgtatcctggagaatgttctgtgtgtacttgaaacgaatgtgtattctgctgcttttgggtgaaatgttttataaatgtctgttgggtccctcgatctgtagtgttcttcaagtcctctgttttttttttattagccttttgtttggctgacatactgtactctatacattattgaaagtgggatattgagccaggcacagtggctaacacctgtaatcccagcactttgggaggccgaggtgggcggatcacttgaggtcaggagtttgagaccagcatgggcaacatggtgaaaccctgtctctacttaaaaaaaatacaaaaattagctggatgttgtggcacatgccagtcatctcagctacttgggaggctgaggccagagaatcgcttgaacccaggcagcagagtttgcagtgagccgagatagtgccatggcactcctgcctggggaacagagcgagacttatctcaaaaaaaaaaaaaaaaaaaaaaaaaccccaaaaaacaaaagtgggatattgaaatctcctactattgttgtgttgcttcctatttctcttttcaattctgtccatgttttatatctttgggtctctgatgttggctacatgcatatttataattgttgtatcttcctggtaaattcactcttttatcattaaataatgttgtttctggtttcttgtggcagtttttgtcttaaagtctattttgtgtgatataagtatggtcatccctgctgtcttttggttaccatttacgtagactacctctctttaccctttcattttcagcctatgtgtgtttttaaatccaaaatgagtcccttgtagacagcatatagctgaagcttgtttttaaaatccatttagctactgtatgtcttctgattgagggatttaattcacttacatgaaaagtcattactgataggcaaggacttactattgccattttgctcattgtttttatctaccttgtagctcttttgtccctctcactgtcttcctttttgtttccctcatttttcttctagcaatgttctttgattactttttcattttctgttgtgtatcgcctatagatattttctttgtggttaacatggggattacataaaacattttatagttatattaatctgttctaagctgacaacaacttcagtcacatacaaaatctatatgcttttctgcacactttgttattgatgtcacaaattcatgtttttatgttgtgtatccattaacatattttacataattattttttatacttttgtctttttttaattatactttaagttctgggatacatgtgcagaacctgcaggtttgtttcataggtatacacatgccatggtggtttgctgcacccatcgatccatcatctacattaggtatttatcctaatgctatccctcccctagccccccaccccacaacaggccccggtgtgtgatgttcccctccctgtgtccatatatcctcattattcaactcccacttatgagtgagaacatgcggtgtttggttttctgttcttgtgttagtttgctgagaatgatggtttccagcttcatccatgtccctgcaaaggacatgacatgaatgcacctttttttatggctgcatagtattccatggtgtatatgtgccacattttctttatccagtctatcattgttgggcatttgggttggttccaagtctttgctattgtgaacagtgccgcaataaacatatgtgtgcatgtgtctttatagtagaatgatttataatcctttgggtatatacccagtaaggggattgctgggtcagatgatatttctggttctagatccttgaggaatctttatagtagaatgatttatgatcctttgggtatatacccagtaaggggattgctgggtcagatgatatttctggttctagatccttgaggaattgccacactgtcttccaaaatggttgaactaatttacactcccaccaacagtgtaaaagcattcctatttcttcacatcctctccagcatctattgtttcctgactttttaatgatcgccattctaactggcgtgagatggtatctcattgtagttttggtttgcatttctctaatgacctgaccagtgatgatgagctttttttcatatgtttgttggccacataaatgtcttcttttgagaagtgtctgtttatatcctttgcccactttttgatggagttgtttttttcttcttgtaaatttgtttaaattcattgtagattctggatattagtcctttgtcagatagatacagtgcaaaaattgtctcccattctgtaggttgccttttcactctgatgatagtttcttttgctgtgcagaagctctttagtttaattcgatcccatttgtcaattttggcttttgatgccattgctttggtgttttagtcatgaagtccttgcccatgcctaggtcctgaatggtattgcctaggttttcttctagggattttatggttttaggtcttacgtttaagtctttaatccatcttgagataatttttgtataagatgtaaggaaggggtccagtttcaattttctgcatctggctagccagttttcccaacaccatttattaaatagggaatcctttccccattgcttgtttttgtcaggtttctcaaaagatcagatggttgtatacttttgtcttttaatctgtataccagaattaaaagtgatttaaacactactgttacagtattatagtattctgtatttgtctatatgtttacctttggtagtgaactttatacttttatatgctttcattttcctatctagcatcctttcatttcatcttgaaagactccctttagtaattcttgtaaagtcagtctagtagcaaggaactcctctgcttttggttatttgggaaagtctttattcttggaaagtatccttcgttgacaggtttttattctttcagcactttgaatgtattgtctcacttgcttcttgcatgcaaggtttatgctgtgaagtccactgatagccttttaggggttctattgtatgggaaaatttgcttctcttttgttgctttaaaaattctccctgggccaagcacggtggctcatgcctgtaatcccagcactctgggaggctgaggtgggtggatcacctgaggtcaggagttcaaggccagcctggccaacatgggaaaacctcgactctattaaaaaattagccaggtgtggtagcaggtgtctgtaatcccaactactcaggaggctgaggcaggagaatcacttgaactcgagaggcagaggttgcagtgagttgagattgcacccctgcactccagcctgggcaacagagacttccatcttaaaaaaaaaaaattctccctgaaaagctagaactttgaatacatgctccaactcttttcctccccagggagaagtaaggagttaggggttttctcctgtttattttgtgctgagctagagggcatggactatgacaaataagtacatgctgatctaaaccatttcctttattctcagcatcccttgacctggcgccctttcctattctaaaccatcccttgggcagtccccttgaaaagcctggacattggactatgatccagtctactcttccccgctcccgggagaagcgaggagctggcagtttcctcttgcttacactgtgctgacctgggggagggactatggtgaatggatgccatgaatttccctgccagctttgatcatctggttttgcagcagcctgagatgcaggagcctcttaactggtttccgtatttctcacaaagggaagtagtctatgtatttttgttgaattgctgtctctgtagggacaaagagggtcttgcagttcctattttgccatgttgccgaagtcacttcctggaatgaaggtctttacagatgtaattaaggtaaggatcttgagatgagatcttcttagattagggtggaacctgatttcaatgataagtgtcatgagagacagaaatggaggagacacaaacacagaggagaaggccatgcaaaggtagaggcagagactggaatactatgtttataggccaaggaatgccaaagattgttggccaccagcagacactaggagagaggtgtggaatggatcctctcttaggctctccagaaggaactcactttgctgacacctttgattttggacttttggcctctagaagtatgagagaatgaatttctgttactctaagccagcaggcttgtggtaatttgttacagcagccccagggacatgggaagtgagtttgggagttttactacaaaaatctaggaggaggattttagacctttattggtcaatagccttatctatgtcttcactctctgtgagcccacctgtatctacggctgttatccacataggtgttttgactagggatttctgttcagtgaggtccaaactgccttcctcagtgccctggggcttcctgaaggtgctcttggtgccccctgcaggtgccctgtgggctgctttgtggggagtgtgcgaggtgaaggctgagcctgtgtggctccagacccctggcctcattaaccaaaacaagttttagataagttatttttagggggattaatataggattttgtttgaaaacaaacaaacaaaaaccacttaaaaaaaaagtaaaagaaacgtcctaaaagctacaggttgcattcttgccttctttctcttctaacgtgattctttgtgcagccattttctgccaatgctcttcttgggtgcagcagtgtctgcagtcatggtgactgggaagtgggaagggggcttggagtagaactgcagggaggatgggggttggaagaacccctggtgcatcaggtaaaaccacaaggaggtatgctgccctcattcttatccctgaatatctattgtagcttcttgtcccctttcatggtcaacatcttgcaaataatttcgtcataggctggtatctcaatttcactgacggctcatggcaaagcatggagggaaaaaattaggaaggggtggggtgaagttattaaatactgggagtgagtaaaagtgggcaggcaggaaaattattctaaaagggttaggggaaagggaggtggcataataacaaaaggaagaactgtacctgcattagagtgctataattttccccaagtattgccatagaaatcgcacttcagactctacaccatgcatcaatttgaggagaacaatttacctgtattgtttcccatgtgtcatcagcgtcctctttctcctgtttcagtcagcaggactcatttcatccattttcatctggtactgttgactattcatttctttgcactgattttgctgccaaagtccccttttcaagtcatggacattattaagtataccctttattttacatcacttgccattttcagaactcctttatttcattactttgcattcagaatttccggcctaaatcgatagccttgacataaaggcaggtctctgctttctcttttgggcatgaacagttcctttcctgaatcagaaatttatttttctttctagaagtctagtgtggggaatagtcagcatgcttactaagtcttaatttgttagaaggaaagatgaagataaatattggtgatgggggttccctagaaaataaattctacctactcctaccctcacacgtttacactctgcttttgatgcatctcttgtattctgcttttcctctctaaagaagggaaacttcttcctgggaccagtacattgggctcattagttccagccccagctctgccacacgcttgctgtttagcttttagaaagttagctcatctttctgttttctggcctatgaaatggagactcactgatctcttggatggatgaagtaccaagtaaccactatgggacttgcccccatgcaggagtaatgaatgaatcaatttcaaaacagctggacactaagcccacagcccaggctctcctcagattcattctatttacagcccagctttcacacaacgtgtctgatagccagttccttacgaagcctctgtcatgcttacggagcacgtgaccctcttgaaggagatggggaaggatcatggaatgttaaccactgttcccatgcatggaactgtgctaagaaatgtgctcccaggtagttttggagccatatgtgtctgaaaagaactcataattagctgaagtcaagggaaggggtcttcttatcactccttctgtattgttttaggcactcacactcatcagcagacagagtgcattcactttcttttctttccttttttctttctttttttttttttttttagagaggaggtcttgctttgtcaccccaggctggagtgcagtggtgcaattatagctcactaatgccttaaattcctgggctcaagcaatcctccagcttcagtttgctgagtagctgggactacagacatgcactatcacacggggctaattttgtaaattttttgtagagatgcggttttgccatcttgcccaagctggtcttcaactcctgggctcaagtgatcctcccacctcagcctcccaaaatactgggattacaggcatgagtcaccgtgcccagactacatttactttcttgattgcactttgaggtttaggggctaatgcctgatgctttttttttatctgtatgaagcagcggccacacagatcttcatcaaaagctgactgttctcatttctccccaagtaatcactcttttttttttttagcttgtgctaaatcattttttaaaattgtagctctgaggcattttattatacaaagttagtactcatatacataaactaataggaacttaaaactcattatacctttgcttcattttttttagcttgactccctcgtaaatctttagcttcattgatttggctgctatgtaagcttcattgatttggctgcttaaatcactccgttgagtgatttaagagcataatttagaagaatggtgtgtccatgtgtggctcagtttacagtaccatttggagtttgattgcttctgtgagttgggtgatctctcctcttgaggtccagatcaaccccaggaggagcctagctgctgctccccattgggcgccccatttcagcagaagtagccaggagtcgtcacccagaaccccctaacagcagttagtgtggcatctccacagtggggaatgttgtaggagttattaagaaattattttggccgggtgcggtggctcacgcctgtaatcccagcactttgggaggccgagacgggtggatcatgaggtcaggagattgagaccatcctggctaacacggtgaaacccgtctctactaaaaatacaaaaaatacaaaaaaaaaaaaaaaattagcagggcatagtggcgggcgcctatactcccagttgctcgggaggctgaggcaggagaatggcgtgaacctgggagacagagcttgcagtaagccgagatcgcaccactgcactccagcctgggcaacagagcgagactctgtctcaaaaaaaaaaagaaaagaaattattttaggcagataaagaggaaaaggggtccttgggaagttttcgttttttttttttttttttttttatactttaagttttagggtacatgtgcacgttgtgcaggttagttacatatgtatacatgtgccatgctggtgcgctgcacccattaactcgtcatctagcattaggtatatctcccaatgctatccctcccccctccccctaccccacaacagtccccagagtgtgatattccccttcctgtgtccatgtgatctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcttctccagcatctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctggtggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttccagggtttttatggttttaggtctaacgtttaagtctttaatccatcttgaattgattttttataaggtgtaaggaagggatccagtttcagctttctacatatggctagccagttttcccagcaccatttattaaatagggaatcctttccccattgcttgtttttctcaggtttgtcaaagatcagatagttgtagatatgcggtgttatttctgagggctctgttctgttccattgatctatatctctgttttggtaccagtaccatgctgttttggttactgtagccttgtagtattaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatgaagctaccaatgactttcttcacagaattggaaaaaactactttaaagttcatatggaaccaaaaaagagcccgcattgccaagtcaatcctaagccaaaagaacaaagctggaggcatcacactacctgacttcaaagttttcgttttttaaagcatctccggaaaagtttctcgtaaagcccagtctcttagagccaggtggcaacctttgatatgcaaatggaagccgttagaaactgggtccacccaaacatggcgattcccacactttcttggcctttccccacctgttcctagcaacatggccgcccccacgtatccccaagtgtgtagaacatcatgtgtcctgcatttgcatattagaaggctagggtgggagggccagctttttccagggctacatcaatgacatgcccaatcaaaccaatcccctaagccctatgcaaatcagacatcgcctcctccagcctctgtatacctagctggtatctggggcaggtgggtttccctgtctccgctttggagcccccgctccctctgtctctatacaggggagcttcttccttctcccttcttgccccttcttgcctattaaactctccgctcctttaaaaaaaaagaaaaagagcataatttgtctgtgagcagcaattattttcccttattggcagtcgggcatacatggagtattaatgctgcttcccattttgtcattttgggttcaaacccacctctgtagtagccaccaccgaaggcagattttggtagactttgaaaaacttgttctgcttgaggctccatgtgcttcatggcttgcaacacctaatggcctgcaaattctacagctacaatggtgagtccagctgctaccacctactagccatggctccagcctggctccccctgccaccacctggagcatggaccatcccagcccagaggtcactgtcaaaaacaacacgcctttaccggagagcaacacagccactgacagcaagctcaatccgcacaagtccaccgacagcaagcccaatctgcccaagcccacccaccgcgagcccaatctgcctaagcccacccaccgcgagcccaatccgcgcaagcccaaccacctcaagcccaatccgcccaagccccgactcatcagttcttcacaccccatatgctttctttttagagtgttgccccctaaaccattcatgatgagtacctttcaccatctgtttttttctttttaccctcttggaaaagaggaaggtcacctgaaggtcaccactggaaaaccttgctggctctggggagttattggtctgtgacactgttcagacttgggctgtaggcagtctggtacctgtgcagcctctcttttatttgtttacttttattgtaaaacctgtgtgcaaaaaagtatatgtagtgtaaagataaggtttaaagaatagtggtgaaaaagaacatccatttaccctccaccaagcttgagaatttttttttttttttgaggcggactctcactctgtcgcccaggctagagtgcactggcacaatcttggttcactgcaacttccgactgctgggttcaagcgattctcctgcctcagcctccggagtagctgggactacaggtgcccaccaccatgcctgggcaatttttgtattattagtagagactgggtttcaccatattggccaggcttgtctcgaactcctgaccttgtgatctgcctgccttggcctcccacagtgctgggattacaggcgtgagccgctgcgcaccgcagcttgagaatatgagcagcacttttgaagtccctacgcaatgcggcttccctcatccctcctttccctctctagcccatcagaggcaaccactgtgctgaatttagtatcaatcaaccccttgatattaatgtagttttttaaccacatattaaatatttaaataatgtattgcttagtcgtgcttccttttgaactttttatcaatggtatatagtatgtatttttctcaacatactgattttctaaatgttacttttaaaaaggtgtatctgtgttgatttagctacagtaattttaaaattaggattcatattccttataattttatctctggggaatttttgaggatcttcttccagaaaggactggggttttatttctccagatacctggagtattattaccagcccaaggcctcctacaaatacattttgggtttttttgaaaacgcaggtggtgtaaattctgactccagccctaaactcaggcaggcatttcttcatttcatttattgcacccagaacaaagtctgagaggggcctgtatcctcagttcatttctgtggggcaggtttttgtttgagtaaacccactgagtgtgttgacctttggggaatcctagtttttgtagagttctctcatttagattcctatacttctaaaaatgtaaagcaaataccaataaaatagcataccagatattggttatcttttgccctaatgtggtgtaacaagtcaccacaaaacttagtgatttaaaataataatttggccgggcgcagtggctcatgcctgtaatcccagcactttgggaggctgaggcgggcggatcacctgaggttgggagttcaagaccagcctgaccaatatggagaaaaccccgtctctaataaaaatacaaaattagccgggcgtggtggcgcatgcctgtaatcccagctgctcaggaggctgaggcacaagaatcacttgaacctgggaggtggaggttgcggtgagcagagatcgtgccactgcactccagcctgggcaacaagagcgcaactctgtctcaaaaaacaaacaaacaagcgaacaaaaacaataatttatttttgctcttgtgtctgggagtcagttagggtctgctggtccaggctgtgctcagctcagcttggtgccccgctgtgggctgggttcagcctgctccacacgtctctcatcctcctcagatccatagagcatgttctcctcatggcagtggcagaatttattccaagagtgcctagcagaaacatgcatgagcagaaacatgcaatgcctcctaaggtctagacctgatgcacttcctttctgcccatgctccgttagctagagccactcatgtggtcctcagtccaataggaaacatattctgcctctagtggaaggagcggcaaagtcacatggcagaaggtctagatacaggtagagaatcttgatcattaattcaatttgccacagggaaattgctttcctttacctctgcttgctagtgctgtggatctgtgctcactgaattccattctcaaacgtttacatttcctgagggtttgatttattactcaagtatgttcatctctactcctgaagtctctcaggtgggatattccagatgagatatttcctaaaattgaaaaaaaaaaaaaaaaaggccaagtgtggtagtggctcatgcctgtaatcccagtactctgggaggccgaggagggaggatcacttgagcccaggagtttgagaccagcctggtgccccactgtgggttgggttcagtctgctccacgtgcaagcaacaaagcaagactccatcactaccaaaaaatttttaaaaatgaaaaataaaaattagccaggtgtggtggtgcgtagttgtaatcccagctacttgggaggctgaggtgggaggattccttgagtccaggatttcaaggctgcagtgagctatatggcaccactgcactccagcctggatgacagagcaagaccctctctctaaaaaaaaaaaaaaaaaggaaaagaaaaaagaaaagaaaaagaacatcaggagaatgccaactcaagaggttcactgcttcccccagctttgctactttggcagggtagggctcctgagaacaggagttcctgtgggagaatcgtttcttacaacttactcatcatacgtcaggatgtcacctggtctctgggggtacctgtggataacctgtggccgggatgggtaggacaaggtaaaacaaaactcaaactcaggtgggtgtggtggctcatgcctgtaatctcagcactttgggaggccagatccacttttgggtggatcacctgagttcaggggtttgagaccagcctggccaacatgtcaaaaccccatctccactaaaaatacaaaaattagccaggtgtgattgtgcacacctgtaatcccagctacccagttgggcgaggcacgagaattgcttgaacctgggaggcggaggttgtagtgagccaagatggcaccactgcactctagcctgggcgacagagtgagaccctgtctaaaaataaaaacaataaaacgtgtcaaactcacacattttaaatattgattcttaagccactgaagaactatatcctcattgtgctgaaaaacaatgggatacaaacttgttctattttcaagacatctagatcttttgttatatttacaagaaagataaattaggtggtggctattcataaattaatgaaagattcctcactttataaaaggagttggtgcaaggtaaatttaagtagcaaacttttccaaaacattaaaaatttcatgcaatttgaaaattttggctgggtgcggtggctcacgcctgtaatcccaacactttgggaggccgagataagcagatcacttgaggtcaggagtctgagaccagcttggccaacatggtgaaaccccatctctactaaaaatacaaaaaattagccagctatggtggcatgtgcctgtaatcccagctgctcgagaagcagagacaggagaatcgcttgaacccaggaggtggaggttgcagtgagccgagatcttgccactgcactccagcctgggcaacacagcaagactctgtctcaaaaaaaacaaaattttttaaaaaattttcttacaacttttcagaaacctgtttatcacatataacaggaaatatttgcaggtctggggctatttttccattgtggtgatcagtatatatttttaatgatttcatttcatttttattaaacttttttttaaggattcatatatggttcatttcgtgtactggttaatgtttgttactttaagccattaaaaagcagaatttgagtcttacaattggacactgtttgcatattgttttagttatttctagttttttgtaaagtatataaatgcgtttttttcttccaaattattggtcggattgtgtaattattaagagcctttgatctgagggtccctgtgtgtctcatctctctctctctttttttttttttttttttcctgtggcggagtttcgctcttgttgcccagactggagtgcaatggcacgatctcggctcaccgcaaccgccacctcctgggttcaagtgatgctcccgcctcagccttccaattagctgggattacaggcatgcgtcaccacgcccggctaattttgtatttttattagagacgggatttctccatattgatcaggctggtctcaaactcccgatctcaggtgatccgcctgccctgacctcccaaagtgctgggattacaggcgtgaggcaccgcgcccggcctgatctctttactgacacgtgcccacaggggagcaaggaattcctaacttcagtagtaacttgggaatttcattgaaaagtgacaactcctttccatctttcatacttatttttcccaccatcttctgggttttgataattatcttttaggtactccaagagtactatgataggcttaaaaaaaaaaagaacagaaaaggagacagctgggaaatccaccagcagaatcaagttccatataccaaattattttttttcatattttcttacatattgtttgtaccatctcttcatcccactctactttcggagcgagcattattcctggaagaacttttgtattttctcggagtccatctgctctgaatacttatctcccacctgaggccatcatgttccattcggagcatcgtaatcattttcacagcaactaaacatgatttcacacacagcagattatgacttctgtggggagtgagcagtgtaaaatgattaaccccttaggacagggaccccatttcacactaatctccttagcaaccaacagaagacaggaaaatggacagcataaatggattgaggataatgcagcatcccatttaacgatcagttctaaatgcctccggaacatacttccaaccagaaatgatagctgatgccaaagagtattgagcaaatgtccctggaaaaggtggcactcgtgtggaagaaggacatgggaacatatgccgtaaagattgggggtccatcagggatgaagtcttgcctgactgtggtgggccgctgggccagtaggactcccggagagacagcatcacagaatgcatggatggtggggttccgaatggcttaagtctaaatgagttgattctacttttgtctagttccgttacgttttggggaagaagagctataccatgcataggtttgtgaattagttcttataacctccctataattacagaaacaaggataacccaaaggtcttgatttttttttcctaaaatatttctttttccctaaaagacttcatggcaattgaataccctgttttcagtttactattgctagttcaaggaagggagtttttactgggaagaagaaagtcaatctaaacaatgccacaactgtttgtttttttttaaataaccttccatgcctatgacacaggcagctaacataatgggttccattgtatttgaatgcttctgaagttaatgctacctttttctgcatgacttacatatagaggaagtcgggttggtttgtagccaatggctgttagatttgatgactaacagtaggtatctcagtaacaaaatgtttctctctccatcaccattaattttggaatcttcaccagagctgattgatcaactcagacaacactctttataaagtataatgaaattagaattttgatttagtcgtaaatgtggttacagggtgggatttgaaagcatcttctgtcattgaagagaagactatcatcaaagaaattaccggcatgctataggaatccaggcattgtggaaccttctgttaccccaggcaattattattattgtgattttcgactcggcaagtgtatggacttgaaaaaatcatctaataaacatttattattagctaccctttgcctgatagcagaaaatgagaaggaaccagatgcacccactttaattaattggtgtaatcaggagtggtatgcgacatcaagggtgaaaattgctgacttaaactgtggctttgtggctccaatgaagtcttgaagtcttttttccccttgaataacaacagaatcagagcctctggattttcctttctcatccatctgaatttctttccttttttgggggtggaggtgtgttcaattgaaacttttgatgtggtgataggattcccaatttttctgcaggagagttgggagtttattcctgagttttctcagttcattcaaaagaccaacaaagagaggaacaacatcaggaaatgtaatggaaacaatacatgttatcctccttttgcctgaacatggtacagattgaagtagcaaccctctgcttagaaaaaccttttctgttgttcccgactaagcaaaccatcctttaggtctctgcttagacatcactttctctgagaagtcttcccaaaataccctccctcccaaaccaccctaccctccatccttcctccagctctgttaggcttccttattcccgtcttagcacttcatccactttattttagaattgcctatttattgtctatatcctcttttacttggggtcaggcactgtgtcttgtcacctctatatctccaggatctaatacagagcctagcattcagtaggtgcttaatcaaacctttattgaatgaatgaatgaatgaatgaatgaatgaatggaagtagtgtctgtctcacctaggtataccttactcatgtctgcattttcagtacctactgtcactggaaaggagttccgatccagactccatgagagggttcttggatcttatgcaagaaagaattctagatgagtccataaagtgtaagcaagtttattagagaagtaaagaaacaaaagtatggctactgcacagacagatcagaaccgagggttgctggttgcccacttttatggttattttttcatgatatgctaaacaaggggtggattattcatgcctcccctttttagaccatgtagggtaacttcctgatgttgccatggcatttgtaaactgtcatggtgctggtgggagtgtagcagtgaggacgaccagaggtcactctcgtggccatcttggttttggtaggatttggccggcttctttactgcaacctgttttatcggcagggtgtttatgacctgtatcttgtgccaacctcctgtctcatcctgtgattaagaatgcagcccagcaggtcacagcctcattttacccagctcctattcaagatggagttgctctggttcaaatgcctctaaccctacttggtgtatcagttatctattgctgcataacaaaccactgcaaaacttagtgtcttaaaacagcagctatttagccatgattctgcagactagcagtttaggctggcccagctggtcagtgctggtttcagctgggctccctcatgtgtctgtggtcagcttccaggccgttgagtgctgggtgttctaagtaggcctcagctgggggtgttgtctcttttccctgtgatcttttatcttccagaaggctagcctgggctttttcaagtggcaactgggcagggctgtaagaaagggagcagaagtatgcatgacctcttgaggcccaggctcaactggcacatcatcacttctgctgtattttcttggctgcagaagtcacagagccagtcctgacttaaagggaaggaaaactgacttctttgagaggaggaactgcaaagataggttttaaagaggcagggatacgtggaggagagtaattgaggacatttttgcaaacaatctattattcttggcatagtgtaggtactctaaagcacttgactactttgagtccaacaagtattagatttagcccaagtcttggaaagtcttccaaagaagataaaatttctctttggttgcattctgaatccctgcccttccccatctcctattccctgatccctccactgctttgtgacccaagcatgcaggccttgtgtggctgtcagcgcccaggtcctcctattcaatgggtgatacatcctggacacctactgttctcctgagcatcttgtataaactagaccccacacccgacgggaccacagcagtgagcaagaaagacagattcctgttctccactgggaaagatggatgtttgactagaaactacgaaatggatgtttgactagaaacaggtaacagaggggacctgccttgttgaggacctggcatttaagctgcgacctaagaggtgggtaggaaggggtgttctcgccatggaggaggtggcggtgacagtgtggggcccagagacggtacggtggagcacttttcagagagagggagtgtgcagaagggccctggtgcaggaaactgggagaggacagaatggcttcagctcaggggtgagggatggcagaggtgtgccagaccgggtctcctggggctgggtgagccaaggcactttcccaagagatgactggaaagctgttgaagggttacagacacaggggaggtgacccaatttactttttaaaatcatcctgggctgcatagataatacatgtagaggcgtgcaaggctggacatgaaattccttccattctccaccatcaaaacactctacccagcggggtgtgaggaagaaagcaatccgatgacatcgaattcgcactaaagttactgagaaccttgtcatggtatttgttcaaatcttgagtgtgcagtcttcgaaaccctctgagctctgttccagactgtcctctcagccttgagtgcacatggggcaccggaagctggtgcactggggaagagagggaaccgtcactgccagctgcccggtggtgcaacccccattcattctgatgtgggctggctggctggcaaggcggcagaggggctcagtgtcgccgtgtaagtcctcaaacggtccttgctagtggctcactttagaggggatggtgcacggctccttttcctcgggatctcagagcaggtgcttcacctgcctctacttcccccttgcccatattccccccattgggtactattttaccttttcattggatgtcatttaaaaaatgtggtaactcagcaacacctttcactgccttaggcatctggttttctgtgtgacacagaggccttccttctggcgctgtctcccgggagcatcttcaggcagcatttctctaacttcactgaatgattctggaagtggctggcagatcactgtcagtggagtcaaccagatgtgtatctgctaggccatttccctttccaccttccctcggttctcgctgggtcacagaagcaatgtcataacaacacagcttcctcctaatgaaacatctgcagccaccctctggctgacagttcattaaccttgtggcccaaactgcttcggtgccgtccctgctcctgaattttaacattcagagttttcttcaaagcccaggtctgcttatcaatcatgttcaatattaggttacttacagaatgaagtcattatctttaatgtttaataactgtgccacaaagataatataataaaatctgagaaatgtaattgagagaggcttttgactcaagtcttgtgtgtgtgtatgtgtgtgtgtgtttaatctttcctaatcctatccccaaggctaagaaaaaccttgttttcgctctgtcttctacttggtttgtctcttttgttttgtttttgcttggcaatgtcctgatcagtctgttttggtgatggctgagtctggggagctggcagcagagatgatgacactgggattgacactatgctgcaggagggggtggttgacggccacaggagatgttgtggggttggacccttgcagggcatggatttggtcaggtatggggaacaaatgaccagcgtggactctgctcctgacacaaatgaacaaagtgcccagatctgattcccccagccctggtggcttccaggtctttgaaggtagaattgagcctcacagcagatggctcctggtagtgaagagattcttgggcaaaagcctggtcattaaagaaggaagatttctttctttccttttttttttttttttggagatggagtttcactcttgttgcctaggctggagtgcaatggcgcaatctccactcaccgcaacttccacctcccgggttcaagcaattctcctgccttagcctcctgagtagctgggattacaggcttgtgccaccatgcccggctaattttgtatttttagtagacatggggtttctccattttggtcaagctggtcttgaacttccaacctcaggtgatctgcccgcctcggcctcccaaagtgctgggattacaggcgtgagctactgcacccagccgatttctttttatttttttgtttaggaaaatgtataaaatggaatgtagtcattttgctttgtcttcttggaagaagcatcaatatgaataagtctttgaatttgcaagttaaaactctgattttccatgggcagaatccgggtgagaaataagtctgtttgactgttttgagttcttcctttaaagaatatagaccatgatggtggcctgtgttgtgtcctgaggggctgtgtacacggagtctatggcaaggttcataaaacgcttagaggtttttcagagaaaggagctatagaaatggaaggtggcacagttgtgttggaaacctcccacggggtctccaggctctcatttccctccaagtcataaagtgagaggatctgtggtaagtctccccctctcccctcccctccctctcttattctgttctcaaggcaagaagcaaagcatgagggtctaactatacaggacaatccttccacggttcctctgcgcagtcccatcttacatctttggaggagttggatagcttttctttcaaaattttacaataattcctttcctttttctgaattgctttatgagttgacttgtcttcctaaggagtcaaagttaacaagactacccttgaacaatgtgaaactcaaccaggtatgtagcaggcttttggttttttatctaaatggttgaatttcttttttggtctagctgtattaggaatagagagaagagaatttctggaagtggagaccaggaaagggttcagactagttcttattattattacttttttttccctgagacagagtcccgctctgttacccaggcttctggagtgcaggggcatgatctcggctcactgcaacctccacctcccgggttcaagcaattctcctgtctcagcttcccgagtagctgggattacaggcacccaccaacagacctggctaatttttgtatttttagtagagatggggtttcacgatgttggccaggctggtctcgaactcctgatctcaagtgatccacctgcctcggcctcccaaagtgctgggattacaggcgtgagccactgtgcccggctgggttcttgagggagccaggctgagttctgcagatgcttctgtttttgactgctctcatattttctaaagtacatcctagtctctttcaactcatggggaaaattgcagagagttagggcccgtatagtatgtgacaccaatcaagacataaataatgaagcataaacatgtttttaaaaaacctgttatttgggatggagagaaaataacccttttcaaacattcgatataactttatacatcctagggaaatgtttacacacaccattggtttaaaattttagctgaattattttgatacttcagttcaacaaatggtcaattcagtcagttttttaattgatttttcacaaaatggaaccggttgactgcttgactcaactagtcatttgtgtgatacagacgcaggcttagaagaataaggttgaactgggcagtggcagatggctaaggtcgagtttaaggaagacacagagaactctacccatgggtccgtatcatgggttcctgtcctcacatccatatcatcagttcatttagtgaatgaaatcataatccctgcctctcaaggtctcatttgatttcacattcagtggcgttttcagtctgtgttgaaagcacatgagatgttgacgcatttgcacacatggtgagccaggaaggaggtgacgagagtgaactgggaagagatcatttgaacattagagatgacgattctgtttactattttcttaagtccttactggaaatattacttttcatggactagaactaattggaagtaagatatcctgtaagtccatttagaaaaaattcttccaactagttctgagcacgctggatttgcctgagaaactctttgggctgcattctgagggtggcttgggtggatttgccttgacttgatggccttgaggaataaggaggcctgaatgggcgtgaaactgtgtttagaacttgagttggcctgacacagctctggttcacacttgaacttatgtggacacttctctgcctctccattattcatctttgtacctcctgcatctagcgtaatgttgaacacatgacagacgttcattagatgttcagagtctggttgtttgccagcctaaaatgcttagagtttattgaattgggttgtacatgctactaggacctatgactttggggaaggaagttttagggttcagcaacctttcacgttttgtctttttttttttcttatgggctaggatatttacccaaggtaaattcagagaacaggggtgcgcagtgttacatatggcattccccacttaggagcaagtgactaatatctgtgttaactgaagtctgtcttctcacaggttctgtgctgaagaaccatctcactggctgacaccccttaataagacattctgaatctccatgattacaagattggagtgtgttcagaaccagaggcaagcagaatagttcagagatgtgggtcgtaatctgagtggggatataagggccccgacacaggtgccaccgggcagctgctggaagtgggtttggagccgcacagtgtgcaccaaggtcagtcctgggtgggggacgtgcagccaaaggaccatccctgcgggattcagactccagatcccctgctttcccatcgccatgggatgcccagaatgttaggaacaaaatccttgctcacgaagtcggcctcacttttccctgcccagctactggcttccacgtcctcgtctttatgaactttccatcatgtgtctagaattccatcccctctgctccctgctgattcatgcccgccattttcctagggagctcagtcaacattcagctcttcaaaaattctttttctggcctcatctcaggactgtacttcattttgtagtttttccacacagaacttgtaagcactcttgaatcatttcatttatgtcccgactttttagctagcacgcttaagagcaacacaggccttgtttttctgtgtatatgctgaagcaagcagaactgacctacccaaacttaatagtatgaactgtgttaatataaattgtcagctctggagattttatttgattctcaaagtaactctgtgaaggccaggcatggtggctcacgcctgtaatcccaacactttgggaggccaaggtgggtggatcaccagaggtcaggagttcaagaccagcctggccaacatggtgaaaccccatctctactaaaaatacaaaaattagccggtcgtggtggcacacacctgtaatcccagctacttgggaggctgaggcaggagaatcgctcaaactcaggaggtagaggttgcaatgagccgagatcacgtcactgcactccagcctgagtgacagagtgagattctgtctcaaaaaataaaaaagagcaatttttattatttccatgtttacagatgatgaaactgaaattcagagaggccaggtgacttaactaaggtcacacagccaagtggaaggcagaggtgggatttgagtctttgctgattccatgtctattattctttctactgccatacactgtctttctggtttgctgattcaataaattttgccttgaaaaattagagtcacaattgtcttttgaaagcctttctttggaggaaatatcctctgagaaactatgattttttagaaaataattggacttagagaaaaggagtaggctctgcctaaggaaaaaatgtattacttagtcctttatcaaacatttatgggtttactctgtactgtgctagttgatgggagtgggactagggtcaaatgaggacatggtttctgtcctccctgaacccatagcctcgtggcttggagatgggacaccatggtggcagatgttgtgtgtgcttgtgaatctgaaagactgatgcctgatgggcatcagtttttgtttgtttgtttgtttgtttgtttttgagacagagtcttgctctgttgcccaggctggagtgcagtggtgtgatgttggctcactgcaacctccacctcccaggttcaagtgattctcctgcctcagcctccaaagtagctgggattacaggctcccaccaccacacccagctgatttttgtatttttagtagagacgggctctcaccatgttggccaggctggtctcaaactcctgacctcaggtgatctgcctgcctcagcctcccaaagtgctgggatgacaggcatgagccaccgcgcccagccctaatgttctaactcataaggaaattttaccttcattcactacgagtaggctcatactatacaaatattagtttctagagtccattgatggatgaagagataaacaaaatgtggtctatgcatacaatggcatattcttcagcgtggagaaagaatgaaagatacgtgctatagcggtaacatgaaccttgaagacattatgccaagtgaaataagctaaacacaaaagcacaaacattgtatggttttgctcatgtgacaggcaaaatcatagagaaagaaagtagaatagaggttgccagcagctagagggagggagaatgggtgccgagtttcagtttgggaaagtgaaaaagttctgggcatggcgattggtgatggttgcaaaacaatgtatgaaccactgcattaatgtacttcatgctcttgaatagtacacctaaaaatggttaaattgataactctcatgttacatataccacacagaaaattagttttcagaatagctgacaagctatgcttagatatgtctttaaggcaggaggaagatggcagtggtcatagcagtgtgtggaaagcaggagagaccccacatgtcaccaattagctctccaaatccagaaaacatcagggatgaacagcctccgctgcccatgatccgcgagctgtttcgctagcattccgaacaattctggcaaaggcggaaacactggaccaggatctgggtgactctttcacagttgattgggtaaggagaagcgctgttctcagagaaatgagaacatgtgtcttggaaggctgcctttgcttaatgttctacacgatccaggaggccagatggcattttatgtggttttcacaactgtgattttggattgattactaaacctgtttgtgttcctaacccagctcgctgcctcccgcctgccttttagcttaacgctcattcccagagctcagtttgaacaggcgcattgtttttattctgttccttattattattgcgttggtgccagcctttactaccttcagccctatttgctgcccagagtctagtgcagaaaatgaaatcctttttccaataagtgtgatcaaatgaaaggctgtcacactgcatttacatccaattctgggtttttttttttttttttttttttgagtttgggtcgcccacatgatgggttgtaaaaggataaaggataatttctgatgtcgtgccagcttttcctcacccagctgaccttctactatcagatggtattttcataggaaaggcaaattaattttatatctaatgtaagaaaaacattattaggaagattgtaatgaaaattaagtagtttgcaaaatgttttagaattttcatattacttttgcataaaaaacttctttcagttcttacaacagtcctgagacagagttcagcaggtgtccccatctcatgaggaaacggaggctcagagaagttagggggcatgtccaaggttgcccagctaacattggtcagagctggatctggagagcttatctgcggggtccacatccagaatgctttctaccgttctgctgtaccagctggaaaacaaaatcccattcgagtaaataatatcagcaatagccaccattttaagcaacttaccaggccatttactaaataagtctccttgtactgtagtaactctcatgactaaggtctgcagacgacccatttaataggctggcaaagtgagtcagagattgcgaggagaggctgagagcttcctgggaacatctctgttgatgtcttgaactgggttcccattgttccagcagggaaactgaggatagcagacattgcaaaatgtccttctgtgaagagacttctagtcgttttggtgaaaacacagtgtcctgctgcctagctgaaatcctggtatggataagtttatcttatcatctttctatttctagtacttggcccagatcgtgacctaacagcaactatttgttgagtggaacctccaaagatagcagtttcttcttgtggggaattacagtctattgatttgctcaatgcaagttcattttattaagatttcttcacctgtgtgtttatataaatagacagccaggcagtgcatgaaagtggctgcccggccagagtctggctgggctgcttcgttctactctggggattggacccagtagaattcttggacttggtgtggagtcccaggtcaagccaactcattacttctacctctcctttttaaaaagggttttctgtctttggttcaagttcctcttaaaacacaatcatcatcccttcattgatagaggcacaaatgaattattttttttcttttttcttttttttttttgaggcagagtcttgctctgttgcccaggctatagtacggtggcacgatcttggctcactgcaacctctgcctcccgggttcaagtgattctcctgcctcagcctcctgagtagctgggattacaggtgtacaccaccacacctggctaatttttgtgtttttagtagagacggggtttcgccatattgaccaggctggtctcgagctcctgacctctggtgatccacccgcctcggcttcccaaagtgctgggattacaggtgtgagccaccaagcccggccgaatttttaatttttttattgaaatggagtctcactctgtcacccaggctggagtgcggtgatgctatctcagctcactgcaacctctgcctcctgggttcaagcgattctcctgcctcagccccccagtagctgggattacaggtgcgcaccaccacacctggctaatttttatatttttagtagagatgggggtttcgccatgttgaccaggctggtctcgaactcctgatctcaggtgatccacccgcctcggcctcctgaagtgctgggattagaggcgtgagccaccacgctcggccgaggcacaaatgaatttaaacctcattgaaatgacagcggatggccatggctctactgtggtttccctgggccactttcttctcccgccttcctgccgcatgcaggagtggaggccgaggctccctggccaggctgctctgggttattacagtgatatatcttggaactgagcttgagcagggatcctcctgtttcctgttggaattgattttctgtccaactttcatttcctattgtgcattcctttggggtcagagcagctttctcagacaaaagcagggctttctgttttggagatattcctggcgtctcttcagctgcgtgtttatagaaatggacagcccggcagtgcatgaaagtggctgcctggccaaagtctggccgggctgcttagtggtactctgggggttggacccagtaggattcttggacttggcgcggagtcccagatcaccctgtcattggccctgtatcttaacttgtaggcacgtcttcatctgtcagatgggctttgttctctgaagcccgcatcagagagctcttcagaagagaggaaatgttatattgctgttatcatttcaaatgcttaccgctaagtgaatctggttcaaagcttaacagcctgtgggtgaaccgcaaaagctcaattggatctcaaagaaatccctggtcaagccctgtgccttctagtacccaattatttatcaataagtgtgaagattgcaacctccagattattcagccattgttgagatgtgtaaaaacggtatccccagcaccttgaaaggctaagtaggatcaaccccccagttgttgttcactttctgtgtcctcagaatccacttttgtttcagtccttctaacccattctcattgttttctgtcagtgttggaataagtggaatagcagggtccataaactctaccacttgattgtcaggaatgaagaatttggttttctctgttgtcataacattcgtgagtacatctgtaagcaggcattttcccatcatctttcccgcatttctaatgaatgtgacatcagtctatttgctgcttcataatcaaggtcctgtttgttgatatgtaatcaaagcaaccggattatgtttgtcagtacgagtcagaaaaatctaatatatatttactctgatgccataaggagtgtcagcctttgctggcctcaataatctcgtcttgggagagaaagctcataatgtggtgaagataccgttttgggattatttctagaacgtgatagttgtgccgtgcacatacatgtccaaatgcattgagtcatgtgatagcatccagttttatgcaaccaaaattggacattatattgtttggatagagtgctcaagatgggtggttcctggatagagtgttgaaggcagtggtgccatcaattcagcagcaaggaacttaatagctttctcatcacagtcctcacctcctccctcctttttctgtgtcacagaagcagtaagaaacatcgaggaatttcccaacatatcagggaatttgttatttcttctaaaacataaggaagtacgtggcaatataaatggcaaatgtgcggggtgcggtggctcacacctgtaatcccagcactttgggaggccaaggtgggcggaccaagaggtcagcagtttgagaccagcctgcccaacatggtgaaaccctgtctctactaaaaatacgaaaattagctgggcgtggtggcgggtgcctgtaatctcagctactcaggaagctgaggcaggagaatcgcttgaaccttgggggcggaggttgcagtgagccaagatcgtgccattgtactccagcctgggcaatagagcaagactctgtctcaaaaaaaaaaaaaaaaaaaaaaaaagaaagaaatggcaaatggacatttacatggtgattagaaaattagaatacaccgggaaatctgggttctgttctcagtcctacttgtaacacatccactgaccttaaacacatttctttactttgctgcacctgaattcccttatctgctgtaaaatgaatttgttgaactaaactaaatgttctttttttttttttttttttgcgacggagtctcgctttgtcgcccaggccggagtgcagtggcgcgatctcggctcactgcaagctccgcctcccgggttcacgccattctcctgcctcagcctcccgagtagctgggactacaggtgcccgccaccacgcccggctaattttttgtatttttagtagagacggggtttcaccgtgttagccaggatggtctcgatctcctgacctcgtgatccgcccgcctcggcctcccaaagtgctgggattacaggcgtaagccaccgcgcccggccctaaatgttcttaaagatcctttccagccctgacattgaactcagtacatcaacttacatgatttattcgcacaatcttagcagaattaatttggatttgttaattgtttgcatctggctaattattgcctgcacaccgtaagactatctaacagtagtagtttcttatattaactaaaggtgctgtgaaggaaacatggaattcccccaaaatcaaaactaaaagaaacttctgctttagagcaaacactgataaaatatacataaggcaccctagctgcactgggcccttctgccctcttcagcaagtcctgcctgaggtgcacacaattattactggctcttgtgccacaaagtgacatcgtctttggctgtgacaccacatgaagagggaaggaggtgtgagactgtgaagacactcagtacaggtgcagcctcctccacagagtaaatgtgatacttctcgagttaatgactatgttgggaagttttccaactccaccatcttccctgcttcaacgaggatcccagggggaagctcacagatttgcagatctttttacactaaggaagaataaagcagcattccagttgcaggagtataagccagccacagacccagggggcacatcttacactgtctttgggagaaagaaaaagtactaataacaaataaatctgatgggatttcagatggattccagtctcattcttttgtgatagcagggagtgaggttttgatatattccctctagagatggttctaaacatggagacccatcgatatccaggtatacctcctctcctctctgatcaatccaattgctaaacaagaccagagcaaggctcagtagttgatggcaagtgcttctgctaattgccttgcgattggggaatcaggaggatgtttttattcaggaaggcatgtctgaccaatgaaacaaaatgcagttggtatcattttagatttggctcttgaatcgtcagaaatatgtgccttcactaactttgaggaggaagtatcccttctctttgggtatctctgggaagttgctttattgatttttcaccagtttgcagacaagcccaagtctaaaaaaaattcagatgtagcctaatactgcaagcctttcttttatctgtctatctatccatctgcctgtctgcctgtctgcctgtccatccatccatacgtccatccctccatccatccatccatccatccatccgtctacctacatgcctgcctacctcagcctcccggatgtttgaggctgcagtgagctatgatcacaccactgcagtccaaactgagtgattcatgattgcaccactggactccagaccaagtgacagaacgagacagacccatctttaaaaaaaaaaatgattatgagaggtctcagtgcagaaatggcttcctcctgcccattgtgccagcttgcccaggcccagaggttgagtcatgatatgaatgtgctgtgtagtgtccagcaccagaagtgtgggtatagtggaggaaaaagatacagagccagaaccaggacatggaaacatttttaagctatatgtttttaaaaatcaccacccccatgctagagagaggactgaattaggtttctgttttctctctaaaattgatataacaaaattgttgtcatgtgaagagaaaatcaaagagtatgctgacaaaatatgtgggaaaatctaaagcacagggacaaacgaaaaaaatagatgacttgggactatatcaaaatggaaagctttttttgttgcaaatggtaccatccagaaaatgacaaaagcaacccacagaatgggagaaaatttttgcaaatcacatatttgataaagaacctgtacccagaatatatgaaagactcttgccactcaataataaaaagacaagtcaattataaaaatgagtaaaagatttgaatagacatttctccaaagaagatatacagatggccaataaacacatgaaaagataattcagcagcattagctatcagggaaacacaagtcaaaactacaatgagatacccctcatttatactcgcatggctagaataaaaaagataaacaatatgaagtgttgatgaggatgtggagaaattgaatccttatacattgctgttgaaaatgtgaaatgaggccggtcgcagtggctcacgcctgtaatcccagcactttgggaggccgaggcaggtggatcacgaggtcaggagatcgagaccatcctggctaacatggtgaaaccccgtctctactaaaaatacaaaaaattagccgggtgtggtggcgggcgcctgtagtcccagctactcgggagactgaggcagaagaatggcttgaacccggtaggcagagctttagtgagccgagatcgcaccactgcactccagcctgggtgacagagcgagacgactcctcaaaaaaaaaaaaaaaaaaaaagaaaagaaaatgtgaaacgatatagcccctgtggaagagaacttggcactttctcagagagttaaacacaatgttatcatatgacccaacaattctacccttgttatgaaaaaacatgtatccacaaaaccttgtacatgaatgtttatagcaacattattcataatagcccccaaatagaaacaacccaaatgtctatcaactgaagaatggataaacaaaatgtggcatgatctatataatggaatattacttggcagtgaaaaggaatgaagtgtggttcattcattgaaatattatggtaagtgaaagaacctagacacaaaagatgacatattgtatgattcctttgatataaagtgtctagaagaggcaaatctgtagatacagtatgtagattcctcattctcaggggctgaattgggacgttgcagctaatgcatatggaatttattttaggagataatgaaaatgttctaaattcgatgatggttgcacaaccctgtaaatatactaaaaagcatagaattgtacaatataaatggatgaattatatttcaatagagctgttttaaaaatattgaaaaccagagatacctgtctgtgctctaaaatgtatccactgccttctagatacagtctaaactctgcagcttggcttttaaagccttttatttatatggaatcctccccaccccccaccatctatacatttgtaaaccttacatgttattcaaatgccataattcgtcaaactggatatgttttctccttccagaaagatattccttcatccctcttataagccttagcactgtctgccttgcgttatatttatttctgtatctgtcatatgatctctatctgatcgagagctctttaaggccgggatgtcggcttgctcatattggcatccttcaggacacctgacccctaaacttatctgattggtacgtgatacatttttatcactggatagaatgaatgggttgtgaaattattagatgtgatcccagataggatactgtttttactaatctctttcacaagggtctttcaagaacaatgcaggatcaaacttataaagagatttttgaaactctcaaaactctgtgcagggtattattattatctgtaatcctggtaactattcaaattagtgtcaattaacttttggctgcactcttaagattctttatcatctacattagtttgtcagatgaggtaatgcactttttctgggtacagttgtctttgaagagattggcagcgtttcatagttgtaaacaaaaccgtctcatatgccggaccgtgacaaagagggactaggacgccagaagctctgtgaaaacacttaaatccatttcagcgaggaggaattgtgatctggtaaataaattagtgttctgctctgttccttggctcctctgctaatgaatgggccccagagatttttttttgtcttgggtgataagcccctaatatctattcaagttcagcataaagctcattttctctagaaatctttgtttaaaaacagaatttttccagtaaatatatttatcaaattaaaagtatttcagatacacagagagtgatataacaaacaaaccaccgcctgtgtctaacaaatgctggctttttgtcatatctgctttggatgtttttttagttgaaaaacatttcgaagatagttgaatcattcctttccttcccaaatctcattgcccctccctccctttcctctgaagccacaattatctctaccaggaatctctctctctcttttttttttttttttgagacggagtctcgctctgtcgcccaggctggagtgcggtggcgcgatctgggctcactgcaagctccgcctcccgggttcacgcaattctcctgcctcagcctcccaagtagctgggactacaggtgcccgccaccacgcccggctaattttttgtatttttagtggagacggggttttaccatgttggccaggtctaccaggaatctttaactggttaatctttcagtccaactttgatatcaattgttaactcttgagaccattttctatttcaaaactgtccatctgactcgtttctattactctgaaataatagaatctcagaattctgtgatctaccttcaagccgattaaatgggaatttttcccagagagagtttaaaccggcctctgggttaggggagaagtatagaccccaaagacccttacagagaaatacttgtcatcacgctcctggaattctgggagagggagaggcatgagaaggctgtgtggccttgtctttgaaatacagaagtttggtgacgcctggaacattttttacatgacaaatatggtgaaatttaacaggctatcaaagtgcagatcaggccaactgaatagcagttttggggaaaatgacaaggtgctaggtagtggagagaggaagattaaataacctacttgggtctatgtgctcgtgaagacacgctcatatgtcttccttgcatggatacctgccttgctctaaaataaacttgaagtgtgtttttaaaaaaagcatgtgtgcagcctgggtaacatagtgagaccttgcttctacaaaatacaaaataaaaagagtagccgggcatggtagcgtgcacctgtagtcccagctacatgggaggcggaggcgggaggatcacctgagctgaggaggttgagtttgaggctgcagtgagctgtgattgcaccacttcaccctggcctgggcaacagaataagaccctgtctcaaaacaagacaaaacaaaaacatgaatggaacaagaaagaatcatgaggtgaggaaatgaaggttaagggaagatgaggatcagagggagtaacaggttcagttctaagatgaggtccgcatgtggaatacataccattaggcacgaagctcgggctggaagtaccctacagactgcaccatgagcttctcaacagacagtgggtaaaggagtcagtgacagaatctagggcttttaagataaaagcaaaccagttggccaaggaagaatggctatttccagcacagatgcctgagggccattttttctgaggatgtggctctcacccttgatggacaatcaggacattctagcaaatgtgcattgtgctctagaggggtgtgtgcagggagcatagctgagggatggaggggctcatgtgcatcaggattgcctggaataccagggattattagtgccaataatgctgtcaatgacgttgtgatggttaattttctgtgtcaacttgactgggccgcgggatgcccagatatttggtcaaacgttgttcttgggtgtgtctgtgaacaaatagccctcactggtgcaggtgagtctcatccaatcggtcgaaggcctgagtagaactggccttcccgtgagtcagatggaagtcctcttgcctgactgctcgatctgggacatgctgctttgggactccagctgaaacatcagttcttcctgggtctcaaggctgccagcctttgggatggaatgacgccatcgggtctcctggttctcagccctttggactaccactgggactgtggtgatagtctctcttgggtcgccagctggccaactgcagatcttgggatctgtcattctccatcttatgataaatcaataaatacctctctcattatatatataatatataatatgaaataaattaataaatatctctcactatatatagtgatatatatatattaggtatattttatatatatgtatatcctattagtcctgtttctccagagaactctggcgaatacagacattccatatgcaaagagaggccgcgtggtcttaggtactagttgtaaaattataatatatattatattatatataatatttaatatatataataaatcaataaatatatatctcactatatatatctcttactatatatataaatcaataaatatctctctctcactatatgtatatatatcctattagtcctgtttctccagagaactctggccaatacaaacactccatatgcaaagagaggtcacgtgatcttaggtactagttgtaacattataatatatattatatataatatttattttatataataaatcaataaatatatatctcactatatataaatatctctcactatatatacatatcaatcaataaatatctctctctcactatatgtatatatatatatcctattagttctgtttctccagagaaccctggcaaatacaaacattccatatgccaagagagatagcgtggtcttaggtactagttgtacaattattttacatttgaagaggtaaacctttgggttcataggctttctaactgatgtcatggagtggtgggagggttttgttttcccttatccattaactttattcttaaaataacaatatcactaataacatttatggcatacttgtaagcacttcacatatattctctcacttagcatcatgacaatattctaaggggactgaggcactcagagcttaggaaactcgttcaaggtcacctagctaggaaacgatgtgctgttttcaaggccctcatctgaataaaactatcttccctttactctcagcggtgaaaatgggggagagatctgtattggaagctcattcagatgttgccttcttttgcactcgaaggctttgctctctgaaggcaggaagcagcaggcacgtgtgcagggaaggctgtgtatgtggcatgtgcaggcagcagcagcaacgcgggacgatggggagagagcccaggggagggaggatgcctgcagaagcggctgtgatgtgtgggaagccccgctgggccggcactgtggaaaggtgacctgcagagccacagctgcaaatgaaccactaattttcccatctctgcttgcaatttacaaagcactttcctggtgtcatgagtagctcccaagtatcagagcagggattgaaacttaagttgtttgacgctacactctgatttcctcaccccacctcactgtcttgccagttccaactgtacccctcaggaatttctatcaggagtctgtgtcaacatcagcatgaagctgaagaaggagaaaggaaatggggcaacaaagcacacagatgttcctaaaaagcaaaagcggaagagagaagctagactcgcctgtctctggtttttctcaccgcctgattgttcctttcagatgacccgcatctctcggagctgacctcagctcagcaagggtgcctgtgacccatggagcagtggccactatctctgcattgtgggagggtggtccgtgttgggtctgcagggtcgttgtcacagcgatgaatgtgtagatctgtgcttgctgaagctcaggctggtcgctgtcttgtcatcgtctcctgttacacagctttcaggctgcttttttggggaagttagactcgcctgctcttttttggggaagttccacctcactgcagccgggtatggtggtttgctcctgtagtcctagctacttgggaggctgaggcaggaggattgcttgagccaggagttcgaggctgcagtgagcagagatcacaccactgcactccagcttgggtgacagagtgagaccctgtctctaaaataaaataaaataaaaataataaataaataaataaatcaccccttggccaggcgcagtggctcatgcctgtaatcccagcactttgggaggccaaggtgggtggatcacctgaggtcaggagttcgagaccagcctgggcaacatggggaaaccctgtctctaccaaaagtacaaaaattagcctggtgtggcaggcgcctgtaatctcagctactcaggaggctgaggcaggagaacggcttgaacccaggagacagaggttgcagtgagccgagatcatgccattgcactgcagcctgggcgacagagcaagactccatctcagaaaaagaaacaaaaaaatcaccgtttaactcagaatcagccacgctgaattgaggtgaggttttatgcatatcagattgaagacctcctccggggagtggtaggctgatggcttagtcatcctataaagagcccagcatctgactgcacagctgggtctacctacagcatggagatggctatctgggaataatgggcactagaattggaggatcctgatgaaccacttcctggccccttgcttgtgccacctcccttcccgccaggtaaatattgcttagacacccagcttctgattaaagccacatgatggaacttgtcctaaggatgcaactgatggcccgtgtcagcttgttggagttaaaaaatatattttaatttgtttagctctctggggaaattatctgagcctgcatgtgataatcaactttcacatgagctttcaagagacctgaaatgatttgagcaacaaaatgagatttttaatctacataaatacaggagtcgtttgcctctctttttgtgtgtatgcgagaggaggggagcttaaaacaattctaattcattccttttcttctcccctaggacactcattagcaatggtaggaaaatggtcacaggagtggtaccttgcctcacattctcacacacattttccctttggactttaaacttcacatcaactcttaaggtgggggtgggcggtagcaagtgttgcttcccctttttatggaaaaaagtaggtctcagagaggttacgtgacatgcccaagttcatgtgctggtgggttgcagagtcagttctagagcccagttctttttggaaactggatcaatgctctttctacctcaccagctgtctcatattaatactagagatactaatgcaaaaacactaccataatagtatctgcaagagaacaaattcaagggaagatggatggatactggccgggcgccgtggctcaggactgtaatcccagcactttgggaggctgaggcgggcagatcacgaggtcaagagatcgagaccatcctggccaacctggtgagacccgtctctactaaaaatacaaaaattagccaggcgtggtggtgcgcacctgtagtcccagctactcgggaggctgaggcaggagaatcgcttgaacctgggaggcagaggttgcagtgagccaagatcatgacactgcacttcagcctcggcgacagagtgagactccatctcaaaaaacaaacaaacaaacaaacaaacaaaaagatggattgacactgcacctgcctgcatcagccaggctaagctgggttaagttgtggctacaccagatgtctatggcttcactggtttatgcaaagtcccctgtggggccaggtcactctccagggaagatctcatgacttccatgtcagcaggacttagggtgcactgaagagggaaagcagactgaagagctttgtcgaaagggtgtttaagtttggcagcccaaaaatgacagagaagttcatagccagtcacagcctgtgggctggctctaattgtgcagccctgcccgatgcacgggcggttgtgaaactgtgtcttccgagtgtgtaagaaggggagaagacccggaaatactggtgaccactagccatgagcaccacatggtctgcaggtctgagcggtcaaaagatctgttctgtggagcaggctcccctttaaccatgtccctgtcacagatcccgcggcaagcattcacaccacctggaattaatcgggaagaaagtcgcagtgtttagcagatatttcacagatataaactgtgcggtcttcctaagtctctgcacatgatcagctgaagattgggcttcttgtggtgcacataccattttcgtcattaaatccccaatgactcaccttgtcctgaaactgttaaagctccttagcaagactgaggcccatcctgatttgggccccgacaccctccccagtctcttctttcatggcacccctcctgtcatctgggtttgtgaagctcctttcagtcctctcaaaagagcgtttctctcttccccctctcgctctccgcacctgctgttccctccgctttgaggtatttcctcctcactcacgtccctctttgtccaggtctcaggaggcctgctcttgtatgtgagtccctagctagatggcaaaccccttggggtcagagacagggactcctggcagcacttgcccttaaaaacttatattcaggcggggggcggtgactcacacttgtaatcccagcactttgggaggcctaggcaggtggatcgcctgaggtcaggagcttgagaccagcctggccaacatggtgaaaccccatctctactaaaaatacaaaaaaaaattagccaggcgtggtggtgggcgcctggaatcccagctactcgggaggccgaggcaggagaatcgcttgaaccccagagggagaggttgcagtgagtcgagatcgtgccactgcactccagcctgggcgacagagcgagactctgtctcgaaaaaaagaaaaagcaaacaaacaaacagcccttacattcagcatagggcttagctaatacatggaagcaactgactactatgtgttcaataagcaaatgaatggtcgtgtgaatggataaatgaggtctgtgaagttgaatgcttgtctgggtgaggggacgtctcctggctcaccctcacctctgttggctgtgctgcaagctgtagtcaggatggtcattttccagctttgaccatgattgctcttgcttttggtgtcagcgcctacctgtatggtgccctccattcgtcagttgccttatatcccagcacgcttcctcaagagctgaagaaacgtcttacattttcatatgaaatcattttcaagcaaggtatagattcacataatacataattaatggtaaaatgctattagcattatgtacttaaattatttggctttaaggccaggcgcggtggctcacgcctgtaatcccagcactttgggaggccgaggcgggtggatcacctgaggtcgggagttggagaccggcctgaccaacatggagaaaccccgtctctactaaaaatacaaaattagctgggtgtggtggcgggcgcctgtaatcccagctactcgggaggctgaggcaggagaattgcttgaacccaggaggtggaggttgcggtgagccgagattgtgccactgcactccagcctgggcaacgagagcaaaactccatctcaaaaaaataataaaaataaaaataaattatttggctataatccccattggagttactgtttaatgggtagagagtttcagtctgagttgatgaaaacgctctggagatggatggtggcaacagttgcacaaaaatgtgaatgtacctaatgccactgagacccacacttcaaaatggttcaaggtacattgcttgagcctaggagtttgagaccaggctgggcgacagagtgagaccttgtctgtaaaagaaaaaaaaaggccgggtgcagtggctcatgcctgtaatcccagcactttgggaggcctaggcaggtggatcacctgaggtcaggagttcaagaccagcctggccaatgtggtgaaaccccgtctctactaaaaatacacaaattagctggacatggtggcgggcacctgtaatcccagctacttgggaggctaaggcaggagactctcctgaactcaggaggcggaggttgcagtgagccaagattgcaccactgcactccagcctgggtgacagagtgcaaaaaaaaaaaaaaaagaaaaagaaaaatatcagtcgggtgtggtggtgcacgtcgtggtcccagatactcaagaggctgctgacgtgggaggattacttgagccccgtagatggaggctgcagtaagccgtgatggtgccactgcactgcagcctgggcaacagatgagagagtaaaaaatggttcaaatggcaaattttatggatacttcgccacaataaaaataaatttctattaaagtacatatcattaattccacaaatgcaaatagaataccaatcaaaggaagtcctcagaacacagactgcacagtaaagtgtgggcctaactagaccacagcctgtttcatgtcaccaggcttagtggatgaccgcactgcaaggaaaattgctgagactgagtcatgttttggttctctggctgcttctattttttttttttttagatggagtttcattcttgttgcccaggatagagtgcagtggtgtgaacctccgcctcccaggttcaagcgattctcctgcctcagcctcccaagtagatgggattacaggcacccgccaccatgcctggctaatttttttgtatttttagtagagatggggcctcaccatgttggccaggttggtcttgaactcctgaccccaggtgatccgcctgcctcggtctcccaaagttctgggattacaggcatgagccaccgcgtccggcccctgggtgcttcttattttggaaaattcttccccaaatgagactaattttggctcagtagaaaaattctctcacctcttgtcccgaaggtgaaaatccacctcaatgattttcaatttttttttaatcatcatcggcctcttttattttttttctgatagaatgtgctttaagagatagttgtagcctgtttcctattcctgcatttataaagtaacaattcatttatccttgccagctgtctgcaagcttaaaatacctagacacatctcaccacccagtagtgtccttgactggcttggatggccagtttccctatactgatttggtacaattgctacattttatagaatacttaaatatgaatacaagtgtgatttctgtggggcttttgacaaaccagaactagttcaaggaccctcacaatcaccttcaagggacaaaaacctgcattttgtgtgtttcctggtgcgtttcctttaagagtcctggcgcctgggctgtccagcccgggtggagggactcccgagacctggtgatggatgctgtagtcaggagtgcatattggatctgttacacggtggtgatatacgatttcaacatttcagggttgatttggattttctgtactccctgcctggaattttcctgctgtgttgttttgtgctttactgttcaacaagaggaaaataaatctagaaacctgcttaaaaatagacatcctgttttcaattctctatcattaaaagatcttaaaagctagaatttagttctcttcccggtagaaggaaggagttgcgctaaggtcccttcttagaaattagctctagaaatcctaaaattctagctaaccaaccacagtgttcacgggcctaatatcccttacatttttcttgtctgacaggcccagagggctcactgtctgtgagctttcacggggttgttgctatcccccagggttgattgatctgtttattctaagcttgaggccagagctggaagggaggccgtttgttttgggcactgctgagaaaaacagactaatcacctaaataccaccttggggaatgaagttacttgaaaagaaactgaatggagcctgggcttttatttggaatgaggaggcaaacctgggaagctgcatgccgctgaatgatgatgaaaagcacaaagctactgaatgcctctggcttggccgccaaagagaattggtttctgtaagtgtcggagagggaagacccgcattccagagctgcacccctttcttcacatttccggtccctctcccccagctcctgcacaccctgatgctggaccaaggggcctgggcagaggtgggtgtgctgggcgggaaagtacgtcatggatgcctcaacttgccatggatggcaggttgacttccttcccagcaacttgcagatgttcagatgcgcagagttaaggtctaaaacaagaaaagtttgctaacgtagagtggccgctgggtcttatctttccgtcttcaatggccttgaaaaatatggggcacgcatggggatttcacactcttaacaagctaatgtctctaacactacaggttacacttcacctgatttccaggttagtgcagcgcctgacctctctccagaggcaccctcgtttagaagcatagatgatgcaaaaacatggtttctcttctcagttcagattgcctctgttgcaaggactgagaactctgaggagatctaggagatccctaagtatattaggttttaattctgggtcaaatcagcaaatgtttattaagtacacacaacagacagggcactgtaagacaaaacaaatcaatcagtcaacgtcaactcttgtcattgcttggggggtaaaggcaatacaaggaatgactggcaaatacaggtgtgaattccacttaccctcagcaagacgagggaagaagaagattctggaaagggagaattctgccagcaccaacctgatcatccttctgggcatggccaaatgcctccatttttcctctgaggggcttctttgccctgaggaatatacaagttgatagggctacttgccttcttgctcattaatatctgcttggctccggatctgcaggtagagcagtgctggaattatcccagagctgtgttgtgacctctggatgctagcctttccaagcagggactttgctgcgactccctaagttcatagggaaagcagcaaggatgagttcgggagactctggcatatgcatcagagttccagagtgaaaggtggctctgaaaactttgcaaactgtacataactcaattccccaggctgctgtgtgtccgtcatccctgaaatttcatgaggccagagtaggtcaacaggggctaatgagacaagatctaactaaacagagtaaagagtttctcggtcacaagggaaacttttactatttgaaatcagcctgagccaagattgatgaggaaaaaaaaacaaaaaccaaaatctactgcattttactcctatttaggaagaagtaaacttttgtaaacaggaagaacacagggatatttgctcttagctagaatggggcaaattggcaacagttttgggtgcctacggctttgggtttgatggagtcaacctgccactaaggaaatagacccaaggaggttaaactcagtagagagctatgggtattcctttcctttaagttacagctcccaggaaagcaaaacacaagctgaacaaacattatacaagccatgtatatgtgtagcatgtgtccagatccaattcacttatttgctcacgcttctaggaactccatccttgtgcttttatctcctgggctctctgactttgagacttttcacagctgtcatcatttagcataaataacagcctgcggaagagtgggtgacaatgtggcattttgctgggccacttcttgctcagcatttgtcgtggagtcttctgccattggccatgtgccaggcctgacaaacagccatcaacacaacttgtcaccaagtgattttgaaaacttattgttgaggtgacttcattcttacatctttcgtgcttggcaaagtaattactacgccaagttttttttttttttaatcaaaataaaacactgattaaatgttttcctgtatctggattacaaactattccgtgatctccaaactttgtcctctcgtgtgtgtgtgcatctcacacaatctctgtccttcttggaaaaatgtctccattaattactggggatgaaagttgattaaaattgtaggtcatttcccagggaggttttatgtgaataactttagtactgtgatgcactacttatgaaatctctggtctctttctaaaatcaggttggagaagaagagactgtgcatgacagtgcagccatgtggcttggagactatgtgagtggaagcattttgaggatacgatttctgagtccatgctatttctctgttgtagcttagctgtggattccttacgtgcgaatgatttgggagtataagaacacagactcagtgtcatcattttgtctaccattaccctttcctttagaaaatctgtttgtgtcattcatttagaatgttgccgttaacaaagtattttatgtatactattttatttggacattatgatggtccacgctgtgaggtcagccagctattgttcatatttgttccagatgagagactggaggttcagagcagcaatgtgccctgcacacctccacacagttcacacagtgctcagaacagcaatgtgccgtgcacaccacacaccctgttcagtgcagaggcagcaggcaggaccccaggacttctgagtcctgatccaaagctacttcctcaaaatccctttactactttattattattattttttaaatagactttttaaaaagcagttttcagcttatagaaaaaaagtgaatgaaaagtacagaattcccatgtgccgcctctcgttctcctcagtttcccctgttattagcatcttgccttagtgtgctacgtttgtttcaactgatgacccaatattgatacgttattgttaactaaagtttatagtttatgttagggttcactctttgtcttgtacattgtatgagttttgacaaatgaataaagacccagtgatcatgatcaagtgtgatttccccaaagtgagatgtgttgtccttcacagagcacacttagtgcagtggcggtcaatctaactggttttttttgttgttgtttttgttttgttttatttatttatttattttggtggcttagtctcctctgtcacccaggctggagtgcaatggtgtgatcttggctcactgcaacctccgcctcccaagttcaagcaattctcctgcctcagccttctgagtagctgggattacagacacacgccaccatgcccggctaatatttgtatttttagtagagatggggtttcattgtatcggtcaggctggtcttgaactcttgatttcaggtgatctccccgcgtcgtcctcccaaagtgctgggattacaggcgtaagccaccgtacctggcctgtgtttttcaaatgtaaacaaaaggccatcaagcagtgacagttcatctcctgacttcatttttattgtcacaaaagtgttctggttagaaagaaaaaaaatcacatatccaccattacagtatcacacagagtcgtttcactaccctaaagccccctgttctctctctattcatccttcccaccatccaccctcatccctggcagccagtggtctttttctgtctgcacagttgtgccttttctagaatgtcagatagttgtaaccatgtactgtgcctttaccaccatgttgagccttgatgtgtttccttcgttggttttatcaataacaacgaacattcactggtttctttccatcgaagttacattttttcatgaaggtaaactcttaaacaagtgtctctttttgtcaccctctcctaggcctattcttgctattggttagaatgtggccaatagattcacctcatggtagcaatgtccttgctgaatataacaaatctgatggttgtcatctaccaagaattttgtttctctgaggaaaatcagcaaaactctcatttcagttctagtgtagcctagccatgctaggctgttttgtaaatgatgactattaggagatatttgtatccattgagatggagaacaccgaagcttcgaaggaggaaacagcttgcccaagtaaagaccattaggagaacacaaaataaccaccaaggcttccttattcccatttgagatgctgctgattgagccgcaattggccagtgctctaaaaccgaggcctggaaaggacaggccatgccagttcgctcagccattcaacccagcagccctgactattgtagccaaggtgatggacttgattcccatagaaagcagcatcaccttggagctcacctttaactcctggaggctggcagggcccctgtggccacaactagactgtgagaggaaccaagaaagtacgttgagatcttggaaccaacccaaatgcccatcaatgatagactggataaagaaaatgtggcacatatacaccatggaatactatgcagccatagaaaagaatgagttcatgttctttgcagggacatggatgaagctggaaaccatcattctcaacaaactaacacaggaacaaaaaaaccaaacaccgcatgttctcgctcataagtaggagttgaacaatgagaacacatggacacagggaggagaacatcacacaccggggcctgtgggggatgggggataaggggagggagagcattaggacaaatacctaatgcatgcggggcttaaaacctagatgacgggttgataggtgcagcaaaccaccatggcacatgtatacctatgtaacaaacctgcatgttctgcacatgtatctgagaacttacagtataataaataaataaataaaaatcacacacaaaaaggaaagtacatttagatctcatctccctctcaccccaaatccaagaacagaacaactcagacacatgtcctacagatcagcacacaatttttttgtgattgaagaaacgaatactaacattggttgatggaagagacagtactctaaagtcagcatgataatggacagaagaacaaatgatgcatctagtaactgatgtttaacaactgattacctgtttgtatggcatatttaaacattattgtgttttctgctgtttgggtagtggttgtttataattattaaagatgccccgagtgacaaagagacgaaggatcatgaacatcttaaaacacttcttgctttttaacaagggcagagcaaagttgttaaaaaggtaaccgagggtcagataaccaatgattcattgatgatgaatgctcattcttctagtgccaatgtggtaaaatgtggatgtttttaaccttgtaagttaggtggcagcatagtctagtagaaaacacctctagctcatggatgaacgtttctccaatttgctcccaagtctcttattgatactatatttgggtgaccctgggcaagtcctattgatagttggctttgacttaggacaaatgaggttacacagactgagagttttgtgttggacttcaagtacgcttctagactaaaagcattatgccattaatatttatgttatatagcttgtatataagtatctctattcctattatcttattaatgttcacatgtatggatgtgtatacacgcatggatttgtgtagatatgtgtggttgtgacgtatgtattttgtgtcttacagttttgcaaagctcttttgcagacattacctcatttgatctttcaacagtctctcagaagggggatgtccttgctttcattttataaatgtggttgagagaggttatggttcctgaaacttgatacaattaccaagtttctgaaatataggaaaaataacttcattgtagacaaaggtcacaatttcaagaggctttgtaacgaaattatgaacaagtttggaaaaactgcaagaaattcattgaacaaaattaagaagatcagccttttgagaaaggtctctcttgatggcaagaccgagcagcatctttcactgagccacagatttgtatggcggattggatttctggggaaggttctcctcagaacagtgcccttcagtccaccggaaagtgccactccaatttttagttaagaaaggctctgaaaagacccactctcaaaggtaccacctgttcatgtagtcattaatttgttaactaattaatcgacccatctatttattcgcttattcactcaaaagcatttaccaagctcctactgtgtgtcctcaaggacatccagctgtacgggaataaacaggggaagcatatggtggacttgaaggtggagttggtgtggaccctgccgtgggtggatggaggtggaggtggggtggtcctgccatgggtggatggaggtggaggtggggtagacccttatgtgggtggtgggaggtggaggtggggtgggccctgccatgggtggtgagaggtagagttggtgtggactctgccaggggtggttggaggtggaggtggggtggaccctgatgtgggtggttggaggtggaggtggggtgggccctgccatgggtggtgagaggtagagttggtgtggactctgccaggggtggttggaggtggaggtggggtggaccctgatgtgggtgattggaggtggaggtggggtgggctctgccatgcatggttggaggtggagttgatgtgggttctgcacagcttaggctgagcaggaagtgtattttcagacctggaatagactccctatggtggacagagttgctggaaaaaatatcagaatatattgtttaggacatctcatcttcaagacatagattccccttcttatggaattttgagatgtcctagctggaggaagaagaattctttccatggaaacaataaacagtcaaaatgtttactatgaaattcatggaaatgctctgccagaggctcgggaatctctgcagagaacattttctgtactgcaggatgacagaggctgtcgagaataaaatgaagctgagtgcttgtggttgggattccttctttttcctcttttattgtttctccttagctttgtgcccaggtcatttgtctatcttccttcccttgaaatccctcctgctttggggccctgcactgcctctggagcatccagttctgagattccaatcacagggccaggcatgaaacacggccatccctcaggcacacggctgctgggatatggcaagcttgttaacacggcaggacaacccaagatgccatgttcctaaagaaaatgggggccgggcacggtggctcatgcctgtaatcccagcactctgggaggtcgaggtgggcggattacctgaggtcaggagttcgagaccagcctggccaacatggtgaaatcccgtctctacttaaaatacaaaaattagccaggtgtggtggcatgcacctgtaatcccacctactcaggaggctgaggcaggagaatcgcttgaacccaggaggcggagcttgcagtgagtcaagatcacgccactgcactccagcctggacgacaaagccagaccttgtctcaaaaaaaaaaaaaaaaagaaaaaaagaaaaaagaaagaaaatgatattcattgcccacctccttacacacatacccagagtggagttaatcctttccatatctgtgtacccatgcttctttatatatattaagttgaaccatatgaaattgccaggattcacgatcttgacctgcaaaaataggcagtttcatgtagttgcacctgctatgtgtggcatttgttctcactttcaccgtgagcgtcatttgttgactttagcttaaaaccaaccttattccactgcatgccaccttgtcctcagagaattcataaagacaggcttaagaatccatttcagctgggcgcggtggctcacgccagtaatcccagcactttggaaagccgaggcaggcagatcacctgaggtctgagttcgagaccagcctgaccaacatggtgaaaccccgtctctactacaagtacaaaattagcgggcgtggtggtgcatgcctgtaatcccagctactcaggaggctgaggcaggagaatcgcttgaacccaggaggcagaggttgcggtgagccaagatcgcatcgttgcactccagcctgggcaacaagagtgagactccatttaaaaaaaaaaggaaaaaaaaagaatccatttcatccagccttctgattctaggaataggaacgtcaattcaatccaatgaatcctgggacagcatttggtgtgccaggtagagcgtgtgtggcggagggggggtggtattgtttgtgacgtaggttttctgattggaactactgttgcaggcttgaccatcacctcccactactgcgtgtgaggctaaatgctgctccctcgcttattgctaaatggagagaatacgagggagacaatggggaacgtgaaagcaacaacattgtcaactggatttgatgcagggcagtgggcagggactcagaactccactccccctactcagacgggcaatcatgtcacagtcaagatgagaaatacccatcgagatttgagtgcatgtgactcttctaaaagtaaggcgtgttcttcacagcgcacactgagcaccgttgcagtcaatctaactgatgtttttcaaatgtaaaccaaaggcctcaagcagccacagtttatctcctgacttcctttttattgtcacaaggtgttctgtttagaaagaaaacaagccgttagaatattccaacagaaacagcattaacatgatttactaggtgggttatttagggttactcagccaagaaatggcatttctggacagtggtagatttgttcagcctctcacaaattgagggaagtggctttatttcttcccacccagctagttcccctgtcctcagcccagagattcaaatgccaacggctgccaagtttaccccaggaccgccaggcaaaggttccggaccactgtttgttttccatttctgtggcctcatcatgctcagaaatgctgacttctacgaagagcccagaaaagttcagatgtgtgccaaggctttggttgtaggcttggcacaaggagcagcagctggtaaggaccaggagacagcccggcctcctccatggtgcctgcctctcatagaagcagtcaggaggacaagcttttggtttccgcagacttagcagtcattcctgtgttcctaagaatcatactcgggattttaaaaattcatgtatttagttataactgtgaaatatcatagaaccgggaggtgatgtccaagtcatctggccagtccagtttctccttttgcacatcaaggatcaggccccaagaggccaagggattagtgggaacccttcttcttgccttcacatccatctctcagtctttgtttcctatcgcttacagttgtttttcacttctctcttcttttcctactccttaccatctgaagaactgaaaaaattattccaggttcagcaatgttggaaccaagttttgtaaacggacctaagccttttacaatctgggggaccttctttaggaaatggaacacagatgaccatgtatacatgttgctggcgcccctcctatggctttggaaggcacccaggcaggtgaggagccctgaatctcgagcttcctttagctttacagtgattcagtctctggttaggaccattacgatttctttctttatttcccccttacttatgccctatatgaaatgaaacagatgtgagtgtttgaatcaaaaagacttccctgatgtagtggtctcattttagatgctcagagcatagaataagtggcagcagaccttacttgttccatctggtttttgcatagactgctcgagttgtttttcctttctcatttgttttcctcccttgcattttggtctgtctgctccccaaacttttagctatgaaacatctctagaattcgacatctgtcagaggaggcagcggaagttctttctctgggatccatgagtcctgactcccctgatactgtgtgctgagagagggttttgttttcataattatgacaattcccatgtattgaatgcttcctacatgccagatatttccagagctctgtgtccctggaagagtcaagaaccactgtttatagcattgagaaggaaagagtctagcctctgacatcttttcttctaaaatgactgcaacacatggacatatttttagctattttttccatgaaatgtattttctaatgacttaagacattagatcaatgggaaaagagagcgtttatgtttttatgaaggtaatattttcagtggcaaaatgagctttatcagacctcaggaacttgtgacttccagaaaacaagaatggttctgacctgggatcgtgagaatgtctttatcctagacatgccaatccacacttagccagtgtgaagggaagagtctgcacttagccagcatgaagggaagagtggcagagaggggactatctgagtcctgtcacggcctgtcaggagagtgacaggtgagggtgggcaggaggtctccgaatgaactgctttgctggtaggctgtgtttctgtgtttagctgaggagagggcgggagagagacccaggctgggaggtgggggtgcctgagcctcctgtgccatttggagcatgtcattatgggggagtcacttattttgcaggggggaggggggtcccaggcctaacatttgtaaaattagggaatatgctgggactaagggttcgttgtggcctgcagtctgtttctatttatttattcatactcataaacatagatctctaatataggccaagattttgaaagaattagtagttgcaatttcaccttgtaagactttctcttttaggtaccttatattagttttacttgttagttacccagatatgtcaagcatagagctaaactgaatgcctgtgtatttgctgtaagcattgcctgccttaattcatgctgtgatgtggtgtggtttgcggaattcctagagtggccagtgcaccatgaccaccaactgacactaggctccttctagcaaagaccagggaatgtggtgatgcctttagttggtttataaaggactagcacccatgagcaggaaagggcacgacactcattttggcactgtgaccgccctcctggtcacaacgcctggtctccacactggcagggctgttcttttacaaggagggacacagggtttgagacaggtccagttgtcgctcatcgagaactcgtgaagacagacaggggagcagtgaccctggaaatcagctgggagagtccattcatccacgtagtgagaccgtgtctctgttgcggttcttatgtccacccacattctgtgattcattgtgtgttcttattagtatattataatctattagagggtatttttctctaattttctgtcattttgtagttctgtgcaaaaggcatgaaattgtggattaaaatgagggcatctggatattgctagaaaacaccagctgaattcacaggctcgcaaagaggtcgtatgtttggaaagctttagccattgctgtggttttctattttctggaggtggggacaggataggaggtggaccctagtccctagagactatttccaaagtgtgtttcccagttgggatcaattattgtttgttgacttggtctcaggattgggctgcgttctaactcgagaattgccaggcctcagggaagtgtctgcttttcagggaagtccgcccatcatctgccactaacacaagtcagagggccacggccatcaccagtgctgcaagtgggaagggcagagtggacttacataaacaccgtggcattcctgcctgcagctccggagctccaccctcatcgccactatctctccttggacttgaaccacaggcagatgaggccccaggaattagttgcacctgagagtctggaagtatagcccaaccctccatgtgtggaaggacagggtccagacccctcccgtcctgcttctgcagtggctgaatggctggaggccgccatgacacccctcatacacattcactcactcaccattcactcccactctcctgcccctgcccctttccaggctcccaactctctctctcatgtgtaccttgaaggtttgctagatgatatcatagtagacgctaacgaaatcgttgttaaataaacaatagagtgacatgtatacaatcaataagaccaaaaaaggtgtttaaaaaaatcttttatttttattttttaagagacaggcctcactccgttgtacaggctggagtgcagtggcacaatcactgttcactgcagccttgaactcctaggctcaaattatcctcctcccttagcctcccaagtagctgtgactacagctaccgtgtctggctaattgtgaaattttttggtaaagacagggtcttgctatgttgcccaggctgatcttgaacctctgggctcaaccgatctgaagtgcaaagattacaggagtgagccactgtgcctggcccccaaaaaggattttaatgttaggagctgagttatctgagcagacacagtccactgtctggtcccaaggctccatgtagaattgtctgcttttagcacacaggcccacctgggctggcctgaggaggaaattcaggagtgggagatgccatcttttcctagccaggaggggctgcagagcgtgtgggctgagactcttggggagggggtgtgaggggcagtcacatggcctcatgtgaaattctccataaagaatcccaggcagaaggccatggacaggcaggctggtgcaccgcatgtgtgaagatgagcagcagggacaacgggtgggtggggggagggagtgggggagggagcgggaggactagagggagtgggaggactagggaaagtggaagagggagtggggggagagtggggaaagagtgggggagggagtggggacggagtggggggactgggggaagtgggagagggagtggagggagagtgggggagggagtggagggagagtgggggagggaggagggagggagtgggggagggagagtgggggagggagtaggggggtaatagggggacagtcgggggagagtcggggagggagtgggggaggaaataggggggtaatgggggaagagccgggggagagtcggggagggagtgggggagggagtggtggagggattgggggagggaatagcggggtaatggggggagagtcgggggagagtcggggagggagtgggggtgtcggaggatgtctgatatattcactccttcctttaatgatttcaaatgaagtgctttttttaaaaggcaggctcaccaatgaggtgcgggaagtccccgcagagagagagcccacgtagtaagtaaggaacgggggcggttagagattctggagaggccggatggaaaatgcacacacggtgagcagaaaccatgatcctgagacgctgatgtccaggagggagcctcagagcaggaacgcagccgcggcagggggcggtgggagtctgcggtatgacgtagggtacgaagggcctgggggtggcagagcagagcctgctgcggaggcacaggcttctcattccgcgcgagtgaccgagacatggatcgcgctcttgccggaggagggtgcacgtgcggaccagaggcttcccagcgccacggtgccaagttgtgggggtgctgagccaggagcttcagaagagcctcacaagcagggcacaagctgagaaaaatgacagctcacgacactctttcttcatatttaaaccagaggaccaaacaactcaaggtgctcttaagaaaagcccgcagtcgtccaagactttaaatgaaaacgcggatctgaaaatgggtgaaggaaatttgaggtacccacatttgccagaacatcgcgtccaccctgaagtaaggtgctacctgtggtggacacctttgtgacacttcgtctctaagtgagataggatttccagggagcgtgggactgtccctggattggtggctgctgaggaaggatttattttccatggagctctagttggctgtgagattttaggtcaacaactggctacagatgatagatggagagatagcccctgtacaatattcactgtggactattattatatagtgcatagtaataagacaatgtacaaaatgtgatagcgtacacttctttcgtatgtagaaaatgcagggatttttaaaaagtgagatttactttggtctgaagtcctcatcaggaggccaggcgtggtggctcaggcctgtaatcccagcactttgggaggcgaggtgggcagatcacttgaggtcaggagttcgagactagcctggccaacatggcaaaaccccatctctactataaatacaaaaatcagccgggcgtggtggtgggtgcctgtagtctcagctagtcgggaggctgaggcaggagaatcacttgaatgcaggaaatagagattgcagtgagccaagatggcaccactgcattccagctggggcgacagaacaagactctgtctcgaaataaataaatagcaataaaaaatgaagtcctcatcaggaaatgcagtaagcagatggttatgaactggattacgctgctgcagaccgtcttctaagaccatttgtgtatcagtggttggaggagtgtgtaggccaacctctctttgaactgttgtaaattcattcaggcagatgactaaaaatgacataacccccacccgtctcccaagggggcaggtgagaggtgggtatagcatttcaggtcagaatgggggttctcacaattcatcagtgttcgctccccaaatctggatttacagtctgaaatgttctttctttagcctctgaatgccagaagtaagcacttccttttaatttttatttttccctagcaaattctttagtgagcaagcttttgtctgatctaacctttctctcccctgttggtttcagcctccacctttgtcttgcctttccccccaccacttactcccacccccactgctgacatgttgtgagtcgtctcctggaagccacagccctgctggttttcactcagggtggtgggtcccttatgtgtgtcatgctttgcacaagacagcgaggagtgctggctggtttgctggcgcccagcactatgacctggcttccgttcatggctcataagtttccagtctttggggtatctgtggcttttatgtcatctcactgcctctcctcggcacagggactggctttgctgtcgatggcagacttaaggcaagtgcagaagggaagaggactgctcagaaacatctcctggagacactgtattttcaatgggtctctccaaatccagcagaaaaagggcaaaatgtagggaaggggtgccaacatgaagccatcatggtggtgccaaggatttattgggcagcaagaatcaaaggactggtgggaaagaagaaatcagagtcagcatgcaggagaaaagcagaacggagacagtgtggctggattgatagaatactggaaggcccaacagatagtcccacacccatgttcacagcacattagccacgattagccaaaagagggaagcaacaccagggcctgtcaccgtataaatggataaacgagatgtggtctctacatacaatagaatgttgtttcagccgtaaaaaggaatgaaattcggacacacgctacagcctggatgaaccttgaagacatgatgttaagtcgaatcagccacagtcacaaaagcgcaaatactgtgtgacgccacttaggtgaggcacctagagcagtgaaattcatagagacaaaccagacgaagtagagtggtggtttccaggggctggcgggagaatgggcagtgagtgtttagtgggtgcggagtttcagtttgggaagatgcagagcgttctggaggtgggcggtggtgacggttacacagtcatgtgaatgtacttaatgccatggaactgtacacttaaaaatgattaaaatggtaaatttatgttacatttttacacacacgtgtgtgtgcacatgcttgtaactctccattttttatcttttgatcctaaccttgaacctctccagagccttaacttaaatatctcctcaggccgggtgtggtggctcatacctgtaatcccagcacttcgggaggccgatgccagcggatcacttggggtcaggagtttgagaccagcctggccaacatgctgaaaccccatctctactaaaaatacaaaaattagccaggcatggtggtgggcgcctgtaatgccagctactcgggaggctgaggcacgagaattgcttgaacttgggaggcggaggttgcagtgagctgagatccgcaccactgcactccagcctgggcgacggagtgagactccgtgtcaaaaaaaaaaaaatctcctctacgagtggatgtcgggtgaggtgggctggggtgggcgatttatttggggcttagaaggaagcagaaaagttcagtcatcttctgttacccatacagcaaggtacaagaaacaatgtgtgtgggagcagcaatggcctctctctctttttatttttcagaggaagtggtggtaattccttttagtgtcttgcattctacatgcagctttaaaatctacactgacatgtttcaagcaatctcataggtggctactaacttaatttgtgttttgctcattcctaatgcgcaggaatgttatgaaaatgttcgttcctggtgttaactaactctgttcagtccttgtatcctggttgattaatggcaaggtaattgcccttcatttctttgccttcaaagcagtgccacctaggtctttactgccctcaaaacagatgtcttctgcaaagagtgaaattccgatcagtcagtccctcctcataaaacatgtaggtgagaggccacttggatgcacaggaaggttgcaaagccagctgccctgcaggagccttcagaagagtgacctccatctggggtcagaccccggctccctggagggtcagcagaggagaaggggcatcttctggagaggagtatgggtgcggggcagacaaaggaacagaaacagaaacaatcaagaatgaggagtgagcctgcagtgcaccttagagtgtgtgtctattttctgccaagggtgagatgttctgagcattttctctatgtctacctccgtcaagtactttccataactgctgtcatgtcagcctcctactaaccctgtacagtaggtatgactgccgttccattttcatagatgagaccgaagggtaaagagggtagataactggaccgagtctacacatgtattaggtgtcggagttgggatttgaacccaggtctcatgaccttaagttgggcgagaactggatgtaatctggagtggccagcatgttccgctggggctgtgatttcagttatctgtaagaaagcatgaggcagctaaaaccactgaggcccagcaccagtgcagcatctctgatttccttttgccctgcttgtgtctggggacttcagactgtctgtctgctctctggattctgtggtccaactggcacttctgtgctaaaaatgaaggcataattgaggcatcacggaccccagatgggccctgcagcctggggcaaggctcagctgacctcatggcacccgtctcagtctaatccagtcttggattgccacttcccctttttggctttgccttgtcctcccctggcctggcatcccaggctcctgcttgtggtttacctgtgtgacacacacagacacatatacgcactctagtgccaaacatgacagaccaggaggttggttttcttagcctgagaatctgcatcatctgaatgaggtagaatctggaggagtctggactgtgagggaggaagcttgggaaggagtcaggatgggatgtgctgcccatcaacgcctgcagggaaagaagagtcccacgcagggaaaggagagtcccacgcgggaaaaggagagtgccacgcggggaaaggagagtcccacgaggggaaaggagagtcccacgaggggaaaggggggtcccacgcggggaaagaagggtcccacgcggggaaagaagggtcccacgtggggaaagaagagtcccacgaggggaaaggagggtcccacgcagggagagtcccacgcagggaaaggagagtcccacgcagggaaaggaaggtcccacgcagggaaagaagagccccacgcggagaaggaggagtcccacgaagggaaaggagggtcccacgaagggaaaggagggtcccacgcagggaaagaagagtcccacgcggggagagccccatgcagggaaagagggtcccacgcagggaaaggagagtcccacgcagggaaaggagggtcccacgcagggaaaggagagtcccacgcagggagagtcccacgcagggaaaggagggtcccacgcagggaaaggagagtcccacgcagggaaaggagggtcccacgcagggaaaggagggtcccacgcagggaaagaagagtcccacgcagggagagtcccatgcagggaaagaaggtcccacgcagggaaaggagagtcccacgcagggattgctgttccactctgcatagccgctgggctttctgctgcacggatgccatctagaagaagcaccatccactgttctcagaaagaagagagaggaaggagacaggagtgcgtagagtgagtgggccatcagaaaaaggactgctctggggatgcaggagacccgcttgtaggatttaggggcaccgtgcaagacaggggtcatggtatgcgggtgcctccgactggcggctgcgtggtggatctggccacttggtgaaggtcgcagtgaccttgatctgctctggggagggatgctgttttgcctttcttcacgcacgtggaatcaggactagctggactggcaggaaaaggttctctctggaataatggtttgcttctctgcaggctcgtgcggcggctcgtgcggagccctgtgagcactcattcttgggagagcacctgaagccgcctccaggtttagtcatttcctgctttttcctatacataccttccgtatcaacatgctttttgaccttcctcacctgaatacatctgataccctatgaattcttacctttctttttccaaagtggccaggaactgaaaatgcaacttcattaaactggaaagactggctctttgctaattagtccatttgaaatgaaactaggctaggatttttggttcacctcccagatcacaggaatgtattgcctcattaacagttgaagaagcagttttaaatgatccaagaacaagctgaccacttggattcctgggtagtcggctgggcctcctgtctttctgcaggtttgtgacttacctttgcttccatgggaagaaaggaggcgggaaatgaggtacaaagagaaaattggagtgagtgggcattttggtttatcaagtagaagcaattctgtgtgtatgtttgggaggatgtggagagcatttagaagttttatttatttatttatttatttatttatttatttatttatctatttatttatttttgagaaagtcttgccctgtcacccaggctggagtacagtagtgtgatctcggctcactgcaacctctacctcctgggttcaagtgatcctcctgcttcagcctcccaagtagctgggattacaggcacccccaaccatacctggctaatttttgtattttaagtaggggtggcgggggtcgggggttcaccacattggccaggctggtctcgaactcctgacttcaagtgatccatccacctcggcctcccaaagtgctgggattacatgtgtgagccaccacgcctggccattcatttagcctggtgacctagaagtacttaggaaatgtgtgtgtgtgtgtgtgtgtgtgtgtgtgtgtgtgtgcacccgtgtatgagtatatgtgttttggttttccaatctttggttcacgaatgtagtccatattcttagaactgactcacatataggaattcaataaatatttattgaattaataaataaatgactatggtgtgtgtgtttataggtgcacacacaaacacacacacagagtaacatctcacccataagtcatttatcgagcaaccataagtatttaaaataaatgacaaattagaaagtccagaagaccatgcagtggctgcataaaggtgacaaagctcatgcttgtgtttctttaaaagaaacttatcacccttcgcagccaggtctcctttagatagcgtgcttggccgggagcagatcagaaatggcaaactaaagataaagacaatcacaaaggcaaaaccaacaaagcgacagctaacagcttgacaggaagagaggggacagaaagcagacacagagtctctaagcacagccgtctggtttggggcaaacaactttttgcactttaccgtgcctgtggaaactatgtcatgcggcatggaatgaaattaattaacattcgtagtagacgctgaatcatcaaaagcttgaattatatctcataactttgtaggaagatgaagttactctagcaagattccttcaaaatggtttacttgtttcttaaagagtacaggcttccattatgtacaccaggaggcagaaaactgtggtcagcagaccaaagccagcctgctgcttgtttttgtaaataaagttttattggaaacaaccatgctcattcatttacgtgtttctgatggcaacttcctccttcccctcagcagaactgagtagttgagacagaaaccatatggcctgcagagccaaaaatacttaatggttatttatagcagaagtttgccagtccccaatccagatgttgggttcctcttgaatgttggtttgtgcttatgtatacatctgattcacttgcacgcattaccaagtgatccatatacacgagtgtgaacacatacgcatttctgtgtggtagtaagcacaactaagtgtgagcaccacattctcagacatagctctagaagagagtttctaagaaattagctctgagtcttttctgcttcagtcagctgatggcatggagcagtatgttgtaacctctgacccgaagggcaaaggccttctggaggaagtgtacacccctcagaagcctccctgtacattcaccatccccaaaatagctccttgagtagaggtgcatcgatcacccccaaagcttacataagatcctagcagtcagaaggattcagtgattaggtatcccagactacatagggtcttgtgggatatttcattggtactagaagttgactgcaatggcaagaaaggtatgcttcatagggtagaattttgcttttagggttttttttttttttgagacgtaatctcgctctgtccaggttggagtgcagtagtgctatctcggctcactgccacctccgtgtcctgggttcaagtgattctcctgcctcagcctcctgagtagctaggattacaggcctgtgccaccacgcctggctaatttttttgtatttttagtagagacggggtttcaccatgttggtcaggctggtctcgagctccttacctcgtgatccacctgcctcagcctcccaaagtgctggaattacaggcatgagccaccgcacccggccttttaggctattcttgtggcctttgtcactgacttaatggataaagtttcttctgctaaggcggccatgttggtttattattctgtacggatgtggctgataccacattagtgtgagctttcactagtgctcactttgatagcctccttgcacagcctagctaatatatgtcactggactccattaattttatagtgtcagtagcccagaactcattaaggaagacaagtttctgagattgtagattcctatgggtaaaatatgtatattatcataaaataggtactaaaacgtgatttggatttgggatgtggaagtaagtgccattttattattgagatattcatataccataaaattgacgttttaaagtaatttttagtatagtcacaaaatcatgaatatatattttcaccttgttttaaatataagaagattggttcattttgaagaattctgtgtgacccatatcaaagtagctgttgcagttgtgtagagattcacacatgtatgctctgtcaagatttaccagttggcatgtgtgccataggatttactgagtgtggattatgacagtcctaggtcccttgattttattttatatacatatcaaattgctcttccccattgggccgtgttggagaacaccagggcccagggcccaagcctctagcctaccccaggcccaggggtttgaacaacctccctaccttctggaaacccatttccccccaatactggctggaaggtatgaggagtcgtctttcttactgtccttatcactacaggaaacagggaaagcataagaaaaatgacaaaatgttccagctgagctagagtctcattggagggtacaattgtctctgagtatcagtggaagagtgcctccaggactcctacagaaactaaaatccacaaatgctcaagtccctggtataaaatgtcatggtatttgcgtataacccaggtacgtcctccggtatatctgaaatgatgcctagattacctataatacctaatacaatataaatgctatataaatagttgttattctgtattgtttgaggaataatgacaaggaaaaaaactctgtacgtgttaagtacagacgcaaccatccttttttttttttctgaatacttttaatccatggttgtttgaatccataaatgtggaacccacggatacagatggctgagtatgtactaacatataaatagggctagccttgcttttctgcagcccctgtccctaacatcttattctaagtggccctgggcaaagtgaccattcatttattcactcattcatttgtaggccctactgagagcctacgatgtatacggcaccatgtaccaggccctgagaacacagaggtaagatagacagggtcctgctttcatcgggtttatattccaatgaagataagaggcattcaacaactctttatctaatgagttgtacagcaacccttgtgatatgtgcacttaaagaaatgtgcaggggttttggatagaaaggctcaatgtggagacagacttggtctggaggcggggcagcttctctgagggtgcgacgtttcagccacgatctaagggagggaacagggaaatgcactgcggtcatccaggtgagaaatgatggtggcctcagtgcccaaagtggggacgtcagtggatgcagacagtggatttgagacgtatttaggagatggaattgactagcatcattttattgacacttttcatttctacagtttgagtccatcctcccatcctcctttcccaatcccagtgcctcagatgttctcgtttttcccttggggtgagtctatactgaagccagatggtttcactcaaacccattcagtgctccagagtcaagtgctggtcatcgcaggggagctccggagctgcgtctgtaatgttagtgaccctgatttctaaagggaagtcttcttcagtctgtttctgagattattcctgggagctttaactggaaaagccaagggcttaaaaagatgcagtttttttttttttttttttttttttttttttttttgagacactgtcttgctttgtcacccaggctagcctgcagtggcacagtatggctcaccacagcctcaacctcccagattccagagatcctcccatttcagcctccagagtagctgtggctacaggcacacaccaccactctcagctaattttttaaaaatttttgtagagacaagatctcactaggttgcccgggctggtctcaaactcctgggctcaagtgatcctccccccttggcgtcccaaagtgctgggattccaggagtgagccactgggcccagcacggtgcagtcttcagagaaggtgaactctctgggcacctagagaaacttgtagggaaacaaaagcttgtttataaacttggttcaacacaggagactatgttctccacattgaaaagttccttcatcttttttaaagcatctaaatgatctgtgtctcacttcctaagcaggctggtgggcagggagggtcaccagttggggcagagctcagagggaggtgcacagctgtgcagtgtctaagctcctgcgtctcctgtcacttggttcccgtggcaccatctacgcccatctccctcccccttaagggttagcatgacattgtatcacagggatgttgattttcttttcacttcagttctggattttcaaattctcagaccacataccaagttgaaagcaatcctttgtttcctcttgaaccgtaaaccagaaattgtgcttgggaaaccataccaggtgactaactggaaaacatccccaaaccttgttagtctttggccgtagacatttaattctgagccctggatggatggtgatattaaatacagattgtgcgcacattagtagtagaatgtacccctgaccaatttttcacacatttaaccaagtaaatggcttcttgccttcagtgagtttttatttcaagaccagcaaccattgcaccaagatgaagaagtgagccgcgtggttttctccatccaggggtgcagaaagaaaagtgcagagacagtcttcagtgtttttatataaattcacttttgcaaaaagtatgttgctgtgtaattaagagtgttaatgatgctgcctaaagcatctagggagagcagtctggacaaggagagaatgggaccgtcacccaccggtggctcctccgtctatggcctctagtcattttgctccctacctttcttctgaagtcaattctggtttttgtttttgtttttgttttttccctatttttcccaaagacccggggctggaggcctgtaaagggaccatgctacaatttctgagcaatccagtctggtttaccagaattagaactcagtactgcagaaccctgggaggtgatgatgcaggtcaatgaggccttggcaagaagaaggggagggagggaggatggagacgtcaacctgacataggatttggagaagagtcagagattaagaatttagattaatgtgccaggcgccgtggctcatgcctgtaatcccaacactttgggaggctaaggtggcagatcgcctgaggtcaggagttcaagaccagcctggccaacatggtgaaaccccgtctctgctaaaaatacaaaaattagccgagtgtggtggtgggcgcctgtaattccagctacttgggaggctgaggcaggagaattgctttaagctgggaggcggagcttgcagtgagccgagatcacaccactgcactccagcctgggcaacagagcgagactccatctcaaaaaaaaaaaaaaagaatttagattagtgtttattttggaaagggagagccataaatatatatttcaggtgtctgtcttcactataagtttgtttatggttgaatttgataaatgacttcctttggtctgtggagtgtattagttatttgggtgtgatgtgttggaagaagatagttaatgcatttacaggaggatcatgtgagatttcagatcagggccacctcatgcctttaatacataaaaaccatttaaaacattaaaaagttccatgcaatcttttttttttttcctaccacaatttatgtctttatgaggaatatctccattctgcctctgctctgccagggtaattattatcctgtatacactcaggtctgtgttcaaatcagcataacgaaggctgctatgaaaatgaatatagaattttcataaagttcatgctaaattcttaaactttagcttttacatttttggcagtaggttataggtaggagtcatctttgtaattgacatttaaacgcaatttttcttctcataattgataacgacttcattcgtgccagccgcaaaacccagtgtattattcttgtcagtgcttgacggttttgacaggccagaaaaattgcaagtaaaatagatatatttgggcgtgagatgttgacttataattcatgaagctgcaaccttccacctgtaaaggagaagaattggcagaggtatggttttgatttatgtgttgaaagacagaaaacaaataagaaaacctttgttctgctgtcacaactgatgaaggtaacagtgttaaaaaataatgaaattcacaatacttcctacacatccagtcctctgtagctgcaattcgggggggccaagggcttccttagcagaatctctgggctttcttggggtgcaggtagggctctggccttgctatgctttaactagaactactgtgattttttttccttccttccctccttcctccctgcctcgctgcctccctccctccctcttttctttctttccttctcttttttcctttctttctctccctgtttctctgtctctccttccccctccctgtctccctccctatctctttctttccttttcttttttctctccctgtttctctgtctctcctcccttcctccctctctcctttctttatttttcttccatctcttaatttcattcattcattagccttctgtgtaagattttgtttggaaaaaaaagagtcatatccccctttaaaaacagttcatagaaatgtatcctctagtagtcccagctgctcgggaggctgaggcaggagagtggcgtgaacccggagggcggagcctgcagtgagccgagatcgcgccactgcactccagcctgggtgactgagctagactccgtctcaaaaaaaaaaaaaaaaaaaaaaaaaaaggaaatgtatcctgtacatgaatgtggataatgagctttcctggctggaaaagggcaatcactctggcttctgggatgaccctggagtccttctctgcttcagtaattgccacactcctgggctccgccacttctctattgcccagttcttctgctgggatgctggccttccgccaggcagccttaggttctgcttagacgcacagataatctttaccagtgtgtgagaagcctgaggatacagacagactgcataccgcggccatgtgttgtgtgagtggtatcaggctggacgtatcccttgacaacttgactttttagctcacagttacatttttcggactgatctacgttgattcgtggaaaaacaggtgataccgcttctttccttctatcccccggcttcagttgagttcattctataccccacccgatgcctccgcgtacacactgtagctaattctgcaggagatggagggttccatggtatcttcacacgtggagatggcactacattcgtattctgagctattccccagcagcaagggtaaattttcttctcttgcattctctcgctcagtcaaccttgtgaccattgactcatatttgaatgtcatgtttgggccataggcgcaagtgaggagatgctcacgctggttaccttgcaggtgttttctataatgaagagcccacaagccctcaccccacccctgccctacccgcagctggagtgaaggtggcgccccagaggccactcctgggagaaacctcatcccctccctccttctgcgacttcacagcctcacacacagttgtctgggaaacatcagatctaaccacctcgagccttgcgtctctgtttatgcctctcccaacaggaagctgagactcggaaaatcctcgtccccctccgcacctctctcctactcaccacgcctttccacgggaacacacagcacgttatcagcaaaattccccacaccctcagcgcctttcctgagaggtcctcgtgatggtgtggatctgtgtccctgcccacatctcatgttcagttgtgatcccagcgtgggaggtggggcctggtgggaggtggctggatctcgggggtggtttctcacgaatggctaagcaccgttccccttgctgctgttctcgtgatagtgagtgagttctcgtgagatctggttgtttacaagtgtgtggcgcctccttccttgctctttcttgctcctgctttcacggtgtaaactgcctgctcccactttgccttctgccgcgattggaagctgcctgaggcctccccagaagcagatgccaccatgcttcctggacagcctgtagaaccgtgcgccagtgaaacctctcttcttgtaaattccccagtctcaggtatttctttttctttctttctttctttttttttttttttgagacagagttttaccctgtttcccaggctgaagtgcagtggcatgatctcggctcactgcaacttctgccccctgggttcaagcgattctcctgcctcagcctcccgagtagccgggattacaggcacctgccaccacacctggctaatttttttttgtgtgtgtgtatttttagtagagtcagggtttcaccatcttggccaggctggtcttgaactcctgacctcgtgatccacctgcctcggcctcccaaagtgctgggataacaggcgtgagccaccgcacctggccctcaggtatttttttatagcaatgcaagaacagactaatacagtccctttaccttatcttcctaactgctccccgaagtcctctcaagccacatctgctttgtccccacaccctgaaccaccacgtttggtgctagcgcctcatcactgctccatgatcatccttccctcctcctggagacccctggctttgcatctctggccaccagatcattgttgcagtcatctattcatctctgatccatgccaccttgttccttgtggattgacgctcctggagtgctatcagtacaccaaccctacttgtcagacagtaacacctgtgatttcagtgttcttgtagacaatccttcggtactctggcttctcaggtccttaatctcctcttctccgatgaccttgttcttcactcaacctcagccccccatttccgtaactataccctagagcttattaccggttgtaaagactgataatgcagtcattatctgttatgctccagctccatcatctcatttcaagcatcccattctctgatcaccacctctttcttctctcctaaaaccttgactgaaaacaattcttccacctcactgaagtgcaaaatccatccatcctatcatcttttccccctttctcacctacctcatgtcttcatgtctctcattgtctagtttggagtccttgattatctaatcattaccttgctttactatcttataacattaacttctttacccatctctctcttcatcccactctccttgcaaaactacagccttggtaaaatccagttgcccatgtcctctgtacctgtctgtgcccagctgagcctgggtggaacagaacacagccgtggtgactgtttccagtttatgaccattaacttctagtgggctcgagcaccctctggcagagcgttctcctctttctgtatcatcatttcttctctcttgattgaatcactccttttagcatacaaaaatgctattataactcccaacttaaaaaataaatttctcttaacctcacacatctcattaactactgtcccctttcttttctttctttctttctttctttttttttagagacagggtcttacctgtcacccaggctggagcgtagtggcgtaaccacagctcactgtagccctgtagccttgaactcctgggctcaagtcatcctccttcatcagcctccaaagtagctggtattacaggtgcatgctaccatacccggctaatttttaaattttttttgagagatggggtcttgctacattttccaggctggtcttgaactcccgggctcaagcaatcctcctgtctccccctaaacggatagcaggcgtgagccactgcacttggcctgttccatttctttgattatctttgcagcaaatttatttttaaaatgcgtgtttatactctctgtttccagtttctcatctctatcctctcttgaacccactccatttatcttttagctgccaccactcaatcaaaagctcttatgaaggtcactgatgataatcaagactaaataacatttgtaatagataataattgtaatctgatcattataacacgttcattcattctacaaatatttgttgactggcacctactatgtgccagttactgttctaagtgttttacgtgtattcacttgcttaagccctaaggcgggtaccgttattttccccatgttatgggtgaggaaactgagaaacagagaggttgaagaatttaccttctatgccataagtggtataaaatggtcagttctcagtcctcattttacttgatctatctgcagcatttgcccgtagatcattccctccttcctggatgactttctttgccttgttttctgaacatcactttttgatttctcctttgagctcactacctattccttctcaataccttgtgctggtttcctctcatctgctctaaataaatcgtggaatgatcattcatcagacctttgctctgcctgcactgactccctatgccatccctcccaggcccgtaacttccaatgctatcagtatattattgatttgcaaaattgtatccctagcctggaccttgaccctgaacttgagactgttggtcttagtctgctcaggctgatataaaaaaacaccacagtctgggtggcttataaacgacagaaatgtatgtatttcttacagttctggagactgggaagtccaagaccaaggcaccagcaacttgagtgtctgaggagggccctcttgttcatagatggcacattattgtgttttcacacagtggagggggcgaggaagctctctgggtcccctttctaagagcactaatgtcattcctaatgactccaccctcatgacctgatcaccttccaaaggctttacctccagccatcatgttggggactaggtttcaatatatgaattctgtggggcaacaccacgttcagtttacagcggtctctctggcctcatgtccaaccatctcccctcctcattcatcccactccagccacgccggcctcttgctgttcccagttacgccaactcgcccccacccagtccttcatgtctgcctgctcccctgcctgggtcgcttccccacgatgcctgctgtggctcacagcctcactgccttccggtctctgctccagtgtccctgaatagagtccaactctgagcatgctgtggaaaagggcctcattccaatacacaaagtcccttttcccatgccctgccttactgttctccataggtcacatgtgacgtgacctgtgtgtgcttgtttactggttttgcttcagaagagacctccgtgagagcagggaccttggtttgttcatggctctatcgcacaactgggtataataggtgctcgataaatattctgttgaatgaatcaatgaagttgccacagggaaggcatagacatatgtctttcaaaactccatgtgcttggtctttttaaaagtaaatttctttgattgtaaatagattcacattgatacttgaataaaatcataaaggtatgtcttctttcctcttcctttaagttttaagacacttataaatgtacctgaaattgtaataaaagatcccagaggattttacagcatgttttccgttgatggtaatggatggaaataatttaaataataacattaacaggttgttttactacaggaccacaataattttaaaagacaaacttgaataatcctgttttaccacatccctaaacctatgaaacacacagtactcactcattaatgttgatttgtttaagagaaataaacttcaaaaaaaaaaaaaaaaaaaagccaacaaaactcactctgatattaactgcctcgggtttaaaggttttttcagaatgcctcagtaatactggcttaatgaattaggttctaagaaaaatggccaggcatagttaacaataaatcaggttatactatttgcagaaaaagcaactaaaactctccttgtaaataataatgtggaaagatctggtattaatcaagccactgtctacagctgagctctgttttcagcttctgaacacagtggagttaatattgagcatatctttgtttcaagtataatgaacacaattctgcagtcctttgagaacaggcttttgtgaaaaatcagtaaggaattgcacctaaaacccatttacaagatcatactcccaaaggctttgtcttagagcagtttttaaaatcttgttggtaacctcctgaccacatcattgggagtacaaaaaagtgcagagagtatatatatatatatttttttttcataaatacttgcacatcacatttcccctacggaaattcaaccagcggttccaaagactgctgggctggagttgtccgggttggtggacccgcctgagtctggggtagcttagcttgttcagaggtgtgcacagggctgaggaccttctgtgcgtagcagagtcattcatctggtcaatggccacatgaagacacagatcttgccatatcagattctccttctttctactggaggtctggtgactttacctgtgttagttcaggcacctctggataacttaaggactcaccaagcggcaggtccttatgtagctccacagaccaccatgaaacccttcgaccttttctgaagtctgccttacgtcttgggccactgaacattctgccagtcctgaagaacgtgttgattccagtctcatcccagtgcaaagtgtccttctcatctttgggctgctgtcccctgagcaggaatgccgtccccacagctgatctttgaccatgggtagactctggtctaccatatgacctgggaccatcaaagcccaggttaagctgcatcccaagtgtttttctagccagccatgccctgggggtactttccattttattggtcacggagcactcaggccctgctccaggatcccaggtatggtctctggggaaaactgaccacaggttgtgcaggaggaaccaccagacctgcccgagaggggacatctcttctctttggtctgctgctttgagacaattccaagatcgcagtgtatatatgtgtgaagtcttcatgggtaactatctccaaagcatttaatgattctctttccttggcttataagtaggctgataatggaagttcaaatgatgtgggactctgttggtttgtccttctggaaaatcccactcctcttcctggtcaccaaagcagtgaggggaggagggcaaggaattgactcctcacatgtattctaacaagcatggaacagagcacacaagacatggatcttactgtagaccggggaagacactgagccacttctggctttatctcttctgacctatgcattgggataaacttagctgagcgcgtttccctgtccgcatggagggtctggaaaatgagccggacattgagctgggcttcatactttcatctttgcctctctctagagccaaacaaaggcttacctgggtgggccctttttggtcctgtttttctgtcatcgctgttgatacgtgggccttgagctccctagttgcaaactgggaagtgcattgaatgagaagtgtgtggcttcttccctggctatgccttttcacgtgttaaacatagggaaaactcagctatgccttttcatgtcttaaacaaagagaaaactcagctatgccttttcccgtcttaaacatagggaaaactcagctatgccttttcacgtgttaaacatagggaaaactcagcatttgtaataacatgttatgtttatagagctcttcacaaagtgctttgatgtctgtgattccatttaatctttacatcagcagcaggggataagtgttatcccagtcttactgatgaggaaaccaaggctcaagaagattgaatgatttggccaaggctgtgacactagaaaaggcaaagcttggactaaaacccaggtcttcagaattcaggtccagagctctggccagtctgttgactccttcatcagctcccaagatgaagatgaggagctattttctgttttgagcctttgattacagcttgttttgtaatacaccataaaggttgagaccatgtttgtttctagcacttacaaaaagacctggcccaattagacacttaataagtgttttataaatgaatgaaattagtgagtgaagaggtaaatgaatggatatattgaatgaatagattaactaggcaaaaacctacctgtctgcatttatattggaaagcactacatgaaaaaatgagatttgaaagttttagaatgtggctgtgtgtgtgagagagatcgtccctcaatctttcatttcttctgattgtctatcagtagggaaggtccaagtcccacccatactgtgtttctcaaatattctcaaattgtattgaaacctgtaaccaaaaccaaagttaaaattgattttaaagtgtcttctaggtttttattctaccattcctacctccagttttttgtttgtttgtttgtttgtgttcctttttgagacagagtctcattccttcactcagactggagggcaatggtgcgatctcagctcactgcaacctccgcctcccaggctcaagcaattctcctgcctcagcctcctgagtagctgggattacaggcacccaccaccacacctggctaatttttgtattttcagtagagatgggttttcacaatgttggccaggttggtctcaaactcctaactgaaagtaatccatcaaccttggcctcgccaagtgctgagattataggcgtgaaccactgtgcctggcccacctacttccagtttaaagtcacctgggaaatacttggagtacagttttgtcattttaatccttttttggaccacaacaatcactttacgaacatttttttaactttttcagaatcgattcaaggaaaagtgatagaggcaggtggggacggggaggtgagttttcttcgcatttttgggaatctcaactcctgagcctgtcttactagtacgggttccccaaccccacgactagaactatcttagtggtttcttcctaaagagatgtacacgtgtgtgtgtgtgtgtgtgtggtgggcgtgggtgggtgtgtagagtagggaaaaggtgagaagtggctctcttgctatagacttttgctttttactcttttccactgagtctgctcatattattcatacgattatcacgttagaggttttggagttgtagtggctatcgttttaagtttcttgtagaattaatttatataagtagacaatgtatatgaattgattgattcaaatctgtatcttacaggatctgttaaagatagtcagaaggctgtcttttaaaatgtgaggacaaatcagtttaacagtatagcagagaagtacagctgtgctctgtcaaactctaggctcctgtgtgttggaatgactagaggcagcagggagaggggtcctggtttactcaccccctctccctctttcacatactagcttgggcttgttgtggttgaggtggtgtgggaacatctagaaggttcattcaaaaaagacagcctcagcctttgctcagacgctcaagatgttctgccggctctccctaccatgaaagttctctgagaagccagtaaagatggcagcctctaaagaggttagctttatttggtggaggggcggtaggggtggcacacaccgaggaagattcggatcgtggcacatccttgtggtcaggcccagaaatcctcattgccctgcagccacccaggtcatgattcatgaggtgggggtctaagctgagaatggctggccggttctctgacttcgtgggtgtgtaatagttggttgcaactgacttctcaagaatgacagttactgactggagctggcagagaggtgtggccaagttcctggagaaatgcttcctgctcctcccgccctccccaccaccatcctgctgtatttaaagctgctttggtgatgctttgctcatctcagtgaattttcagttcagaccttttcactaaggatcattatggaagaaagaggggtaagaagtgtggctgagtagcctaggattaattcatcagtccccaaataagcaaacacgatgtctcaggatggacggtgaaattctggacctcacaggtaggtcttggagttgttagttgtgaatgtagacccccaagttcagatgttgccaggattttacatcctctgcttaaggctgtgttgttatttctgatgtttatgagtgaaaacaaaaacatacagctcaggtccttatcctctgagggtctcctcagcctggggcacctcccgccaaacgcttcatgactcccccaccaagcacatcctggcacaatctggcatgaggtctgagctacataaatgtggttttatgagggaacaaagcaagttttggttttctttagaattgtacgaaattataccttcaagatgactttgccttatcgtggcttttgttttgcttctccgagaaggaaactacaaagttaccatgatgtaaatccggccagaggcttgaagtgatttcatagtaaaagccacctcagccgtcccctctgaaacccaggccaagaggcagagatgccaatgacaggctctgtgaccagcctcgtaagccatgaaccagatccacggtttcacatggccaggacctcagggccgcatcagcctcttccaccacactctctcgtgaacagctggtgacactgtcagcggcgcctctgtcacaaggaagggcaatgtcctgtgtagccagatggcgggggagttggaggctgggccaggcggtcaggatctgcattccaccagcccgtggggttttcatagccaggggcactgtgtccaccttgggcgtggccatacacagccaccacttctaaccccattgccagctacaacggaagagagcatgctgtttagagttcagtacctccacataagggaaactgaggtagaggagagccggcattagcttctgggcttagaacacccaccttgccctcctgcatcgagattcatctccagtgagagcaggtgagaaggaatcagaggagagcacctaggcccgggtgtcaaccttgaccccacggacatctaggactggatgatttttattttattttatttatttatttatttttgagacggagtctcgctctgtcacccaggctagagtgcactggcgcgatctcggctcgctgcaacctatgcctttcaggttcaagcgatcctcctgcctcagcctcctgagtggctggggctacaggcacccaccaccacacctggctaattttttgtattttgtttagtagagacagggtctcaccatgttggccaggctggtctcgaactcctgacctcaggtggtccgcccatctcggcctcccaaagtgctgggattacaggcgtgagccactgcgcccggccagtgattcttttttcaggtgctgggatgcggggtgctgctctgtacagtgtatgatgtctagctgcatccctggcctctactcactagacgtcagtagccctctcccagttatgacaaccaaaaatgtctccagatatttcctaatgtcccctgagcatcaaaatcaccatctccagcctgggcaacatggcgaaactccatctctacaaaaaatacaaaaatgagccaggcatggtggtgtgcagctgtagtcccagctatttggaagcctgaggtgggaggaccatttgagcccaggagagtgaggctgcagtgagctgtgatcacgccactgcatttcagcctgggcaacacagtgagaccctgtctcaaaaaaaaaaaaaaaaagaagaagaagaagaaagaatttaaaaaacttaccagcggtcaagaaccattggagtagagagagaatttggtgaaaagacatctgcattctacctttagtctctgggctatgtctccggggctatttatcattgtcttgaattattttgtataataagcagcagcccccacgctcaggtgtttggaggagttgcaattcactgggtggagggtagagcgtctcatgaaatcctcggctcctgtctgaaggccacagctggggtgaggcccttgaatgggagaggcagatgtccctgtctacttcttccttctccctgcctcctcttggccttccttcccatcccctcctctgtgacagcacaccacaccgtcacctgggtgctcgtcagcacgcagattccagagcccggctccccagagattctgatacagggggtctgagaggggacctggaaacctgcctcactgtgagcttcccaagtgactctgcgcagggggcgtggtgaggtcacactttgagaaacaggccctagaggcttttctgaacacacgagccctcccagtactcccaggacactaaagtgtagcagaaacaagcaaaaaaacacaactatactagcaaacgtgacaaaagcaaaaagggataaaaattcctaagaaaggccaggcacagtggctcatgcctgtattcccagcactttgggaggctgaggtgggtggatcacctgaggtcaggagttcgagagcagcctggccaacatggtgaaactccgtctctactaaaagtacaaaaattagctgggcgtggtggcgggcgcctgtgatcccaaggtactggggaggctgaggcaggagaattgcttgaacctaggaggcagaggttgcagtgagccgagattgcaccattgtactccagcctgggtgagagagtgagactctgtctcaaaagaaaaaaaaaattaaaaaattcctaagaaagatgaagctattcaatgtgggaacctctctcactgaaaatggattcatcgagtcattgattgattcgacacatggcttctgtgtgcctacttgacttcaggcattattctaggcatgacgcattccgcagtgaacaacacagacaaatgtgcctgctgtcacctagtttatattttgcagggggagacagacaatgaacggaatgtagttagaaggtggccatgctgtagagagaattaaagcagagaaaggtggttagggagtgttggggctagtttgcagtatcactagatgatccaggaaggcctcgttgaaaaggtgatccttgagaccttgaaggcggtaagagatggccaggcagatatctgcaggtgagagttttctgggcaggaggaacagcaagtacaatgtcactgagctgggagtggacattcctggtgtgttcaaggaacagccagaaggctttcatggctggttcaggctgagtcagggaacaagtgtaggagctgagggcagagagggaccaggaggccgagtcctgcagagcccatggcagggacattgactttgactctgaaggaagtggggcgggggccaggggaggattttaagccgaggactggcaggatcagatttaagattgaaaaggatcaccttgtctgttttcttgagagtggactccaggtgggtaagagtagaagttatcattactattcaaattatggcacggtttctgccccctaggaattcactgtgatggtggagatagaacatgtacagcttaagtaaggaaatgtttgctaagtgctatgaatgacttagagaagtgctgtgtgagtcagtgaagggagacatcccttctgggagtcagacttcgcggaagagcggggccttaggatgaatgaacaagactttggtttttttagtgtgatacataattcaccatgcacatccagtgaatggtacacatttaaagcgtacactttgatatttttggacatatgtatccacccatgacgctatccccacaattataatactgcacatatccatgacccccaaaagttttctcatggttgatgagggagagagggagttatcatcagggcaggaaccaaagtgaaggtgcagaggctgggaaatgtaggggcttccatgagacagagggaggctggtgctggtgctcctgggggaagtgagggacgtgtgacaaggtggcctgaagaaaattgtgtggggcccaaaacactgggtcacaggggaatggggcaagtacttaaatttttgtaggacatggtcaaatgatgtatttgttaaaattccatcttttttcttttttgtgttgagacatggtctcgctctgctgcccagattagatggcagtggcgtcatcatagctcactgcatcctcagcctcctgggctcaagggatcctcccacctcagcctcctgagtagctgggactaaaggcatgcaccaccgcacctggctaatttttgtattttttgtagttgggatttcaccatgttgcccaggctggtctcgaacttcagatctgcccacctcagtttcccaaagtgtggggattacaggcgtgagccaccataccctgccaaaattttaccttttaaaaacaatggcaacaccaccaaattttaggtatttaatctttttgtagtaagtttaagaaaacacagccaagggcggatcatgaggtcaggaaatcgagaccatcctggctagcagagtgaaaccctgtctctaataaaaatacaaaatattagccaggcgtggtgatgggtgcctgtagtcccagctactcgggaggctgaggcaggagaatggtgtgaacctgggaggccgagcttgcagtgagccgagatcgcgccactgtactccagcctgggctacagagtgagactccgtctcaaaacaaaacaaaacaaaacaaaacagccaagtacatttatgcagcatttcatgaatatgaagtcaattaaaagaaaaagaaacattaagcaattttataattagataattaacagaatccttgatagccttatactaatacaactacttgcagattgaaaataattccatttgctgcctgctggcacattaaagcctacatgtaaaaaatacatcaagtctagatgggcttcagtcatttgaaagtaatattttagtgcattctagtataatcttgattagtgcttacatgcgtatagttcagcactttattttgtgtcatgttgaacatgaactttaaagttaagggaaacattttaagtacgtagtaggaatctactttcccatcttaagctctgaatctatttgtgaagggatcctatttcccaacagccaagggatatactggagaacaagattttcagggttgaagatacgctgatgtgaaatcaggtttctctctctttttttttttcttgagatggagtcacgctctgttgctcaggctggagtgcagtggcgcagtctcggctcactgcagcctccgcctcctgtgttccagtgattctcctgcctcagcctcccgggtagctgggattacaggcacgcaccaccacacctggttaatttttgtatttttagtagagacggggtttcactatgttggccaggctggtctcgaactcctgacctcaagtgatcctcctgcctcggcctcccaaagggctagggttgcaagagtgagccaccgcgtccaggccaggtttctctttctacatcttctgggaaaaggttggcagctcctaggagatactgaccagttagttgatgggtctgtgattcaaatcgaacatctagcaaagcccctacgaagcattagtcactcttgtgggagaaatgaggaagcgttttcagtaggctgttagagtgagaagcatcagattcttagttccatggaaatgaacgcctcttggagtgtttcatcttttaaaatagagaaggaagctgagagtcattcaggccatgctcagagatgtcagctcaggaactccaggaacccagtattattttgattccttccttccttccttcattccttccctccttccctcctttccttacttccctccctcccttccctccttccctcccttccttccttccttccgatatgggttttcctcatgttgtccaggctggtcttgaactgctggctcaactgatccacctgccttgctttgggctcccatagtgctgggattacaggtgtaagccaatgggcccagcctattgtgatttctttctttctttctttcttttttttttttttctgagacagggtctcactctgtcacccgggctggagtgcagtggtgagatctgagctcactgcaacctctgcctcccaggttcaagtgattctcgtgcctcagcctcctgagtagctgggattacaggcacctaccaccatgcccggctaatttttttatttttaggagagatggggtttctccacgttggccaggatggtctcaaactcttgacctcaagtgatccacccaccttgacctcccaaagttctgggattacaggtgtgagccactgcacccgggctgatttaagagggctttgacttgaccagatgtggtggttaagtgaatatgatatgttcccttctttatcatcctctctgttcttaattgcaaaagcgccaaatcctcctagataaaagacagccctaagatcattgtcaccatcctccttatcctcatcccaacattatatgaagttctaaatttatacaagttactgtattagatactgagactagttacattgataataattactaccatttatttaagggtgataataattactaccacttattcagcatttaccaagggccaggtctgtgctaaaaatgttgcacatattatcacatttaattcttacttaactcaataaaataagtatgattattgactcccatttttacattaaggagactgaagcttagagagatttgtgaaaaatggctcctggtcactcagctactaagtaatagaagcaggacttgaacctcccatacccttaaccaaaagttttcaaaatagtcaacactgtccataccatctagttggaaaagatgagacctggacataaaaactggccaggcagagtggctcacgcctgtaatcccagaactttgggaggctgaggtgggcagatcacctgaggtcaggagttcaagaccagcctggccaacatagtaaaactccatcggtactaaaaatacaaaaaaattagccgggtgtggcggtgaacgcctgtagtcccatccacttgggaggctgaggcaagagaattgcttgatgcagtgagccaaaatcacaccactgcactccagcctgggcaagagagaaagactctgtctcaaaaataaataaataaaagcattttcaggggttgtgacgagaaatgcctcacccattcttttgagtcatttatgaactgttcttaatcatgttacgttctaattaaacatctcccttttcttttgacgtggaaaagtctttaccttctgcaatacctttttcacatgttgcagcaagcagccctattaatcgcattcccacctgcctttggccctcccagctgcctcgcttgcagaacacgatcgttcaaacggaagtcattcatgggatcgcctctccctgcagtaatccagagcagaatcacttaggctgagcacagctgctacatcccagggtaatttggtttcttatgtagaaaaactgcggtctgacatttaacatttcctcctctggagagtgtttttttctttttttgtctctgtgaacttattacccagcatgtcttcacgcctttacattcagcgtgttcacgtgctcagcgcggtgttcatgcccgcaccattgtgtgatcaccatcactgggtgaagggctgtgggcttacaaagcagactgggaatcacaatgacaaaccttgggttcagactccgggtaggacagaaggaagtttctacctgagtttcatgctaatcaagtaggggtgcaggcgatcaagcaggggtgcaggggtgcacctgcgatctcagggcatggcctcgttgctgtcactactgcggttgttattttggctgtctcaggcctcacctggagcaaaccctaattctaacacactctgtgttctttcagatatcactcccctcttcttttcccgtctttccagaatgcgctgtgcttgtgtcctctttgccaatcagagtgagccgcttggggactttagtccatgcacatgtcgtgtcagtgcagatgatagaaccttgagggtggtgacttccccacccggagccatgggtcgtgattcctttgtcaggcgttctgattggttcctggcttccctctgcggtggtcgtataccttgtgtgtggttctgggagctcatgaacaacaggaatcaaggacactgacctttcgccatcagcaaactcctgctgtgtagattcaggggcgaagagagtctcgcggtgagaaatactctgggtgagaatgaccctctgtgtctccttggtccttcacaccccatcaagcacaggcggatcaggagatgtaaaggtcagggagctggtaagcatcgacgaacaaaatcttcctgaggaagggccgggtgcggtggctcatgccggtaatcccagcacgttgggaggccaaggtgggcagatcacgaggtcaagagatcaagaccatcctggccaagatggtgaaaccccgtctctactaaaaaaaaaaaaaaaaaaaaaaaattagccgggtgtggttgtgggcgcctgtagtcccagctactcaggaggctgaggcaggagaatcacttgaaccagggaggcggaggttgcagtgagccgagatcgcaccactgcgctccagtcttgcgacagagcaagactccatctcaaaaaaaaaaaaaaattttcctgaggaagaagtagcatccccgagctggcatgttgggagtatccttcaatttcagatgcttaaattctcctctctgacaatggctaattaagatttggccacattatctttatttctcttcttttgaaattagtgaggggacctgaccttgggtgatccgcccacctcagcctcccaaagtgctgggattacaggcgtgagccacggtgctccaccacctacgtgtcttcttgtattcctcttcatgggagaagtagggaaaaaatgatttggtatatattcctgaaagataagagtgttctaagtatcgaatccttacacttaaaactttaggttgaaaatgttgcccaagtgccaataaaaattgggaccttaaacatagaagttcaccttgtgggtgggcccatcgctgctcccgtgagactatctctgatccaggatggatcagagctaggtgatacagatgtctctgaagcccacgagctaggcagcacgacagactggatgcttcttttggtgccagctgatccagaggacatggccctagtccatctcctagggccactgccattctttttgtgtccatatcaggaaagcatggtataattcgaggcatctatggctctgaagacttcttttctctctctctctctttttgagacggagtctcgctctgttgtccaggctggagtgcagtggtgtgatctcagctcactgcaacctctgcctcccaggctcaagagattctcttgcctcagtctcctgagtagctgggattagaggcatgcaccaccaacccagctaatttttgcatttttagtagaaacagggtttcaccatgttgggcaggctggtctcggactcctgacctcaggtaatccacccacctcagcctcccaaagtgctggggttacaggcatgagccatcacgcccggcctccttttctcttttcttcctatttatgactaccctcccttaaagcagtatcttctttatttcagcacttacagaaagctatggctgttgaccattcctttttgaagttgtgagttgtactaaaatatttatgtataatgtgtggataagcacttgatttactgaggccttttgatgataagaactcacaaagggttttagatcaagggtggcttcattgaagaaacacctctgacatcagccagcaaccgcattttcattaaagactctcaatctcagcctttccctggacgagagaggaatgggttgttggctacttcctggctgtctgtggcggtcgtattgatgttgggcccagctgtgctgaatggctctgttggtgctcgctgggcttgctttggctggcacagctgtgagtggaggacagctgtgaggagcgggagttggtgctgattgatgtcttgtgaaccccggcggagcactgagctccatgtatgtacggattggtcctgtgagtcactacagactgggctagaggtggcagcagaggcatgtggcgttaggtagtacaggaaccaagaaggccctctggactgtgaactctcagagaacgggtgttgttctcatgcaccctcagacccccagcctggggcaacactgggcgtgcaggaaaccaaagtctccgcttgttaaatgtcagcagctgagccacaaatggcaataagctgaataaagaaggtggtgcttcaagggagaggagtaaaaacaaggaagaaaagagaagaggggccctcagagccagggatggctcatgcggtttctggagagtggttgtgtccctaggtcagagtcaaatccagactccaagggctagcgttggaaataaactgtgatgtgcagacatgacttctcaccctctctctctctctttttttttttttttttttttttgagatggagtcttgctctgttgccaggctggagtgcagtggtgtgatcttggctcacctctgcctcccgtgttcaagtcattctcctgcctcagcctgctgaattgctgggactacaggcgcccgccaccacgcccagctaatttttttgtattttagtacagatggtgtttcaccatgttggccaggatggtctcgatctcctgaccttgtgatccgcctgcctcggcctcccaaagtgctgggattacaggcatgagccaccgcgcccggctgaaatgacttctcttagagctgcctcctttctgtggcacctcttccatatgattgggttagtaaaaatattctaaataagcaattgatttgaggctttttgaagccaaacagtttggtgccttgagagcataagccattgcttatgtgaaaaaaaacaagaaactgtatctttgcatatactggggcccaaataaatcccgtttgaatgaatgaacatttcctagtgaaaacatggggctggaacccttctgtgtccgtgggaaaataggaatctattgatggatatggctctttggcttaaagtgaaaaatcatgaactggtggtcaagaaatctaggcatagtccacgcttttaaccctctgggacctgtttttctgtaaactgaggtgacgctctgttctggaacagcccctaaggggccgtttcaggtcctgctacacgctctgagttgtgattagagactctctggccctgtcatcgaggaggacgcctcgagacaggcctcatatggtttgcatcacttcctcaaccagactcgctcaacctgaacctcccattgcttcccatcattgtgtctggctgtcttgagtgtctccctcctgagccaccccttgctgctgcagtgtaaagaggcctcttgatttattaatcaattaatcagtgcgtgctgaggagctgttcggggtagttaaacagggaaaacaaacagctggagcctgcaatcaagatggatcctaattaagaaccaccccccaaatgctgatcttcctgccccgtcactgcctcacaactcccccccaccagcctacagctcagcaaaccgccttcagctctgatggggcttctaccccatgcaagctgacagtgaatttccgaagggcagattttctccctaatgtcctagaggtaaataagccttgagatgagcgttatcaattacctgcaacgactgttgagcccccaaatggcgtagtagccctgttcatataggcacagcccacactctcctatcccagttcccccacgaacggagtcatggagctggaaggtccttacgataaggagaggccatggcgctgtggacagacgagaggttcagtgaggttcagtgagttgtctgaggtcactgcagaactccaaggtcacaagtggcagaactggaaactatctgatactcaacgaacactcctggtgcttgtttctctgtgtaatcctaaagcaaagtaaataagagacattgttctcactgaatccattaaatgcttctgttccagtggtacttagcacacaatgctgagaaggccaagattttcttagaacagaacctctgttcgaggttgcaagttgcacctccatctgcaactaactttctgtggtaacagggggccaagggacctcagtgcagtggtccagaattgcactcaccccatatcatgcctggacaaatgtttgttccttctgattgaacaccttgggagagcccagggatggctataattcttcagtggatgtaagaataagaatgttcttgccaggcatggtggctcacgcctgtaatcccagcactttgggaggccgaggcgggtggatcacgaggtcaggagattgagaccatcctgtctaacacagtgaaaccccatctctactaaaagtacaaaaaattagctgggcgtggtggtgggcgcctgtagtcccagctatttgggaggctgaggcaggagaatcacttgaatccagaggtggaggttgcagtgagccgagatcgtgccattgcgctccagcctgggtgacaaggcgagactccatctcaaaaaaaaaaagaaaaaaaaaaatattcttgaccagcctggcgaagaagatacttagaagtcttatttatttttttaacttctttttgaaagttttcactataaaattcttacatttgtctaatgtgtttatcaaaaatagaggcttttctgccagtgtgtcttctcatttctgtggaatgccaatcaaactatccaactctttgagtacgtctcgggtttgactggtaagccaggtatctgacttgcactagcagccttggagttatagaatctcctctccctctgcttctgtgttctgtaggaccctgctttctcggctgtgattcacgacaaactccaggtccccaacaccatccggaaggcatggaacgaccgggacaaccgctgtgacatttgcgccactcacctgaaccagttgaagcaggaggccatccagatggtgctgacgttggagcaggcagccggcagtgagcactacgacgcctcgccctgctccccgccaccgctctccaacatccccaccctggtggggtcccggcacgtgggtgggctccagcagcccagagactgggcctttgtgcccgccccctgtgccacctccaactacacaggcttcgccaacaagcacggcagcaaacccagcagccttggggtcagcaatggggcggaaaagaagagcgggtccccaacccaccaggccaaggtcagcctccagatggccaccagtccaagcaatgggaacatcctcaattcggtggccatccaggctcaccagtacctggatggcacctggtccctgtcgagaaccaacggggtcaccctgtacccataccaggtaagtagcctgtgtgagccaggaagagcagggctggctggagtcaaagcggagaagtaggcagcacttccttccgctgcctcctcccgggaaccctgtaactcagagcccagtgtttccatgtggcccccacagagttctcatcaaggtgccccacccgggcctgcctgctttgagagggtgttgctacatcttccaaactttccacacctgccctttctctgctcttcagtgtctccttcctgagagaccctctttgtgtaagaggtccttgctggtccaggtgatgccagcgacttcccagccagcagatttaccacatggcagagccatgaagaggtaggccacacagatacttggactggggtccaagccccgacttgtccacttattagcagcgtgacttggcacaaggggtttgccctgtcttaggctcaagtccctcatttataaatggatgtgagtcacgagaattaaataaggtagtgtttgcatgacatgtaggccaacacctgccatatagtaggggatcattgttgtgcctgttaacagagattttagatattaagtgagagtgagatgagtgagatgcttttgaaccaaaggatattgtgagtcccaggaatcacggttttaaagcagcctgtggaagtgctggacattgctgagaataaaatatacgaaggaacagtgatccgtgttggcactctgccttccctgtctataccttccaaaagaggtgtagatgcccttcttaacctctcctcccttgacagacccaaattcttttctatttgcaactcaccttaagaactactgggattgggctgccaaaactgtttcttccttttcagttatttaaattagaacatgcccccaagtttctccatagaaataaaacacaggtcttaaatctcccagggaatctttaaagatgttctaattttgcccgggtgagttttctgttggatgaggactggatttttaatgtaagtggcctccatatcccctgcatcaggggtgtgggaagcagcagagagcattgaccgtcactggaatggagaggcggccacggtcaagggtgtattactcagagaagatagttggtacatacagcaaatgatcctggagacctcaggctttttctcacttgggtctgtcatggtgggtgtttggtaggtggccttctgctgcgatgtgaggactcagactagagacctcaggttatttctcacttgggtctgtcatagggggtgtttggtaggtggccttccgctgtgatgtgaggactcagacttcttccaccaaatgcgtcaccatcttccaggggcctcaagagtccttcaccagaccttctgtaaccagccaggaaatgagggaagatagagtgtgtggaggatctcacaggaggatttggggcccagctttgcatggaagtgatgtatgttgcttacatctatattccagtgacaagaatccagtctttgctgggcgtggtggctcacacttgtaatcccagcactgtgggaggccgaggtgggtggattgcttgagtacaggagttgaagaccagcctgggcatcctggcgaaaacccgtctctattaaaaaaaatacaaaaattagccaagtatggtggcatgcgcctgtagtgtcagctacttgggaggctgaaacgggaagatcgcctgagcccaggaggcggaggctgcagtgagccgagattgcaccactgcactccagcagcactgcactccagcctggtgacagagcaagactctgaattgggaaaaaagaagagtgagagagagagagagagagagagagagagacagacagacagacagacagtttagtctcttgatctcaccttcccactggtgaagctggggaagccaatctacccgtgagcccaggagaaaaaggaacaagtcgagtgaacacatagcatagttttgttacgccggacaagatacagggaaacgtggagtgagttaaatgtggttgataaaatgccgggtgactttctctagagcgtttgagagtgttcatgtctcttgctatcttgaaagaaagtgggaaacgttgatcattatcctaagatattagcattcttggacggtcgaaattttcacttaactgggtgctttctaatttacaaaatctaacatatggattatttcctttaaccccacagtaggcctatgaggtaggtggggcaggtgttagatcttccttttacagttaaggaatatgatgcttagagaaatggactgattgtggccacacagccagtggcagaaccagcaccagctctccccttgcccagggaatggctttgcctaccgcggtttcttccaactttcctaggctaccccaaagtaagctgccgacatcttttccagatatggttccttttcagacctggtgtcacaaagaaaagaactcgttttacctgcaggggcctcactgcccctagacttttggatagaatcttctgggatgtgtatataaatataatgaggaaccagtggcgtcctgtgcagtgcttcacattctaaccttggaagtaaccttctagggcaggaacagagaagggcttctttgcatcatgggataatttgcttttttttgtttgcagttttaaaatataccatttagaaaattatcaaaagtaacatatttgttgtaaaataaaatttaaaatacatgaggaagtttaaatgagactttaaaagtcgatgtcacccggatataaactatgtaacatttggggatacttcctcctagcatttcatacactcgcaatttgtaaaattgtgaccaggttcaattctgtgacctgcagttcacttaatacattgggtacatttccccatgccactatatgtttccctaaaatattatctttagcagtaacatatttcattatatgaatattttccacgctatggagatgtcctcatttattaggttggtgcaaaagtcattgcggtttttgtcattactttcaatggcaaaaaccgcaatgacttttgcacccacctaatatataaccaaacatcaattaattagaatttaggtctttgctactataaatacaatgctcaggtgaacatccttttacccaggccatagtttcaacacatgcctggcttgtgtgagccacatacttgtgttacacagacaactcacatttcaccttccaggactccgaagctcttgtcacacgtggcaggggccggttagaagactcggcggctgcgccagcgctgatgagcgaggacagaggagcatgaaactggtgctttcctgtaaaatattcaaagtgaggtgaaagtttgtgtgtaagtcggaaacactgaagatgctgcttaaacggccgattagggattatttgtgcgtttcttttatttgtgcaatgattctgttcttcctcttacttcccaaactcagatgaaagagaatttactgtacaagtatttattaatctctaaccaagtaccaggcactgtgctaggtggtgggtggggccgcagccttgggctggaaaccctggttcctgtcctgaggtccttgcagtgggacagaaggcaggtgagtgcagaggtgaagagatgccgcggtgctttgggggcatgcagacaggctcctaatcccgcccgatgtggcaaagccagatacaaccaagattcacacaagccaccaacttgtggtcatcctgggtatgttctgttgcttctttccaactccagaacagaccaattcatgcatttcccctcagtaatgaagggaccagaggaaatctctctgggataaagagatttggtgcctggctatgaatctgcgtcccctgtgttgtgactgtgtcgtcctgatgccctggggtgggggctctgggtctggccagactgagtgtctcctgttgcggacatctccctgcagtacatattgtacagttcgcagtctagccagctcgtcagagacggttgactgctctgaaagctgacctcatttttcctgcttacccatactcccacttccctccccacagagcagatggcctctggatcagtgccagagccattccccgggcagagaagcatctagaccttgtcactaccaagggtgcggctccacacccgcgggacccgagcctctagaaatgagggagaagacgactctgcctttctgcaatttagacgtcgcaaggatgaaaacgatgcggacaggctttccagcagtgagcctggggaaatctgcgtcacatgggcgacagaaggtccctcgaatccctcaatccccgtggcccgcaccactgtgtaataatctccaaaggttgcagtaggaagattcttgattctcgtttgctatatccttcacatttctaaagtacctccagaaagaccaggaacctgtaagcatcacagataaataggaatcgatccagagagattttaaaaagagtaatttaggaagtactaagatgacatcaaaaatgttgaacaaaccacaaagataattctcattaaatatcttagaaaattgatttaataggagattataagacgggctttcaaagaaagactttcttctgttcatctgcagacatttagcacaatctatacacacacagagaaagcagaaaattctctagcgcaggggtccccagaccccaggccacagattgataccactctgtggcctgttaaggagccagccgcagagcaggaggtgactggcgggtgggtgggcattacctcctgagctccatcccctgtcagagcagcagtgccattaggttctcctaggagcagaaaccctactgtgaactgtgcatgtgagggatctaggttgcatgctccttatgagaatctaatgcctgatgatctgaggtggagcagtttcatcccatctccgcgccctatttgtctgccatgaagctggtccctggtgccaaaaaggttgggaatcactgctctagaatcttcatcttttttcttccaacttttatttctggtttgggggtacacgtgcaggtttgttatgtgggtaaattgtgtgtcactggggtttgatgtacaaatgattttgtcacccaggtagtgagcatagtacccaaaaggtggttttccgatcctcaccctcctcccaccctccacccccaagtaggcccagtgtctattgttcctcgtctttgtagccatgtgttacagccttcatttgaccacatgaaattgtgactttgaaaggatgtgtctagattagttccttgtaatcaactacagattagttacctctttttgaatggcagctgcttttgcctgattaacatttattatagtcaataactgcaggaaagactgtacacataacacacggagttataggatgttggtgatgttggtgttggaatgcacctgtgtaggatggtaactgtcttttgcatcatggtaggagatttggagacagagtcttacctagttcaagcctgtggtcccaccaactattaaaccagtttagtagcttgacatcttagtctatttcctcacctatgaaattcctacctcatggggtgattatagggaacaattaagaagaaggcgtgaaaatattttatgaactataaagcaggaataccggtataaattatctatttcaaccttttcatttaccagaggagaaacctgaggctgagagatttgaagcttcttttgttcagagttttctaaatcctagtttgatctcttttgctaaatcacacactcttggacaacagggactcattttattctcacatccctcacagcagctaacgtgaaaatgttgttctttattagagacagctcctatctcagggatgcactacaattactttccatgactggccctagtttaggaaagaattccaggccaaagacctatctagaacccaaggatttaggtggaaaccaccaggtatttgattccaagctaatctttaacctgaagtgtcttaatcatacttaataaatccttagatgcagtggaaagaacctcgctggcatttcgatgccacactcaatacaggggcatttgaaaggatagaagagctttatttcataggatttcactcgattgaacttgtcaagaaaattcagaagatgttagcttaatctacaagtaataaatccatagtggaccgttgatgcaatgaaggtcgtccatgtgcattccttgagttgcaggaaaatgctcttgatacaatttttcctgctttctctaaaaacatgcattggaatgaatgtgagaggtaatgctggactgaacactggccgaagtcattatgaggtagtctctattacagctttagaaatgattgcgcctatgaagcacagccattactggactttacattttaagatatgagcacagtctgggcacggtggctcatgcctgtaatttcagcactttgggaggccaaggtgagaactgcttgaggccaggagttagagaccagcctaggcaacagagtaaaaccccttctctacacagaaataaaaaatcagccaggcgtggtggcatgcctgtagtcccagctactcaggagggtgaggcgagagggttccttgagcccaggagttccaggctgcaggaagatgtgattgtaccactgcctgtaacctgggtgacagagacccgagaacctatctcaaaaaaaaaaaaaaaaaaaaaaaaaaaaaaaaaaaatatatatatatatatatatatatatatatatatatatatatatgggcacaaaaggatgtaaaagcaacaccaacctcaacatatatcaaggtttgctaaatgacaggacctctgcggtgcataacacttgctcctccgagatcagaagccctgggggatcttggtgctagaggacttccaagcgcccctgcaggaggaaggtgaggctctgggaggcccaccaagtgctgttgtactcagaggctttgccgattgtggcttcgtggaaagcagaagcgtgtgttctagtatggctgatgtcgggagatgaggtatacacgtgctcttcccggccgaaccacttttcaagaaggaacaggggtgggtgtttccagcaggtcaggagtataggattttcatccacgttcttcgcagctcttgagggctcatccagccacttgtgccctgaaatatgcagcacaccccttcttgggccagcactggggtcacctgcttcccacttgctgctgtgtctacccagtcaggcaatagtgtaagatgccacgattagaccaattatgacgtggaagagattcttaagaccatgggttttgttttctcctgtttataggcggtcaaagggatattaggttatgtatctttatgctttttgacaaattatgaacatggaaaaaagaatcaatttgtatattcggtcatggacacacatttctcaaggctagagtgttcagggtgaaattccaaaagggtagtcacagcttatgaatatggatggggccgtggtctgaagggaacacccagacttcactaggaaacttcaaaaatacgttcaatctgggcgtttgcttggtgtggtagactgaataggggccccccaacgatgcccacaccctaatccccgcaatctgtggatgtgttaccttacatggtaaaagggcctcagcagatgtgattaagccaaggatcttgagatgggggatcatttaatttaattttattattattttttgagacggcgtctcactctgccacccaggctggagtgcaatggtgcgagcttggctcactgcaacctccacctcccaggttcaagcgattctcctgcctcaacctcgggattacaggcatggaccaccatgtccggctaatttttgtatttttagtagagatgaggtttcaccatgttgtccaggctggtctcaaactcctgacctcaggtgatctgcctgcctcagcctcccaaagtgctgggattacaggtatgaaccaccacatccggccaaggagatcattttagactatctgggtggactcaatgtaattacaaggatccttaaagaggaaggcaggaggatcagaaccagagagaggaggtggaaggacagaagcagaggtcagagaggagagagatacaaatctgttggctttgatgatggaagaaggaacctctagaagctgaggacggcaagggtgtgattctcccctagagcctccagaagaagccagccctgcagggccatttttgagttctggtctccagaactttaagagggtaagtttttgttgtttgaagctgctaaatgtgtgctattttgcttcagcagcaataggaagctattacaactggtgagccttctgttaactgaaaagcttggtaaggagaagcgggatggggtctacagaccaaggagtccctgcagaaacctgcaggacagcaagaacgtgggcttttcatctcacacaacaaaccccgttaccctgcggatcggccggtccatgcacaagtcagattctttcatctgggtgccaccacagaatgagaggttactcatactgcaccgctggtttgcgattgtctcagatttccctattgttatagaatcataataagtagcacaccacagcgactctccattggtagctagtcattacaattatgtaagtctcatactgttgaaactgcagaaatcattccaagctgggggtgggagggatggaaggaacgggaggggaaggagagacttcactgaatttcatgtagaaggaagttcatctttgctagaggccttttgatctgatagaaggagatctcacagaactgccccagcaataattcttacctcatctggtaaagatcttcataatgcatgcacttgaatgcactttggacgttgtagagcagcatgtgagtgtttgctggtatcacgttttatctggtaggcaggacacagtcaatggggattccggagcaggggaatgggaagatttctttgcctgaaagcaggaattctcaattttggcttcacactagaattacttgggagattaaaaaaaaaaatcctaatgcctaagccacaccccaggcgaattaaatgagaatatctgcaggtgggacccaggccttggtttgaacttggccaagtccaagaaccacagtgttaaggaagaatttatctggcactggcgtaataggtacagggaagagaacaatgaatgtgtgtggatagatgagtgataggctgagagacaggtgtttgtttcttatggctgccatcacaatttactactaactatgtggctttattttttattttttatttatttttttttgagactgagtcttgctctatcacccaggctggagtgcagcggcacaatcttggctcactccaacctccgcctcctaggttgaagtgattctcctgcctcagcctcctgagtagctgggattacaggtgcccaccaccacacccagctaatttttgtacttttagtagagacagggtttcaccatgttggccaggatggtctcgaactcctgacctcaggtgatctgcctgcctcagcctcccaaagtgctgggattacaggcgtgagccactgtgcctggctcactgcaacctctgcctcctgggttcaagtgatgctcatgcctcagcctcctgagtagctgagattacaggcacgcatcaccacgcctggctaatttttgtacttttagtagagacagggtttcaccatgttggtcaggctggtcttgaactcctgacctcaggtgacccacccgcctcagcctcccaaagtgctggaattacaggcgtgagccaccgcccccagcctgtggctttaaaagcaacaaaaatgtattctcatagttctggagactgcaagtctgaaatcaaggtgtcggccgtgctgtgcttcctctgaaggccccagggaagagtccttcctcgcccttctgttggctccaggtattccttggcttctgatgcatccctccaatctctgccttgggtctcgctgtgtcctcttcttttctataaggacaaaagccattgggtttagagtctaccccaatccagtaggatctcatctcaatccttaactactatatgggtgcaaaagcaattgtgggttttgccattaaaaatcatagcaatttctgcaattacttttgcacctatctaataattacatcttcaaagaccctatttccaaataaggtcacattctaaatagatagacagacagacagacagataactagctagctagataagatagataaataaaaagaagaaaagtgaagttgcagaggtaaaaggtacatgcgggctctttccttgctgaaccacttctgaagaaggagcaggtgcagcatccacggctggtcagcagtggaggattctcattcatgttctttgcttggaggaaaaaaaaggaacaagtggaaaagatgaaaacgggccaagtcgagagagggagggacgtgtcatacctgcatgcatccttatactggaggggagcctctcaagagccagacaaaatgaaaaaatgctcagggacaaagtcaacgatcaacctgtatgcgtgggtttttcatagaataacagcctcctcttctgaacttacagaataccttgtaagtcatttgtgctttcacagccacagacataaatgtaaacagcacctcttgggccaccacctgagagtagataaatttaagttgcgagcctaatcagactgctgctgggggagccttgttccttctctaccgatcaagctgataatttggtctgtattttttgtttttatctttagtaacatttctaggctctaaaaggaggctagaaacagcaggtaagatgctgtgtgccttcaaggggaatttcttagttactagtaatagttacttaccatccctccccctttttgatgtgggtgagaggggttaggtggggaggtggggggtggtgggaatgtggctattatcacccaagcaagggaggagttattttcccctcccaggcaaagcttgggttgggggcagagctgagcatccctgcacagggggtgaaacaggtgggagagaagattgcctagatgtagatgcttttcacagtcgtcttgtgtgttagaggtctgcccacatcctgtctcactcagccaccctccccagaccttgttccctcaggctgaattttcactttcctatgggttgaagaaaagagccagggagtatgcaggctccatggtgagcaggccaagggggaaacaacagctactgctttttttcattttaatgacaaagaaaacagatcgttttagaaagtctgaggctgatactcatcaatgattttatccaaatctcacacaatgagaggttggggtcatgctggatttgctgctcatgcaccagaaataaaacaccaggttccttgctgactgtgtgacctcaagcgggcttcttaactgctatgtgcctgaatttcctcctctgcagagtggaaacttccagagctgttgttgggatcatgtgagagggcgtgttttgcatacttagtgctgtgtgtgacacatggcgacttctccgtgaagttgactgaaccttgagcgccattttcttttactcaactcaagttcatgtgactcaagttaaatggaatcaggaccctcttttccattgtaagagccagtggcagatgaaaagacatcaatcaccaatttcataaagtgaatatcaagcacataaaataaatgttatcctgcaaatctgaaaacattccctccttgacatattgccaaaaaatcaactttccatatgtacatcacatctcgtgtgagaatgtcatattttaagtagatgtgatctcattttatcattagtgaattaataaaatactgaaaggctcattgaccagttttcccccatatttggggatctttctaagggaggagggaaagcagcaaatagattcgaatcatttaaaattttacagcgtagtggacaggtcacatttaaaataacccaaacaagtcaaacgttattattttggaattcatttgaaatatcaagcaattcaggcctagtttatgatttttttttttttttggtttgtgattcttaccgaactctttgaaacacaggactcagccctttcattcttggtttccttatctatatgcttatggtatattattaatatgtttgctttcctattcttttatgtatttataaaatataaacctttcttttaaaattattatataatttgcaagtttcgataaattggaaaattgaaatgtcctcggctggtcgcggtggctcatgcctgtaatcccagcactttgggaggccgagacaggtggaccacctgaggtcaggagttcaagaccagcctggctaagatgctgaaaccccgtctctactaaaatcacaaaaattagccaggcatggtggcatgtgcctgtaatcccagctcctcaggaggctgaggcaggagaatcgcttgaacccgggcggcagaggttgcagtgggccgagattgtgccattgcactccagcctgggcgacagagcaagactccgtctcaaaaaaaaaaaaaaaaagtcctcacctaccccaccccagacatacacctaattcatttctaattgagattttactgtgctaacagtctttagtgtgatgaattagcatgcctttatcttatagaggtatttgtgaggattagttaatgagtcatatatttcatatgcttaagtcactccgagggagtcatttaggtgtttagaagcatattagtcactaattttgggactctggagacttagtccatttctgcagcaccactggccccgaggagttaacatatccctccattgctcatctgagagcctgggcaatgacttgagacactggggagaaaaaaagattccatatgaaaagcaaagacagcagcagccatgtctatattcaaggctgtggctgggagttgtctaattagatgactcatctgagccagcctgatggtttccatcaccttcactaggctgctccccaccgtccattaggctgcaaggcgctgcgtcgccagggaggttgaccccacctgcttgttcatgacgtgctcccttttggttcaagcaacagacatggttggaagcaagactagaaggcagccctcaagaattacaaatgacaaaactgaggcccaggcctgtcaggcgacctgtgccaggtcacacggctaggaagtgacagcgatgggagtcaaacacaggtctcccatgcatttacccctgcccctgccccagcccctctctggagggaaggggaccgattcctcagataggtcagatttgcaggcctcctggggagggttacccaccgcacacactcctgacgtgatttctttgggggcaatttggggtgcctaggatttccaagccaggtttctcatcttattcctctgcatagcagtttagaactcaatgcgctgtattgtatctcctccctgggaggtggggaggttggtggggttaaaaccgaaagacactgatgggccaaaaagatgaaaaaaaaaaaaaaaaaaaaggctgtgtgggcaatgctgccatctagtgagacatactttagccaacctaagaagctgagtggtcctggtagaatcccaccgtaaagtatttcgatgtcctaagcttcatcaaaggagacagggccatctccctgtcagtagcgtggtctttaacacagtagtgaagggttaaattcagtgtcctaacatctgtccttcagaaaggacccgtggcctgaacagatcttctgtgagaatggagcttggttttggcctggtagaaagaccacacagatctgcatgtgagtgctggctcacctgcttagtagctgaggaatgtttgttgttgttgttttaattgtggtaaaatatgcctcatacaaaaaatgtgtcatctgaatcatttttaagtgtacagttcatcaagcttgtccaacccgcagcctgcagtctacatgaggcccaggatggctttgaacgcagcccaacacgagttcgtaaattttcttaaaacattgcgagatttttttggtgttttctttttgttttttaactcatcagctatcattagtgtcagtgttttttaagtgtggcctaagacagttcttcttcttccaatgtggcccagggaagccgaaagattggacacccctgactcttccatggcattaggtacattgacatgatgtgcagccatcaccaccatccatccacctccagaatactctgcatctccccaaactgcaactccacaccctttcaacactcactgcccattctccctcccaccagcccctggcaaacaccattccactttgtttccgtgaatctgactgctctatgtacctcatataagtgggatcacacagaacttcttctctggttaatggtctgttgcacttggcataatgtcctcaagtttcatccgtattgtgtcatatgtcagaatttccttccttttaagggctgagtagtatgctgctgtatgtatataccacattttgtttatccattaatgtatcaacattgagttgcttccatctcttggttcttgtgaataattctgctgtgaacatgggtatacacatgtttctttgaaaccttgctctcaattcttttggatatatccagaagtagaacggctgggtcaaatggtggttctgtttttaatttgttggggagccaccatactgttttccatagtagcggccccattttacactcccacaagagtgcatacgggttccaatttctccataccctccccagtacctttttcctcttcacagtagccatcctaatgggtgtgaggtggcatctcattgtggtgtggatctgcgtttccctcatcatgagtgatgttgagcatcttttcatgtctcttggccattggtaagctgagtaatatttggtaaattacttgaccactcaaagcctcaatttcctcttccatagaatggggatagtatctatcccctagtatagcatctatggcctaagattgctgtgaagattaagttcattattctaaaagaaataaattgtttttggttctgtacactgttctaagcacaggtttgtgtgtgtgtgtgtgtgtgttttgtttcttgttttgttttgttttgtttttgaggcagagtttcattcttgttgcccaggctgcagtgcaatggcacaatctcagctcatcacaatctccgcctcctgggttcaagcgattctcctgcctcagcctcccgagtagctgagattacaggcatgcaccaccacgcccggctaattttgtatttttagtacagacggggtttctccatgttggtcaggctggtcttgaactcccgacctcaggtgatccaccctcctcggcctcccaaagtgctgggattacaggtgtgagccaccactcctggctagcactggttttaaattatatatgtatattctatattgtatatatataaattatttttatgtgtgtcacaattttactaaatatatacttacatgtatttatatataaattatttttagtgaatatatattttatatatatacacacacacacatatatatatatgtatatgtatatatatatatacagagagagagagagagaggcaaactctgacctgagaagctctataaagtcaacccacacagattactcacagagcatggctctctgcttattgcagcccgaaggcaacacatttaaaggtgaggcagacatacctaaaataattaacatgcccctgaaaaacagcagtggaattggtgaatttagaaaaccgaggcatccctcacgtctgaacacggtatccctgaaaaatagcggtggaattggtgaatttagaaaaccgaggcatccctcacgtctgaacacggtatccgtgtgtttttagcagtaatctcatgatgaatatcctgaacacagccttcgtgcagggtccactctccagcttagagattcattcccagcctacttcaaaggcagctgagactgtgtattggagtttctgttcaagacaacggtgtcttgttttcctctaaagacagattgtactttctcatgtaaatagcctttttgatagaatgcaggtgcttccagggattaactgctgctattaggctaggtggcccactctctccaccctgttcaaacagccagtgcttcatcatagtttatgtaactggcaacttagaagcagcagcctctttgatgagtccattaggaggtaggagaaggattggtagcagagaaatgaaagttcttgcacacaaataatgagtagaaaggatgaacggtggttgctggtgctttctgaacaaaatgagggcaaggggtgctgtccactaataagtgtcatttagaggctttattcttctagaaaaagggctgcccatctgctctccactgagaaggtgatttgccgactgttcctgaacgtgtgcctgggttgctaaaacttgcggaacgtgtatcagctgttgaaatggcctttcctttgggaaaactgtgcagacagcaaagagagtacaaaacacgaaaatcttaattccattccctcttctgccactttcagtatgacctcgggcaggttttctacctgcacagagaaaaactgaagtcgcacgctgctcttggttttctcagcctggagcagatgcctttgagcagctaccacttcccgttcccctgacagtgtgctccggctttacgaggctgtttttctctccacagtcaccaagtccactgtctctccacagtcaccaagtccactgtctctctccactttgggggccatctgtgaatatcactaacttagcattacagtaccaaaaataataattatagctaccacttgtgtacttactatatgccaggcactgtgctgagggctttgtgtgtcttaatgcattcaagcttcataacattcctatgaagtaaattattcccattttaattagttagttaattaattcatcaagacaggatctctttctgttgcccagctggatactgtggtgtgatgacagctcatcgcagtctcaaactcctgggctcaagtggtcctcccactttgacctcccacagtgctggattacaagcatgaaccgccatgcctggcccattctcattttaaagataaggaaaatgaggtacaagttgatagaaacagacagtacctcaccacctgcatggaggaatcacgtatttatggagtcctgaacatttaatcaacaactgttttattgagcatttagtttgttattggttgaaattaagaagactggtaaataccatgaattaataaaaagttttatgttaatagtaaacttgtttaggaaatctggttttgtctgacttgaaatattaaggaaatatgtgtaggtttaggtaagaatatatatttggtttaggactgttcatattaagttacatagtcctcagccttaattcacctcacatctccccatacatcttatgtctttttctttcttctttttgctattaaattacagcatcacctcttgatcactctaagacctaatcatctagcttgtaaattattcatacttttccccctcacctcactcctctcttttggattttatccatttatctgcatctctgagaataggtgggcaacagaaataaaaggattcagtgaaaataagttcattctgtcatttattagcaacttacacaacaggtttggcagaaaagaaaatgggaactaaaatagagtaattaaaaagaaagtcacttatttaaacattgcatatcttgctacctcttctaagtagaaattaattagctcctaacagctaactaatagactaagtggaaaatagaccagtgcaacatttggggttaattggtacaaatatattgattacagtaactagtcattaaatgttttataaggtatatatgctattagtataatctctgtatggacatcatctactgagtgcatggatgccgtaaacacatcatgcttagaaccaggcgtttgaacgctgtctggagtacttttacattgtagtaccctgaatgtacatgcctgtttgttatcactgggagggcagctcaggacaggattataaagagatggaaagaggagcaaacctggggcggcgtggagctgtcatgagaatggtattttcgggagctggggaagaggcagagaaggaagggaaaacatttaaagagggcaaaacatggacttcatccgttagctctacagacacggcccttggtagttaggcgacgtgaagccacgtgtactcaggcaggtagtggggaaggctgcttctccaacagatggagacagggaggttggcagaccgctggcttaggaggaagacagcagcagaagggttgcgtgtgtgaaggcagggtcacagatatttagaacgaagcccaaagtccttggagattggttggatgtgggaaaagagagaggatggtgaggctgagactctggtttctgtgccaggtgttgcatggacggtgagctattaaccggtgcagagaaagccgaaagagtaaggctgagccatctgaggtcaggagttcaagaccaccctggccaacatggtgaaaccccatctctactaaaaatacaaaaattagccaggcatcgtggcacacacctgtaatcccagctactcaggaggctgaggcaggacaattgcttgaacctgggaggcgaaggttgcagtgagttgagattgtgccattgcactccagcctgggcaacagagcaagactgtgtctcaaaaaaaagaaagaaaaagaaaagtatcagtttagcaatattgaaatgtgcagcactcaattattagctgtattcagcctgctgtgtaattgatctaaaaaaaaaaagacagatttattcttcctatctaactgaggctttgtaccttttgagcccagtgactccggtgccttgatgggggccgggggctatgacccaggctttgctgagcgatgagggagcgtgctacttctggggtcagggctggagggctccagctgcccatctgggctgccactatggaggagagctagacattgaccacccaccatacaggatgtgtttgcctccccctcactcacaccctggttgtggcgtaggtaaacacagcaaggctcagagggctccaggaacctggctttaagattgccattagcatcatttcctccttaaacaacctcctatttacagctctccatcgataagatatgcaatgaacaacttcatcaggttaaactgcagcaaatgtcaccacttattttgtcactctctgatcttggggggagaaaaacagtgcagcataaaatattgaactgtttactcagtatttagttcattcagtgttttcggatgcccgctacgtgccagcggggagtaaagatgagacaggcttagtccttctcttgagggatctcaccaagtgcagtgtttggtgacgcaggtcacactggggacatgccatggcaggggcacagatatcagctgggggagcagagatgaaggccagatacgaattcccctgcgcatctgaaagaatgcttcatagctttgaattagatgaactgtttataggaacggtaatccagaaacaagtactaaatgttgtatggtagggtgtactagaggctgtattatctgacctaggtttttttttgttttttgttttttgttttttgttttttgagatggagtttcactcttgtcacccaagctggagtgcagtggcgtgatctctgctcgctgcaacctctgcctccccagttcaagcgattctcctgcctcagcctcccgagtagctgggactacagatgcccatcaccctacctggcaaatttttgtatttttattagagatgcggttttaccatgttggccaggctggtttcaaactctaagctcaggtgatccacctgccttggcctcccaaagtcctgggattacaggcattagccactatgcccggctccaatctaactcttgattcctcctttataactattcatcagactgagcaacttggcaagaacctgactatcaaaaacaaattagccaggcatggtggcacatgcctgtggtcccagtgctttgggaggctggggcgggaggatcgcttgagcctgcaggtctagactgcagtgagctatgatcacgccactgccctccagcctaaacaacagagtgagaccctatctcaaaaaaacccgcaacaaactaaaaaaaatccccgatatttctgcttccctaatatgcatgataccagcagcagacagggctgctttgacacctgcccaaagtgtagctggacatctatgtagactcatggagtttggggagaataggaaggcgtcaaggctaagtacaggtcccatctctctccctcatccacttcccccaacctctggtcattcaccaagaaacgttcacagtcctgggctgcgtttactaactttgttctcatgcgtgcttctatttttgaggccagaataggccattttgaaacctctggttccagccttccccttaggaaagtgagcggcagagttgcgacctctctccctggtggctcatctctgggagacgagcgctgtcctcagaagtgacgtggaagctatcgtgacagaggtgttttgggtcagaaactttccattagtatttggagaaaattgatctcattggagaaaggaccatgatatgaacaagtcaggttttttttttatcatagtattttttaaaaaacgttctaaggagaagatttacatgaccactttctttctgacggatacttcttcctggatggaaggaataggaaaagtacataaaatagctcacatggaaaatatttttcctttgatgaaaagtgaaactaaagtagcacttgcaggatgcacttttaattcctgaagcaaaagccgctacttgcaatgctaagtcacattgacgtcccagtcctgattgggccagatttcctctttctttctcatcttgtgttagcatttaaaactgccaagataatgactatgttaattaatctggcccaggatattttccccataaacaggagtgtgactgagtaggtccctcgttccttctacgtctgcctcccgccttccctagagagaagtgaatctaagtcatgctggaaaggtggtgcctaaactgtaccttaagggggaaagggctaacagcccttctcccatagccctttcagcactgtgatcaatctgacccttacactcaatttgtctacaattgtatctctattagcaatgctgctctgagtctgttgggtggaagacatccaattggtgggttgtttctgaacactggaccagcccaaggactatttcaaggaaagtcagggtgagatttgaactgtgcgcacctttgcctgaagccagtctcctgtaattgactctgggacagtaagcattgcagaagacagcagcgtccctgatgttggaaggaagtcaggcttgcagtaaaagcttatccagagaaagaatgtcattctctcaatctgtctctccctctctctctcttgccaggaaagttccgttttgttagctctagtgcttaatgatttcagggttcacactgtgtccactctcaaaaaagcccattttcttttttttgagacagagtttcactcttgtcacctgggctggagtgcgatggcatggcctcggctcactgcaacctctacctcctgggttcaagcaattctcctgcctcagcctcctgagtagctgggattacaggcatgcaccatcatgcccggctaattttgtatttttagtagagacagggtttcaccacattggccaggctggtcttgaactcctgacctcaggtgatccgcccacctcggcctcccaaagtgctaggattacaggcgtgagccaccactcctggccaaaaaaaaaaagcccattttccatgtacacacactcacatgtgcatgcaagtatacagtcttcctggcagaactggaatgagttaaattttgtccatttttattactagaattggctaatagggatccatagcttataatgcatcaacattaaaaatgaaattatattttgaggctcactgcatataaccatgtttaccctctgaaaagatattgtcctcccttgaatatttgacgcagtaaattatgttttggaggaatgcttaagttacctatgaagtatccatttttttaaatgttggttttttctattagtttttaaattaaatggtacatgcgcataatttaaagatctaagtcatttgataagacttgatatgagagacgccagcccaacactgtgaatgcagtgaggcctttcctcctttcccaaggctcattaatattcatctccctattttaacattcttaggttgctccttcttgatttacttagttaaagtttcctattacagcagttctcaaagtgtgctccacagaccatctgagtccctaagaccctttcactgggtttatgagatcgaaactattttcatgtaatactccgacgctatctgccttttttacggtgttgacatttgctctaatggcgcaaaggcaatgatggataaaactgctggcttctcagcatgaatcaaggtggtcacgccaagctatgctggtcatgctattactcattgtcatatatttggatatttggagggtttttttttttttaagaagtacagtgttacttgagtttattttattttattttttatttttgagacagagtctcactctgtcgccaggctggagtgcagtggtgcagtctcggctcactgcaacctccgcctcccgggttcaagtgattctcctgcctcatcctcctgagtagctgtgactacaggtgcccgccaccatgcctggctaatttctttgtatttttgtagacacggggtttcaccatgttggccaggatggtctcgtgatccactggcctcagcctcccaaagtgctaggattacaggtgtgagtcactgcgcccagcctacttgagtttatttgatgaggcagtgaaaataattttattgaatcaaaaaatgtatgttgacatgtgaagtacttgggtggcataggatggtcagttgcattagttgcaagctctactagcctttccccctctgccagtagaatacatttttacttgaaggaataacaaaccaacaaactatggttattgagaagtaggtattatgaagacattttctcaaaaggaatgaaagtttgccacttaaaggaaaataactaatggttattttcctttggtttgtttattaatcataaaattttggcctagcatgatggtacatgcctttagtccaaaccatttgggaggctgaggcaggaggatcactcaagtctggggaagttccagaccaacctgggcaatataacaagaccctgtctcaaaaaaaaaaaaaaaaaaaaaaaaaaaaaaaccaccataaaattttgagctttcaattaaaagataaaattttgaaaacttgattctactaccatgggcttgaaagctttccaatactaaaatatttttctggtaagatttgtggtgatattaacaaatgtgattttttgatactatattatggaatgggtcaacgtctggaagatacagataactcagtaaaccagtattttccaaatgacctttgcattatgttacaaaatcttgcaacataagatccatacaaagtacaaggtagcctaattgattttagtacaatgtgataccaaaagtttattaatatatttaatagtttcagattgctcatttcagtgaaattttaagaaactaccacttgttgatttttagtgtagtttctaagaacagtgtacacagttatctgaatactcctattcaaatactcctccatattccaactacttgtctttatgaggctgggttttctttagatatctcaacggaaaccacatatccagacataagccacataaccaaaataatataagcaactcattaaagagatttgtgggctggggatggtggctcacacctgtaatcccagcactttggcaggccaatttgggaggatcacttggggccaggggttcacggtcatgccttccaagatcatgccacggcactccagcctgagtgacaaagtaagaccctgactcaaaaaaaaaaaaaaaaaagagagagatttgtgaaaatgtaaaacagcaatgccacttttcttactaattttttgtttagaaaataattacatttcatacaatatttatgccaacatgtgatgggtttattattttaaaataaataaatgcatctatattttaaagttttcatttaatttctagtatggtgactatcaataggtatatagtgtatttacggttgctcttatgccagagcaaccagtccagactggagcagatcaggagaccctgggaaagaactcttcagaaagatggaatgattcttataactcctatgctggaacatttcgagagcagagttacagaacaagaaggagagttttggatggaattcccaataaatacatagaaaacaaagcaaattgaaaaaaaaaaaaagataaaaaaattgaaccatgaaggaagagctctctggggctctccgtaatgtttaagattatgaagagctcctgaaacgaaagagtttgagaatcaccggccttcggcgtaattacgaaacatgaaggggtagttctctttcgccaccacccaccccaatcctacgccacagaaatattcacttcttgtcttcccattgccctaacaatttgttatgatttgggttggatcaatattctatattatgatttatgtaaaggttatataaaaatattactctgagtacatagaggctgtttgcagctgagctgtgtaatgtggcttttcatttaaatgtacaaaagggatacattttttgataccttggatctgaaatatctctctaatttgccttaacacttgatggttggtttttggcttgatattagagttctaggttagatgtcattttcctcagaattgtgaaggcatttctctatggtcttagagcttctgatgttgctgttgaaaagtctgaatctggatcatttatgtaacacatctccctctcccttcccctttccctgcccgttcctctcctgaagcctgtctctttagtgttgagaaatgtcacagggatgtcttttggcgtggagctaatggcatcctttgtgctggcacttggcagtcctttcggtgtacaaattcatgttggcctgttctatgaaatattctttaattattttttaacactgtttttcctttcattttcttttttattgtttttgtaactcctattatttggtgttattgtctagtttaaaaattttggggggctgggtgcggtagctcatgcttgtaatcccagcacattgggaggtcatagtgggtggatcacctgaggtcaggagttcgggaccagcctggccaacatagtgaaaccccgcctctactaaagatacaaaaattagctgggcgtgatggcagatgcctgtaatcctagctactcgggaggctgaggcaggagaatctcttaaacccaggaggcagaggctgcagtgagccaagatcccgccactgcactccagcctgggcaacagagtgaaactctgtcttaaaagaaagaaaaaaaaaatttgtcttttctttcctatttgtcaaactttgtaaaaacttcatcttgtaaataattggttgagatgttcttttctgctgtaataattttaatttccaagagcttctctttgttgttactttgtctctgcatcttccttttttatggcattctgttcttgcttcatggatgcaatattttcattgatctctcagaatgtttgatacttggttttgtttcattctgtttcacttttattcttcctgtattgtttctccttccgcaaagatggcttctgttgttttgttttcttctcttttgtatcatatgttttcctcaaatatttggtgatccttggctgactgattgtaatttgggagtgagacgcagaataactcaaggaggagcatggaagggattggtgagtgtggtcttacctgtgtggtgacttgaagaagccattttcttccgtttctttaggtcttttcttttgagttgttgagatctcccaggaaagactcttctaatttccagcttgctgagtgtaaattttggctgccaggttttgggagctaagaggaagaagacaagggagatttcaaatttagtgtgtaaactttgactcagcccccttgtttttggtttcctgcttctaactgaacctagtgtgttctagcctagatgccctgggtgttattctctccaagaacaaacctttaatctctgccagatggggaggtacagtcacccagctacctgggggaggggaaggggtcagggattcgaactgcttcttaaacagaattgcaatcagtccccttggacttagctccaccgttgtcctcactgcctgcaatatctggggccaccaactcttgagccttttgggggttttgaggtctgaacggtgttgtttgcagctttgcctatcactagcttgagactcatctttggatctgctaagtcagttactgctcacctgtcttggctccagctgttaaaatcctgttgcagtttcttcctctcccattttctctgtcgtcgtgagtttctgccatcttaaaaattctttattgtcattttattagggtttcaggagagagcagtgctccatgcatgtatttaatccactaactttaaccagaagtatttttttaaacatttggaaagcaggctgcgtgccgtgactaatgcctgtaatcctagcattttaggaggccaaggcaggcagatcacctgaggtcaggagttcaagacaaacctggccaacatggtgaaatcccatctgtactaaaaatataaaaattaaccaggcgtggtggcacaggcctgtagtctcagttacttggaaggctgaggcaggagaattgcttgaaccagggaggcagaggttgcacagagccaagattgcaccactgcactccagcctgggcagcagagcaagactctgtctcaagaaataaaaaataaaaatataaaaatataaagcattaaaaagtaccttcaagtttttttctttctttttttttttttttttttgagatggagtttcactcttgttgcccgggctagagtgcaatggcacgatctcggctcaccgcagtctccacctcccaggttcaagtgagtctcctgcctcagcctcccgagtagctgatattacaggtgctcgccaccacgcctggctaattttttgtatttatagtagagatgggatttcaccatcttggccaggctggtttcgaactcctgacctcaggtgatcacaccctccttggcctcccaaagtgctaggattacaggactgagccatcacgcccagccaaggtgttttcttagtaggtgaaattactgagttagaagcatttattcaggacctactccttcttaaacaaagtcattgttttgtttcttcattcgcctatgtctgcaatattatagagctagttcaaaagtaagcagtttgattttggctccaacattgagcaatcataatgtaatactaggttcaaatgtgagtagatttgagtgcatgtcgatgttgaaaataaactcactattggagtgttttaggatgctctggctttccaggatggatattacttaggagtaggttggctctgggttttttcctgggttcttgatttgcttgatttggttcttatataatctattctttctttccctttccttctccagaaacagctcaaattatgaaataactttcaaaaacaagttaggtggtagtagtggaggtagtgaaggaaaacagggaactttcctgttcgctgcagagcaaaccaggtgccacgtagaccttctcagatgccactactggacgcagccctctagacctgaaggtatgctggatagacccggatagacccggcggggtgctgagcccaagcgtgtgccagggtgggaggatttacacttcagaaactggcagatgctatgaaatcagaaccttttttcctggcaagctggtatttaaatcttaaccagcatgcttctgtctagacctgactttactcttggggcaatctgatataccccccaaagtgtcataatcacgtcagcctacccgtatgacattgtatttattcactgcactgtgagctccagggagtccaggtgatagaataggcaaagggcaaaatttggagccagacagcctgacatttacatccttccttggctacttctagctctgtgacctttggcaaacctctgaaagcctcggcttcagtttcttaatctgtagaacagggggggaaatttcttcctagcgatggtgttgtaaaaaattcacaactgtggcagcctctgctctcccaaaaccatgtcctctagaaaatcctggctttatggagtaggttcctctgtggcctgtttctgtttggcagcaggcttgtgacgtctttgcttagggtccttatttttataacagaatactgactttttgtttatatggtttccaaaatttatgaagccactaatcaaaaacatgggatcagtgtacttcagactcttacaagggaatataatgttagacagacttctctccggtgctccaaatcccacaagaggaacagttttgttaaggggcagtcatttaaaggatgactcacaaattatctgtctattctaagttatacctttgaataaaattaaaataccaaataaaatatgtatgcattgggacaacatcaacataatcatttttataatcactcaaaactgtgtcttaatcatatggcttcaaacctttattgcaaattattataagaaatgctgtctctactaaaagtacaaaaattagccaggagtggtgacaggcgcctgtaatcccagctactcaggaggctgaggcaggagaatcgcttgaacccgggagacagaggttgcagtgagctgagatggcgccactgcattcctgggcaacgacaacagtgaaactccatctcaaaaaaaaaacaaaaaacaaaaaaaaaacaacaactatttgacttttgctttagcgtctgctatgaaccatgaatatagatgccaattatccattacatggttcagttttcctggcttacactgccctacacaagacatctgtccttgacacagggactaaccttgtctctcctaaggaattagtcatttttatcctcttagtaaggagttgtgaaatacatgatgtttccctatgcacctccgtgccaggaatgttagaatcaagttttgttatcaatcataagaactgtctaagattttcatttgacatgctacatttctactcctttttttttttttttggaaagggtttcactttgttgcccaggctggagtgcagtggcacaatcacagctcactgtagcctctaccaccctaggctcaagcaatcctcacaccacagcctcccgagtagctgggactataggcatgcgccaccacgcccagctaatttttgtattttttgtacagataggagttttgccacactgcccaggctggtagatttctcctcttgatcctgttttccacatgttcatttttttttttctttttttgagacagagtttcactcttattgcccaggctggggtgcaatggcatgatcccagtttaccgcatcctccacttcctgggttcaagcaattctcctgcctcagcctcccaagtagctgggattacaggcatgcaccaccacacccagctaatttttgtattattagtagaaatggtgtttcaccatgttggtcaggctggtatcgaactcccgacctcaggtgatccaccctcctccgcctcccaaagtgctgggattacaggcatgatccactgcgcctggcccacatgttcatttctagcttgttaactttattgtatttaccatactctcccactttttaaactacagattccttgtagaaaaatgaataaatgaatgaatgagtgaaggaaagtcagtggcaataactaatgatgtttttaaaattgtgtagtaagtggcatagttatgagatttgggggatttggggctggatcagacagagaaaacagaaggggaacatgccagtgtcttcaaatgtttgagacactgtagtttggaagagacagcggacatgatttttattgctcctgagaatagaataggagccaatgaatagactatccattaattgatttgttcatttctaagttatttcttatgcacctgctctctagggcatgtggacgaggtccagatgaggacaagtttcctgctctcaaatttcttgcattttagggaagtaatttttggctgacttgcaaagaactttctaatgagaagagttatataaccatgggatgtgttgccttgtgaagtagggagctttccatctttggagaatctcaaaaagggctgaatgaataccctgaaaaatactactccctcgggagagaaggtggatttgttgacctctagggtttggctctactgtgcttccatgtttctcttttatttgtcagtttccatcttaaactgaaggattaggtcatttcagggagttctggaggtgaggtggtgggaagcaataaaaataccttcacaaaccagttcctttactctttgatccaggtggttcccacaggtcccttgacccccgataaagtaatcccggctgcctgcgacggaggtgtaggcagccagggttcatggagcctgtggttatctccttacagagagccttatcagcttgtggagccaccgtaaagcttgctttgacctttggcagagactcctcctgtatgtctgtccacagaaatgagagcaggtgacagacacctgggatgatcctgagacccagcacccaaagcccaggcttctttctatggggaagtcaagcagagggacccaagctcatagccagtggaggggtgggttgatgagaggcgagccctttaccagatgtgagcccagtcatcactctgcattttctacgcaaaagtccaggggcttgctattgaaattaggcaaagaggacaaagaattgccctctgtaaagtcctcaaaaaattataaattataatttttataaaatgatagaattctaaaataaaatttttataaaattataaattttatatatatataatttcctggaaataacttacagaaaagttgcaagaataaaaatagtacaaaggacacccttattcactgtactccgttagcaattaactattttttctggaccatttgtgagtaagatgcgtataccattagcctttatcctgaagctcttcgatgcatatttcctgggaaatgagatatgctgtcacgtagccagagtacacttatcagcttcagtaaaattaacattgatgagtacccttatggaatctatcatgcatgttccaatttgttttcagttgacctgataatgtcctttacagcattgtctccctccagtgaggggtccagtctaggatcagattgcatttcgttgtcgtgtctctttttgagggtcttttaactgtaccattattattgttatctgtcatcttattagcttattcaaagttgttagaggtatttcttatttagggtacatctcatttacaatcatcctttcgttcacttgaaaatgaaggctaggttctctggagtccagactcactccccttctatgtgaagtgttttcctgtgtatggtggaagggatgggggtgagaaattttggatgtacattatgtacatggttgacttttctttgtttgatttaaatcatacaaaaacagatcagatcctttgagatcattttcaaattccgctgttgtcaatccgacttattgccaaggagatcgtcccttcatccttgaggaggaagaaaggatcattttgagaatcttcgtttcatatcaagacaacacactcttctgaatctagaaacagaaatacctttacatttacttacagcccttatctcagcactttcatgcatcttatgagaagcaacacgcatgataattaagcatttctatgcatgcagagctttggttagcttggtaaagggtatgttcagcaattctggtccctgccctccagaaaaacttgcttaagatgcaccaatatgcattattaaatataataacacatcaagtaaaaactatgcctaacactcgcaggctatcatacagacttagaattattgagatgatttttcagatggtaacatttaatcacagagaagctgaataatttgccgaagtttactttaaaaaaaatcagagctacgataccaatgttcagtacctttctttcttagtataatcccctactttcaaaataacctttatagatatttctagtatctacgctaagaaaaagagtaatggtgaaagactgagagaagacactgctttttaaaggctatagaaatctggtacatggcttctttgaagaaaaaaaattaaatggaaggaaaattggctgctcattttctgagggtgcaattttatatagaagatatttcactgtggtctgtatttaacaagctgcggggaccctaaggctggtagatggtcagactggtaacattttctaatgtgactctgataattttgacataggctttctttttggctgccctaagtatttatccttttcacctgatttactttacattcgcctattttaccatgggttacagacaagaacaaattggactcttaaaatggcatataattttaatattttctgagtttctagtattctaaattcataattataacctgagggatgtatgcccacagggcataaaacaatcacatagatagtgagttttttttttttttttttgaaattaccttggctacttgaggattctctacacccctgctatccagcatgggggccaccagccacatggggctactgagcattgagacgtggctagtctgaactgaatgtgactggtctgtataaaatacatattagagttcaaagacttggtacattaaaaagaatgtaaaatatctcattagtagacttttttatattgattacatgttgaaatgataatattttggatatgcagggttaaatgaaatgttattaaagttaatttcacctgtttctttttaattttttgatgtggctactagaaaaccccaaattccatatgtggtttgcatttgtggctcccattatatttctgttggaaagctcagctctagaaggaaagaaaatacataaaaaaagaccaaaaaaaacccaactcattcagtgtattttagagtgaattacggaagggaaagctgaatagccaatgatcccattttttttcttgattaggtttggagttcattaaagcttctttaattaaatatattgtaaatctgcttcaagttcccagttgagatgagaattgaatctttttgtttaattttaaaaattctaagaaaatcctgaactcacttcaaaagcgacttgttttttgaaatctttgtaaaaagctttccatttacatggattggaggtctgattaatatagagttttgaaggggctaaagaggtgtgaaaattatccagaaacttctgaaaggacctttcttatctcacaggcatccagggagacataagggcccttagaagccgcagatcagccataagcatctgtgttcacagtttccttccaataagcaaaaacactgggagagataacatatttattcctaggtgtctataactgaatttatgggtgtaacttgctggatattattgcccttgtaaacccatgtaactgcacacgtaaagcatgtttttattagttcctacataaaatttttatgataatggcaaacaaaggaccaatttagtttagctgagtttgttcttattactccagcttccaatagataagcaacagtgcaaacagcaggctgggcgcggtggctcacgcctgtaatcccagcagtttgggaggccgaggcgggcggattgcttgaggtcaggagttcgagaccagcctggccaacatggtgaaaccccatctctagtaaaaatacaaaaaattatctgggcgtggtggcacatgcctataatcccagctactcaggaggctgaggcatgagaattgcttgaactcgggaggcggaggttgcagtgagcctagatagagccattgcactccagcctgggagacagagcgagattccatctccaaacaaacaaacaaacaaagaaacacacacacacaaaaacaccaccaaaaaaaacccccgaaacagcaacaacaacaacaaaaaaaacaccccactgcaaatagcagcagtcaacagggaagagagagtcagtgcttgcagggctggggctcctggcctgtgggtaaggaggattgaggctcccctaggcctcatgggactgcagtagggtgaggctgggctggcctgccctcagcttgcaagcctgttgttgagcagctgttctccacgttggtagctgtggagtattctaatttagcttctgaaaaggcttgcatagctagtattgaaagaactcccacttactgtatttcagctggagaattacagagaaaaaaggttcaagtggcttattgtaggtcatctcccactctgggatttaaacaaagcacaaacagaacaaagttcctttaaactgggtgccttcatctgagtccctcctgtctgcaaggtttggcaggctcgctggatacagagcccacgcctctcattctcactgctgcctttttatgtttgacccttggatgtggccaacgattcccatggtgacctggattggagggaagtttttctagaatttgaagataaagcatctttcataaatactgcctgttccttcccaatgactagttaaaaattgatagtctgtaaactagagtgagtgcgatccgtgaacccaaattcaggagacagagtttgacgtgtctaaatgtacgcaggggacaatagcaagaaatattttaagctgaatgagcctgaaatataaaagacataggattgttatagatatgtcatactgaaggctgccttggatggaaaatcaactgaaaaaagggcaagcttagtacacactaggtttattctgggctaaggccggtctaggacattcatgaaattacaacttagtgattaggggctatagtggtttagattctagactttagaagtatttacacatcaaaaaactcatggctgcgaagagttttcctcctagcatctgacacaactcctcattttgtaagtctgtactggagtgaattctagacagctggcttgttgtatttatttttatttttagaaatggggtctcactctgttgcccatgctggagtgcagaggtgcaatcgtagctcactgtggccttgaactcctgggctcaaatgatcctcctgcctcagcctccccagtagctgggactacaggtgtgcaccaccatgtctggctaatttttaaaaaaattttttgtagagatggggtcttgctatgctgcccaggctggacttgaactcctaggctcaagtgatcctcctgcctcagcctcccaagtagttgggactacagggacacaccaccctgccgagcttgactagttatattgttcttaaaggtttatagaaggaaggagcttctgtagcctccaaccccatttttcggatgcgttcctttaaggactaatccaatttgaggttctttattctatttcctcagtgggcatgtttactgatcctcaaatgtgcctttatatatttcataagctgtttctttgcattctttcccccaaaggagtagtttccattctttctgaaaaacactgcttgagcctcgtcccttttggaagagcagttctggggtgtgtgtgtgtgcgcgcgcatgtgtgtgtgtccacgtgcatgcgtgtgtgtgcatggggggtgtgtgtctgcatgcctgtgtgtgtccacgtgtgtgtgtttctttggcctcctctcaggctctgggggaaaaaaacctctactaaatcttaagctaagtacaaaatgtgtgcatgtttcactcttgccaacgttttagacttctggtgttaagccctgtggaaatgcaaatagcatagtttttaatacttactctaagggtactatttagggaagtaaaagttactctaaaggcaagattgatttcctgccctcatggaactgacctttcataatagatagcttgttgtccatgctaacaagggcttactacaagtgctacgtattctcaatttgtatcaaaaattgtagtttggggccactggcttctttttggagatggcctgattgattccagactctggatctgagaagctgacggttttgtaccattgccctacacacatggaaacactgcagacttcaaagttcctttgttttaagtgcggtggaatcatagttgaggggacagtgaaggaagaggacagactgagctgaggtgttgttgctgctttctctcaaaaggttgttaagagatcattcatttttgaggaattgcaacaagactgatttttttttttttttataaagcgtagagtcttttaactcaggattagatgaatagcttttcaaatgtgtatgaaagacaagaatcccaaaagattggctctattttaaatagcagactccagggactcaaggtttgtaacaaaagggcagatatggaagagatgaactcccgggtccaactctgagaatagagcaccctcagggctggggatccctgaggtgtcagggaatgccaatctcgctggttccggtttattagctcggggaatctcgttagatatcctcacaataagctagttggtattgactttgcctgacccatattataaagttctaacaagtggaaagtatagccaagctttgggaaatgccatagcatgcagaatagaagagaaaaccagcgtcttaaatgaacagaggagaaatttgagcagaaccaccaactggagaaattaggacactggctggaatgttacagccacaacaggggaaaaaagcagaatatttacttagtgaagacataatgagatggtacaattctctggtgtcaactttcacagaagagctttgtctctgtgctaatgatgcagagagcagggaagtgatgagaaaattgtatagacctcaagaaatccaacaacagcaaaaaaagaatttggagtttagttttgtatcttctgaggtccaggatttttccatctccctaaatttgagaattcaggttcaaggaaggacttggagaatagtcaaaacattactacacttcttaaagcattcttaatggtatttttactagtgaaatagaaaatgaaaacacacacatgtaaataagcatattttattaatcctccaaatgccctgggtaaaccagtttagaaaaccatcagatgcaaagtctgtcatgggtctggtgacgagattaggatcagtcctaattaggattaatgaaacagagtttcccgggaagcaactgtgacaagctgttctttgaattctggacatgtaggaatgatgtgaaagtctagatgatcagcctcatggagtaagggatccgaacctccaaagggaataggcagaagaacaatttcaaatatcttcataagatcagcccacaaatgtttgcctacccgtgtgcaggtttgcaattagaggctttagagcattggttttgattcttaagccatttttatttgaggagaaagatgcctgagagtgtttttagttaatattccttatggcaaatctgtgattttgcaactaggatgcagagaggttaattgactttattaaggtcccacagctggtcatttgggtagaactgagcccctggcttatggctaacctacagagactctccctctctgtatttctaggattttcagtcatttcagagttctgctgtcctattgatgttgttttttttttttgtatgcatgaataagtgctgcaattaacgggctgtggcgtgaactaggggtgtgaatcaggatcactcatcccaccaagttgggcttctgtgtcttcatgtttccacatggaacttggcctggaatagatctaagggcttttccagctccatttttaaaaattgcttactgaattgtgtaggatttggtatttctgcagttggcaaacagaatacaaggtttggtgtcaagtcgaaactggaaccatgtaagccattgcattactctggaacaatcagctgactctgaaacaattcttgttcaccaatgacagtttgggaattttttcccagtttggtagggaatttcttttttgtcatttttgatatgtttgtatgtttttgcacaaaggccactcaaaggttaagtcggggcattttttagagatgtaatgggaatatctgtaaatggtcctgctttagactggattatgactttaggaagcacagggcacgttcagccgcatggccctccagtcatcctatgtgcagtctcacacgttccccactctggggaaattgaggcaaagagaggggagatgagtcgcccatagcctcccttgttgctcccaccaagccaggcccagaattagttcctaacacttaatgtaacgtttaccaggggcctgatgcctgacacaccctttgctaggcactaggattacagtgacaagttaatttggtccagcctgtctccaatttgggcatctccttcgtggctgtggtatggagtggctcagggtataatgcactgctggttgccttgaaagtttcccaagcattagccaagacttaggtgaagaacttggacatggaggtgacgtaggccctgggaagggactgcctaaagatgtatgttcatgggctccacagacaagaaagacatggcagattaaacatggatagaaaagggcatgatgtgtattagaattaaatgctgcagcagttccagctaatctaatttcagtctcttaatctcattgtctttccccttggcagcataactaataaacaatgccactctgcaacagttacataaagcacgtattcaatagtcaaaaattccaagctcttttcttcaaaggttaggtctattttttattttattttattacttattattatttttttgagacagagtcttgccctgtcacccaggctggagtgtagtggtgcgatctcggctcactgcagcttctgcctcccgggttcaagtgattcttctgcctcagcctcctgagtagctgggactacaggtgcgcaccaccacgcctggctaatttttgtatttttagtagagacaaggttttaccatgttggccaggctggtcttgaacccctgacctcaagtgatctgcctgccttggcctcccaaagtgctgggatgacaggtgtaagccactgtgcccggcccaggtctattttttaaatggataaaagaaagagggtggctcaattttgtgacagggtctttaaatttgtcagtttgtgcatttcatcttctggtgccccagagctctgagtgtagctgaaactcatgcccggtatggggaagaaccggggcagggtggggccctttagcctctgggtttggtttctcctctcctggaacctgtattcctatgattacttgccccatattccagagaattccagctctgcagctgtggctgtcgcatctcacactcaaactgactgagatgaacaattactggttttctctccccgcttcccatctctttgtgtacattgctttttgtttttctcttttttcttccttctcccatttctctctttttctttttgttcttttttctctctttgttccttgtttgccctttcttccccgaatccagcaatttgtcttactaccactatattgaattatgtataagccgaagcatcttagttcattcaataaagctttctgtaccctattcaccatgttaaaaatcaagtgaaaacaaagttttatcccttaaaaacaaacaaaactccaacaaccccaacccaactaaattaagtccattcctatttgtatacatctgttaattaatgtatgaattaatgtatttattagataaattccatatccagacacatcctatactggtaatactaaggagaacagacacagtccctaaggtcctaaggttgactatttacttggggagagagactgacaacaggcagttacaaagcaagacatgctgtaggccctgggattgcatggacagtgtccactgtcagtggagtcctgtggagggggtggcgctgatcattcagtgcggggaacaagtggtcaagacatgcttcctggggcactggctcttggttgactatttgggagtgagaaacagtggtagcctttgcccaatagaagagccgcccccaggtgattctgtacataggagctggcctaggagtagcctctggcctgaccctgacatcagggttgagttgattagggttgtgattccatcttgactactcagtctgaatttgctgagttgcaaattgaaagtgaaatcaattacatccagattcagaccatttgattttattttcatttgatcataaacatcacaaaacacgggatagagagagcctattgtgctcagttattcaaataatcctaattatgatcactcattcaaatgattcttaaatgattctttttttttttttttttttttttgaaacacagtcttgctctgtcacctaggctggagtgcagtggtgcgatctcagctcactgcaacctccgcctcctgggttcaagcaatcctcctgtctcagcctcctgagtagctgggcttataggcacacgccaccatgcctggctaatttttgtatttttagtagagacggggtttcaccatattggtcaggctggtcttgaactcctgacctcaggtgatccacccgcctcggcctcccaaagtgttggaattaccagcgtgagccaccgcgtccggccccaaatgattcttttttttaaaatacaatcttttgctgttagcacattttctgaagagggtggctctacttgagccgtacattctctggatgatgtgggcctgagctgcccaatatgaactcaagagtagcgagaaaccaagcccacaggccttatctgctccagggcttttccacctggcagacggaattgaagctcttactcgatcgcagttgtgcctgcttcacagggttgttgtcagtattaaatgtgtcaatacaaataaagctctcagaacagaagcccgctcatggtaagtgctcaaaagtggcaatggtgataatgatgatctatgagcccacctgtttcacatcctcaaaggcctctgaggctgaagctgatctcatcatgtcaactggactccttgtttcattatacaccctgactatgtcgctgaaaacaccccccaaaacatcactgaggaataagtattgagatccagcatacctgcaaggtgaattcacatgcatatgtgcaaaactgcaagcttcatggtgggaccatatcacctcttctaggagactctttttaaaaagcttgatctctatcttaagccacacatgttggaactaagaaatctaagggaggaaccccagatagagatgcagttggccctttgctgaatctcggtccttcctggagcaggcgggcagccctgcccctttatcttctggcaatacaaaggataaaagaaaacagttatcaggtgctgaggggccagatctgagccccgataatgggaatcctgaaacatgagcagcctcttctgtttgcagagtctcatcatgcaaggcagagtgctggaggtagggctataaattgagggtgaaggaaaggcagccctcctaggccctgcgtatcgccagttgtggaattctcttttgcaagaggtcactgagtcaaatgctgtggatggataattttatggccactaataaaatttatagccaaagcaagctaagataataagagtaatcaaacgtccagccctgggacataagaatcccatcctggcctggggtgctggctgggggtgctggacagcacagagaggagtttatctgtctgactcaaggccagcctcagagtctcagaggtgatttgtgtccacatgaactgcgaggactaggccaggtctggggcaagcttcagcttgggcagtaactgctgtttctctgcagacagcatgccaacagcagcaggaaaaagctatatcctatttaaatgcctaaaagcaaatcgtgagcctaagaaaagatctgaaccaccccagctctggaatactacattatggaaggaatgctaactggtcattcacgtgtgacttgccaggtgtgagggaagataaagaaggatgcaagtattactcatgcaagtataaagaaatcagatgacgtttaaccaaagagttgggtttgtgtgggggctttcccctgcccatctcctccctcttctccgagcttagctcctctctgagtttccttcccatcccagttcttcctcctgtaggcctggggcataggcaaagtgggatcttgtcactgaggccaccctgcagaacacacctcgtgacatctatagaggcatatcagtcactggaagacagaaaccctgggttcttggccctcttctcttgactcgggcctcaccgttgatggtccttatgaccacactctctaaaatggcacagcaggtaggtagccacgtggaacaagttgagaacaagtaacactctggtgttgtgggattctctctctctctctcttattttttgagacagggtctcgctctgtcacccaagctggagtgcagtggcacaatcatagctcactgtagcccccaaccacccaagctcaagagatcctcccacctcagcctcccgagtagctggaattacaggcgcgtgccaccatgcctgcctaatttttgtatttttggtagagacagggtttcaccatgttacccagcctggtcttgaactcctgagctcaagcaatctgtctgcctcggccccccaaaggcttgagccaccccacctggccttctttctttttttattgtggtaaaatatatataacctaaaatttaccatcttcaccatttttaagcatgcagttctgtgacattaagtatattcacattgttacacaaccatcaccaccatctaccaccaaaagaactttttcatcttcccaaactgtaactctgcccccgttaacaataactctatgaatttgactattttaggtacttcagataggtggaatcatacaatatttgctcttctgtattatttttaaataaaaactcttttgatgagataggtcagagaaaatccattttattgccctagtttttagtacattttattcaaacaagaacccagcaatagttaacttgctgcaatgtctactgagacgtctaaaccaaaacatgtcttgctgatgccagcttttgccctcttcacaaatcctgcttaggaaaggttcatgacactgccacagtaggcctgaccctgccagggaaaggcatcaccgcggttctgggtagctctggtgtgcgcgaagaaaagagacaagcagggtgagagtgaagtctaaatggatcaacaagtttgcctgataccttggagtcaggaagcacgggaagaaagagttgagtggaatagcttagtgaggtctgaggcctgcctgatccagaggagacactgacaaacacagacgctgcagaagaggaagccgtcccaggttaggaggcatcccagtgcttccctcctcagtgagtcatttcatctgtttctctgcctgcaaggaagaaataaacataactcataaaatgaagcatttcacctcgccgggggagtggcattgaagtgagaggcatgcatctgtgggtgtcagagcaagagtcctctgtagctgcttgtccttgacctggaaggaagggtctggtggggtgacaaagtgacatctgctccttagagggagcctgttcttggagacccctctgccagatacatttttatagtcagctccagaagtgacttgatgtggggattgagacatattcctgcagtcaaagactcatacatagaaagggacataatttttttttctttctctctcttatgagcaaagactgaataaggcttatgtggactctatcactgcatcgtgatgactggagtaaggtgccctccgtccatcatcgtcagctttctattctgtgtctgactgcagtggaacatcggcgtgatcaactctacattatttaactttgatccgggcgtgcattgtttgatcttttcctttgcagattgactttcataatttatattttatagaatacacagaaatgtattctggcatattctaagagcataacggctgacagcatagacacatcctaagacaatactaagggtttacaaattagctgtggatggtcttttccaagataattgtgagttgatttgtgctaacctggatcagaaatatttatcaagcactcactgtttacaaaactataaaagcattaagtaacagtgtaagtagcagatagcaataaaagatgtcccaaggcagtgagatattaattgtgtaagagaaaatgttattaaatgttattttctgggatttgaggagggggagcctgtcattaaatgtcattaattaaagactgagtaggaagcaattgctctccgtagatgtctctacacaggaaacggatactgtttggtgttccctgctgtcttggcagagtcagagggaggtagctttctgggtcaataatgccgtttaagatgaacgcccatgctgacacactctggtagctctcagagtccttccttcagtgtagaagttaaaggtcagcagcttacagattgcaatttgcattgtggaagcaaccttaggaagagccacacgtcttttatcttgattctgtggtcaagatggtaaccacatttgggattctctctttctttgggattctctctttctttgggaatgagtaccaagctcctcatactgaggtatcagtgtagacatttaaatgtggttgaaagacgtgaattaaaagttaaaatagaaggagaagctttatttcgatgtggcctgtgaaaagcagactttcactgctcgttaatggtgcacggaattctcatggacgttgagaatgtcacatgtacacgcacatgcacacgtgtcgacacctgcgcagacacacatgtgcaccctctccctgcagcctggccccttttgctgccacctgtattcattttcccaccaccccgagggatatgatgtgctgtttggaaagtaacagatatccttaaggagtgaaatggtcccctgtaatcaagatggagagctaaaaacaggtttcaatcagaactaaaccaaataaaatcccgtggtgaaaatttagttccccttaaagcttgtgattaggaccaccccgtgtgttttcggccactgcttttagacggtgacagtgacacatacacgtaacgaagataatgaggcctttccactagcactgtagggttttcaaacatgttagatggatatttggaggttttctcaggaagaatcatgtatctttcacagtatcgcaagagaagaaataaattcctaagagtctaacacgcagatgtaagccatagtcctttaaaaataaggctcttggccaggtgcggtggctcacgcctgtaatcctagcactttgggaggctgaggtggatggatcacaaggtcaggagtttgagaccagcctagtcaatatggtgaaaccctgtctctactaaaaaaatagaaaaattagctgggcatggtggcgtccacctgtaatcccagctactcaggaggctgaggcgggagaatcgcttgaacccggaaggcggaggttgcagtgagccgagattgcaccactgcactccagcctgggtgacagaacaagactccatctcaaaaataaataaataaataacaaaagtaaggctcttgattcagaattatgcagtgaggctcaagtttcaggagaacatcttctaatagtggactgcagggaggggctctgagggcagcctcgagttaggaagtggtcctgaaggggagagtggagggagggagatggaactgaggcctgacatgctgcacagaagccacctcagccgaatggatcagcatcccaaccgtggctcctcctcctactagctgatttcccttggggaaggagctcaacctctctgaccctcagttccctctttggtgaaagggttgaattgtcttggaatccacaggtgaccacctcaggactgcagtgagggatctgtatgcatccagtaaagcctgtccttagctctgtcttgtggctgcccacctggcctgggggccagagatggggctggagaaggggcaggcttcctccgggagctcatccccacacccagtggagttagcgtagccaaggcttccagcagagttttacatccagagtcatctttgttataggtagcagcaagaagcagtctctcctgggaagacttgctttgaagtgtggggagtcgcactgacttgtaggaaaggccactgccttgagatgaaattccaaagccaagaggaaaagtgctgttgaggaggtgggatgggaggtcaactcctcaagtccctcaaggaattcagtggaagccactcctgagaaccggctggaggtgggaagcctgaagaatgagggagttcacggtaggggcctgaggtgcgtgaggcttgtttgtgttggtctgagcagggctgaagccgtgggcccagggcctctttccttcagaaacagtcggaagtgaccaagcttcagctcctcctcctccccaggcctcggcacccaggcccggtgctgcggggctcacgtatgggaactgagaaagggaatatggagtcttccttctaggccccacagaggcctctttgacctcaagacttggctagaaacacattttggaagcttccgcatttccaagtcacagataatatttctacacacacacagacacacgctcttattttagagaagggacagaacatttgtctctggctgactacaagtttctttatctaccttcctttcaaatctcctgaggacagagactaagcaaagtttaccttttgtaatcccccaagtctgtctggtgctcaggttattcagtaaacttcagtaactgaggtcagatggtagaaggaaggggaaaaaaacgggaatcagaggcctgtgtttccagctcaacttccctacttgacggctgagtggctttggaccaatcatcggactcctctcctcgcctctgttttctcatctgtgaagtggaaacaatagccaaccagtctacataacttaatgttgtttccaatgtgccttctatgaggaaggagaggttatcagcagcaaagggatagacacatctgagggcatcccttatgctgttaatgactgtttaattgtcatagaatatggatcactgccattctttgcttgacataaaaacaactcagagacacactgtcaccgtttcagagagcttcagaaagaatttggattggagtgcttctttcatagccagatctcatgtagtaggtcattattttgtttctttgattaataggacaattcggttacaaccgaaggtactgtaaccctgcaaccctagagaggatttgcagggctgaggaagagtaaattcctattagcaagtatcttggtggcaagcaagatggcaccttggtaagaagttatccatccaactcagcactccaaagacctgcataccagtgtatgcgggaaaaaccatagccggtctaacagggaggcgccttctcgctcagaatcatctacaatggatatgattgtaattgttgaagaagctacagctgcttctactgagagcaagcctcgctcttctgtttttcagaattataaaaatggagctaaacagagataatggaagttgcttttggagcactatcttgcagactgtctttgcacaagatattgacaggaaatgtctgcacgtttcttagagcctcctgaatcttcagcatctacttttttttttttttttgcctgacatataccaagcacccaacacatggttgttcatacgaatgaatgaacaaatgaactagtagactaaaaaagaggcagctcttgatccccaaacattgtggagccaaaacactatcctttgacagtgatgaggatgggagaaaagactgtcatatcttaagaattaaacaaaataggccaggcgcggtggctcacgcctgtaatcccagcactttgggaggctgaggtgggcggatcacctgaggtcgggagttcgagatcagcctggctaccatggagaaaccccgtctctagtaaaaatacaaaaaaaaaaaaaaaaagttagccaggcacaggggcgcatgcctgtaatcccagctactctggaggctgaggtaggagaatctcttgaacccggaaggcggaggttgcagtgagctgagatcacgccattgcactccagcctgggcaacaagagcgaaactctgtctcaaaaaaaaaaaaaaaaaaagaatcaaacaaaatagaaaagcaatgaaatgttttaaagaaatgactcttacttaaaagacttaagaaaatttacgtagatacacgtgagcagtagaaagtaagaatagctcagatttatttcacaaacatgttttgagcatctttgtgtgccagccattgtattgaccttggtatacagtggtgagcaaaccagccttagacctagagacctggggcttttgtgtagtgggggaaaatgacttactattaaatgcatgatatgaaccgaagtggagatactgagggaaaagattgaggctctgtaaaagcatccagcagaggaagcataggctggaagaaggcttctcggaggaagtgaggcttgagcttacatctgcaggaaaagtgggagcattccatatggagagcaaaggccccacggcagaaggagcaggaggtgtgtttgaggaccttgcccgaggctggagccctggagtgtgaaactgagggggaggtaaattagcagttcctgtagccaaatcctggtctgttatttctgaaagtctgtcatctctgaagaggatactgggcataaatacaaatgagaacatgatcttttaggtggtgagagtctatagagcaggcatttggagggatgccctctccccattgtggaactagcagaacaaaatctaaagaatgcacaaaagaaaccaaaaaatgagctgttaggttctaaggagggagggagtgtgatggaaagcacaccatgagaaataaggacatggacctgcccccgccccatcatgacactggctgtgtctgaaaaatggagcaggaaaggcagcgtgactaggaaaatgtgcagttttaattttacataatatttgtttttttttagaaaatattttctaagataaaaaatgctaacatttgtgaatagtggtagtggatacatgtgtatgttttattattggatttttttctatatatcacatttttttaattagaaggggaagacttttttttttcttaaattagaagaggggcagttaaaggaaggaggtaggtgctaggaatggtttaagagtcagggtcctattcctagatacaaattggcttgggcaaattgcttctctggtcttcaggtgtcttatctaaggagaagagttttgaagatgatgatgttggaaatcccttctagctctagaacgttctgtgatcctgatttttaaaaacaattgatgattgaatagttctatttataggcttgggaatttggtgtctcatgctcactaatccctgattctttaaaattaggagaaacaatcttgcttggcacaagatagccaatagctttctagtcaggaagctcgtgcattgaaattcatttgcccagagacattttcaaaagctgtgaacccacaggtcgctgacatcccttctggaccagatgtgggaatctggacccacccagaaagctgtgcctctgtgtcaggcatcctgccattcaccacacgcgttccagcggctgctctctggctttgcagggcacctgcaggacagtttgtgcataaggaatcccttccctccaaattttagatgagaaatatggtaatgaaaggaaataacccaggcagagtggcttgtttcacatgtcacggtgtgtcaaaatcagatgtatgtcttagattcttgggggaaaaaaaaagttgtcgcatgaatttgggggttttgttttgtctttggacatggtccgggaggcatgatgcgcgccctggagcttcatcgatgctgttgagtggggatgacggtgtgcatcgccacatcctcagctttccagttgtttcagctgcgccctccaagctgccctgttccgcggggacaatagcagccagtggacgggagcccgcaccacacagcagcaaaggaagccggaggagaggctctgcgggctctctgctccgtcagcaggaatgtcctccgggccagcagctgcctttgcagccacctctccagtttctgtcacttgggtcaagtttccttataatgcgttaaatgaatgagaataagaaagtgtgtgttggcagaatttccgttgaataatgccaaggctttccaagtaagagcatgaatttaagcggagcaaagttcccagtcaatgggattcagagtaatggctattctgctaataatgaaaagtagaaatgtttttacttttaaaggttcacaaatgggctactcttagggctcgctggcctattcagttacaaagtggaaactgttccggatctttgctttattgcacttgtatttagtaggtgattggaaacattttccacttagcatttaagggtttgaatagactggtgactttttttcaactaaagtttcctcttttttaaaaaactgacatttttctttttttgcaagtagactgaagatttcaagtaacaggttttccaaatacttagactctgcctgcataattattatatttgccgtggggattagcacttttcaaaagtgtatttctacacaacatccttgttttgccccaaagtttgattcttcacagcttattacgtagatttaggcaaaatggaccgagctccatccactagaacttccattataaaggcaatcatttcgaatgaaacagaagccatttatcttaatgaaccagcaggaaaatgaagtctgttgaaatgatctgaacccttcaaaaaatattggtaattcattgtggctatatttatttttattagtttctctatgttgcctgttttattgactttccacagcaaaccaccacccccaccagcaccaccaaataccgttgtattttgattccttatgttctttattagcaggcttacttctctcttcatagaactatgcctttgccccactgctccatttcagagcattcggggctattcctggtaagaagccagcattagttaatgttactgttctggtcttgggctgcaaagagtgcatggataatggttcatgttttcccctccaaatggagggaagacacagacataattgaaacttacaatgtcgggggataattttataccattatttttaatgaaaacggggaagtatcctagctaaaatgctggaaaatagccttccagtagccctaagcatccacgtgtaactgaatgcaggtgggatagaaacctgttccctcttgcctccctcccccaaatagagagatgctgtcagtggtcaggaaaagcagtgagccacaggtaatgagctccgtatccattttctttgtcagatctcccagctgatgacagagagtagccgggagggactaacagaagcagtgctgaaccgctacaatgcagacaagccttccgcctgcagtgtcccagcctcgcagggctcctgcgtggccagcgagacttccacaggcacatcggtggccgcctccttctttgcacggtaagagagctgttcagatccttggttctttccgatgagcccagctggttagcccctcacgtggactagctcagctgaaacactagaaagagtttggggccgttctgtgatgtcattcattaagacagagtttctcagccatggcactgtgacctctcgggccagctaactgtggtggggactgtcctgtgtgttatagggtgggctgcagcatccttggcctgtacccctcgatgtgtgcccgcagtaccctcctccagtcgtgactaccaaaaatgtctgcagacattgtgagaggccccagggtcgagagtcgctgctctcttgatgtgtagctccaaagatgctcttttgcagcatcaggactttgtagaggcatccctctggtgggtgtttccagatttatcttctcattacagaaattgaactgcttaaaagctattaaatagatggcaggttttctcccccgcttcttgacagattagccagagtgttatcaaatactctccagctaatcttgggaacttcaaaaatacaagaaacaaaaaagaaaggtatttcaacaatgttttctgcctaattttagcaacatggcagagacggggcgggagacgaaggacagctgagcaggaaaggacttcagggattgtctggttccatctccttatttatgaatgaggaaaccgaggaccaggaaggttcaactaggagtgagtttatagcacagccagaaatagaaaccggattgctctacatttttctgtataactcatgttttaatttaatgctcagaactgaaccttggaaaactttctctgtctaagatttgcaagctcctgagtaaacaggacatagaataaatgcgatagcatcagatacgaaatcacaagaccttttgggttccagttgcagcagttctgcctcagtttcttcatgtataaaatgaggatgatacctgctctgcagggtcgctccgaagactaacataagatgatgagaaattataaagtactgtagaaatggttactactatgtcagtaagaaggaatattgtgtggctttgcttgttatctttatgaatggtaacatccagaacacaaatatggggaaggggctctgattaggacagcggcaaggcagaggaggacagagggctaagaccctggatgatgggaccctaaaggcagcacacagggcttgttggaagaccggctttgagggtcttcattgtattttggtgctgtgtttattgtcgtatgaacacttgggacaacttgaatgtgtgggaagtaataggaaatatgtataggctggccacccaacaatggggaccattgtgttagccctgtctggacatgaatctctgtgttgtcccagaccattaagcagggagtccaagctcactgggaggtcatgtccatgccatttagggagagaataaagacagggaacagttatgaggaaatgtcacaagcacagaagctcctaggaggttattagaacatgttcaaaggaggctgactaagaagccatggcatggcaggttcagtttggagaagagaaggactctggggtacatcatggatgccctcagctatctctcaggctattgtataaatggagacttggttcgttctgtagagcaaccagttatgtaggcaaaggctaaataacgagggaggagacggacctcccagctcagaatgaagaacttgcaattccgatggcttcaggagagagtgagatttgtgtccctaagggagatcaaagttatgttgagtaattacctggcctcgatcctagagggaacattcaatgctcagatgggaattgacttccgacgtgcctttctaacctgaaattctttgaaagtggagtcttccgttcagttccagccagagaattttacagaaggttgactgactcacaaggcaacccagaagatttgaagcaggaagaaataagaagtgagggttcccaattggcagaatttaaggagaacatgagttctccttaaattcttggtgcgaggaaaccagcagcgtctttggagctggggaaaggatgtggaaatgaggggggcctgggaacctcatagtactggacaaggtgtgcctgaggccagaggtcaggatatcagaggaggatttacgaacaagcaaacacacagcagggaaaggaataacaaatcactagcgaaagcctagggtggaagggagatactgaggcaaaacccaaaatgtatgggccagtgatgtcaactggggcaggctctgcaggtgatgctagcagcaaacaaagacttgaaactcatgacttcagaacgacaagggcttgcagtatgagctttcaaagagctggaaaggatccctaaggctccccaaatctttactattactttctgtgcagtgaacgctgatagtacttggagcttcatggtataagcattaaaagtatgtggtttgtattcaaagggtttacaatgtacagtgggaaacaagtaccatgtgaaaaagaacaattctttctatagatttcccccccaccctttactcattaccatattttgccatgttattctcatcattattgatgagaactattattagctgggctttcccacctcccagcgagggaggcagcatattaataacccccctgtcactgaggggcacccaaagcagaagtgtgactgactggctccaggctcatcctgtcaagaggcagaaccagggatgtacctgacagttaggtccccaaacgtccatgtgataagccaaaacctgcccagcttatgctgtcagacagtcaactgagttcaaagagccttttggttttagctgaagcaaagctgtgtaaggggatggtaatgacagcttttgataagtgtctgtcctcataggggtttggggcagagtcagctcctacacctccaatctgtgctcaccactttccactcttcctgcttgactgcaatggagagagagtcctctgagtctgcggggccctggaactctcctatagctccaagtcaagacacaggggtggcctgctttcaggaagctgtcctgggctgggcatggtggctcacgcctgtaatcccagtactttgggagaccaaggtgggtggatcactagagaccaggagttcaagaccagcctggccaacatggtgagaccccgtctctactaaaaatacaaaaattagctgggcatggtggtgcatgtctataatcccagctacttgggaggctaagacatgagaatcacttgaattaggaaggtggggtttcggtgagccgagatggcgccactgcactccagcctgggtgacagagttggactcagtctcaaaaaaaaaaaaaaaaaaggaaagaaagaaagaaagaagcaacagctatgctgggggccatttcgttttatatgggagggatggcatttgctaaatttgtggccaatgtggctgacgtatattgagcactgagtgggcatcactcactattaactacctcttcatatgcaaacccccttcatcttcacagtaaccctgtgaggcagagcctaccattttctctgttttatggataaagaagatggttccctgagttactgacccagagccacatagccgggagtggcggagtgggaaatccatcctcgtttcctctcacttgagaccccaggttcctattctctgtgctaaacagacacaggaagacactttattatagggttttttttttttcaccgtaatcatgaactgatgattgcttataaaacaggtgtgaaactactaggccctgtaatttgtttgagaaggtgagtagaatgacaataacaaaaacaacagaaaaacccccaatttgttgaagatttgaagcaggaagagataagaggtgacacatttgttgttgctcttgaggattcctacctttacacggtgttttcctgttgacgaaaaatatgtctatcctgggtctggaattttctggataaatgttggtgttcatctccatatagcgtcgctctcattcatgcagatgtccacttttctctgtgatattaacctttatttaaaatgtatttatttttattttaaaatcttttttttgagacagaatctcactctattacccaggctggagtgtagtgacgtaatcacagctcactgcagcctcagcctcccgggctcaagcgatcctcccacttcagcctcctgagtagctgggaccacaggaatgcaccactgtgcccagctaatttatttttattttttgaagagatgagtctccctatgtttgttgcgcacgctggtcttgaacacctaggctcaagcaatccttccaccttggcctcccatagtgctgggattatagtcatgagccactgcacctggcctaaaatttattcatttatttatttttgagatggagtcccactcactctgtttcccaggctggagtgcagtggcgcgatctccgctcgctgcaacctctgcctcccaggttcaagtgattctgcctcagcctcccgagtaagattacaggtgtgcaccaccacatcagctaatttttgtatttttagtagagatggggtttcatcatgttgcccaggctggtcttgaactcctgacctcaagtgatccacctgccttggccccccaaagtgctgagtattgttttgattgactaataaacattgtatatatttacggagtaaaatatgttttgaaatatgtacatattgtggaattagcctgtgtttttaaatgcttactttctagaactgtgggtggaggtctgggtgaaccttgttacatttcaaattcaatgcctataaaataagaatttcaattttgaataagcagtgtgtggtctgtgctggtccacacacggttactggtctgtgataagtatagaaatggagaggaagcgtttagaaacatctgctgatggaataattttctgtctgttgaatctaagaataaaaaatcggggcttgcattttgtgtataactagaagtaaaagaaaaattggtccttcacccggatagtttgagatgcactgctatagagaacgatggagcatgaagcacctgttctgtgcttttcttcctctcacgattgtctttaaatggtcagcatcttagtagctgtctttgcttcagaatttcagtaccttccctttttttttcgagaaaagacactgtttctggaaaaaatagtaacagtcacccagaaaagagatcgagacaactgatcgtcaagttggttaactattatgtgctggctttgaacatcaagaacatttcaaacgagggccttttttttttttttgcatgattttcacattaatagaaaatggtgaagtagggtatcattagattttcccatttgctgacagttcactttgaataaaggtggacttaatgatgtactttaccttataaagtatggagtacatgaaacccaataaaaactcttgggtgaaaccctagctttgtaggttgaggcagtggaaccttcatgtatatttgaagagcagttagtggattctggattatgcatagaattgaaccctgaaacagaaaatgaatcttttgggtgacctcatatctttgcattgattttctttcccaaataaccattaaaactcatgggttttgtttttgttttttttgagatggagtctcgctctgtcgcccaggctggagtgcagtggtgcaatctcggctcactgcaagctccacctcccaggttcaagcgattttcctggctcagcctcccgagtagctgggactacaggcgtccaacaccacacccggctaatttttgtatttttagtagagacggggtttcaccgtgttggccaagatggtctcgatctcctgacctcatgatcctcccgcctccgcctctcaaagtgctgggattacaggcgtgagccatggcgcccagctgtgtttttttattcatggagaaaattagcttctgtagaattttcatctacattcagagcaagagtttgaaaaatggtgaaaatggacaaagatcacatgagcacaaagacactgtcaagttttggcagagctggtatcgccagttccatggcgttggtgagcacagagacttccagttctgccctcagacatcacttctaaattgtcatatttttggtgttcagcttttatgtttagttgacagcctttctaccaaattctaatcagatttccaagtaaaattatattaagggcattttttattttccgtgattttatttaaattttcctgttttcttaatataaacaaatacctttccattctgttatctcaggttctgatgacttcagatcagaacttactatcttcaaatcctttattctgtttttttgctcattattgactctgttacattagttagagcttctttctctctctcccccttcctctctctccctccctcctccctcccttctttcctcccttcctgtttttccatctgctcttgaagattcctacctttacacagtgttttcctgttgacgaaaaatatgtctctcctgggtctggaattttctggataaatgttggtgttcatctccatacagcgtcactctcattcctttctctgggatccctgttgtctgctttctcttccacacttgccaagctgtccctcactttctcccactgactcctctaactccttgccgtcggcccaaacacattcctttctcaggacgtgattgtttttctgtccatctcaatctcttgtgtggtatcttccatcgttgtttttgaatggctccctgtgttacctgaacagcattcttcagtcctcttgagcatgtcactgactgttgtatgactgatttgaccagtatccccttgggtccagaggttgccgtagtgttaaaaccaagccccgctcaggccctggggtcagggctaggctgagcagagaggactgacctctggctcccaggccctgccttcaggaccacgtggcttctcttgttagttccctgtggggcctgctcttcgtgctgtgtatcctcatgtgaccatacggagagctgttactggtctgatgaccattattgccgcactctcgctgagaagcaactcagatagcgccttgctgtgatggtttcagcaaatgcttttcatatatgatcttgtatgatgaaggctttctttagtccctgggcccttaacagtggtacttggttatatgtttggagttgatgaagtcagagaaggatgggaaggagcgtggaactgttcctgcttcttttgttcttctgtcaggtacagttccctttagggatgctcccttcttccccttagaaatacatcaacaatattaccagagaaaaactaccctaaacataccacaattggtctcaggtgatctaggcggaggaaaaattgagctgggtgtctgagatccaactcctaggcgtcaattgactgtggagagacagggcacaagttctgcctccagtttcacaacttggaacagttaatgtccagcactgtttccattatgatagaatgatgcctttacaaaaacaaacaggccaggcgtggtggctcacacctgtaatcccagcacttcgggaggccgaggcaggcaggatcacctgaggtcgggagtttgcgaccagcttgaccaacatggagaaaccccgtctctactaaaaatacaaaattagccaggcatggtggtgcacgcctgtaatcccgtctacttgggaggctgaggcaggagaatcacttgaacccgggaggtggaggttgcggtgagccaagatcacgccattgcactccagcctggacagcaagggtgagactctgtctcaaaacaaacaaacaaacaaagaaaaagcccttttaggagctcatattgtagaacttcactgtattatttttttttcctgtttcttgttttgttttcactgaagcatattttgcttacccttagttccttgcacttgccagggtcccgttctgacttggtgtctgttcttttctccttgccccagtgtatcccctcgttctcacattccagatctcagtctgcctattccaggacttcccatggaagcagggctaccattgagcttcctgtgggacacttgtggtcggggccaacatgcataattgtgccatctattcacagaaccagggcgcccaattgtaggagtgagtggggcttaaatccagccaacactgtgccagcctggtggaaccacctcctctggggctctgtcaatcctccttggatgcaggtaatgtctgggctcatgttgtcctggccggccctgcctccttcactggtggccaagcagtgtcaggacatagatctttgaagggctgaactggaaggcaaacccctaccctctggtttcttatttatttatttattcctgacaggtcgtagctttactctgcttagaaaatactccgttgatttcttggaaaagaagggactctcactcatgtatattgatgaagtgaatttttaggaatcatagttctatgaatatggtctcactttaactcaccttatgaaaggaaaacattaagaagcaaccaagggtatatttagtgccatccgatttcaagggccctagaaaacagtctcaggcatttgctgtgtgaagctgaacctcctcagttgcttatgagacagcgaaagcacagaaggaaaagtggttgtaatttaacgtctacactgttttcccttctgctaaaaacatgcctaaaacacctcaaatagataaccctaacatccaatatgcaaccccagcaacccccaactgttctgttgttgggggtgcagtccgtaacagaagtggcattcatagcttggcacacaccactctgagatggtgagctacgctaaagaaaatgaccagcgtttgcggccccttcccatcttctgctgcagggaatgtggtcaggtggagcattttctgattaaacaagtcctttgtctgactggcggccggttggggtgttggcaattggctcccaacatctgggaatcatttccacggctttgcctaggttgaaaactcagttcatgtcttgatgtgaatgtctgaaggcaaagcaatttcaacaagcctcaagaatcccagggattcttgtaagatactctcagggttaaggattctagttcttattgcacattttgcattttttgttttaattgatgctgtggtgggggcgggggtggggggcagtggttaggagagaaggatattgaataagcaaacagaaagctggagaagcccaggcttgaattctcagccagacactgacattctgacttgaggcaagtaacttaaccttgctaagcttccgttgcttctgttcaatggagatcatcatatctgctttataggattatggagaggattaaatgaaaatgtgatagtccttggtaaacttcatccaaatcctacagataatgtgaagatggcacgtgctataaaaaggatggagttctgtcctcaatgaattctcaacgttcccttttgagtagatgacttttcgttgagacctttacaggctgtttaggtggccctttgttatctgtctaacgactgtccaggccttctgtggcaattataaagatctggtatcatgtctctgagaacaaaaaccacctacagaaggagctgaagagcaattcgcccttaaatctcacctgttacgaactagatgccattggtgatggaaaatatcagtgacccatacggagagagaaacctgccctcaagtagctgcattttagcagagctccaggtaggtcactgctcacctctaaatcttctgaagaggtttcatttttttgttggtttttgttttgttttgagttgcagtctcgctctgtctcccagcccagattgcagtggcacaatctcggctcactgcaatctccacctcctgggttcaagcaattcttccacctcagcctcccaagtagctgggattacaggcacctgccaccacacctggctaatttttgtattttttagtagagatggggttttgccatgttggccaggctggtcttggacacctgacctcaggtgatctgcccaccttggcctcccaaagtgctgggattacaagcatgagccactgcacccggccttgttgttgttttatagccctagaaaaactggtaccaaacaataaggaagagactgaagggaaaaaagaagatggggaggggctttaagaattctgttcccatagaactttgtgactcactgaaggccagcaagctggaattgtcgtgatactcacagtggacattaacgaaaacagtgaataaaagtaaaaggggaaatgttctttctttgtgaataccctcgtgatctgaactgggggctgaagagggaggatggggtgacatggagtagattcaggaaaagcagagtagaaacctgtgaactgaaggagaggaccaatggatgaggagaggatgcaattttatctagtatatgttgcgtaaatttgtttcctggtctacacttctaccaccaccctaatacagtaccgctataatatgtttccttccttcagcactgactcatttaaaaatcgtactggccagccaggtggtgccatggctcacaacttgtaatcccagtactttgagaggctgaggtgggaggacagcttgaggccaggagttcaagaccagcctgggcaacatagcaagaccctgtatctggagaaaaatttaaaaaagcaaccaagtgcagtggcacatacctgtaatcctagctacttgcggggctggggcaggaggatcgcttgagcccgggaggttgaggctgcagtgagctacgatctcaccagggcactccagcctaggcgacaagagtgagacccttctcttagaaaaaaaaataatcataatagcctacatttttgagggcttcttatatgccacacactattctgagttcttgacacacatttaatcttcagaagcccccatgagttggccgtgtttttatcccattgtttagacgtggaaactgaagcacagagggcagaagtaagttgaccaagtccacacaactagtaggcaacgcatagggatccgagccaggtgtctgattccagaggccacaagccagaatataagctccaaatataaggtggggacatttgtgtctttgttcttggctgaagctccagcacctaaaagaacactcaagaaatgtttgttgaataactcaatgatggtcttagccaccatgctctcctgcctccaaactcaagatgggttgcaatggacaggggtcattaactaagcagtctcaatgcaacgatctcaatgtgagaccaaagtagagaatgggtacaaagtgcaccacagaagctatagggggaagcttttggaacaactactcttttttttgagacagagtctcgctccgtcgcccaggctggagtgcagtggtgcgatcttggctcactgcaacctctgcttcctgggttcaagcaattctcctgcctcagcctcctgagtagctaggactgcaggcgcccgccaccatgcccagctaatttttttttttttttttgagacagagtcttgcattgtcgcccaggctagggtgcagtggtgcgatctcggctcactgcaacctctgcctcccggcttcaggcgattctcctgcctcagcctcccaagtagctgggattacaggcatccgccaccatgcccagctcattttttctatttttagtagagacagggtttcactatgttggccaggctggtctcaaactcctgaccttgtgatctacccacctcagcctcccaaagtgctgggattacaggcgtgaaccactgcgcccagccaatttttatatttttagtagaaacagggtttcaccatattggccaggctggtcttgaactcctgaccttgtgttccacccaccttggcctcccaaagtcctgggattacaggcgtgagccactgcgcctggcctgaccaactactgtttatgcttctaattttgttagttactaaaatatcgctttcagtctcatgcagtaaaagcaaaaggtttttcagtgacttacaaggctctgtgcacaccatctgtcccctgccctcttcctctgccatgttcccacttgcttactctgctctaggcatattgacctccttgcttttcctctaaaagtgccaaggccattccctccccctaggctttgttcttctgcttggcttaaccagaccttccttcagatctttgctcaaatgccacttccttggtaaagccctctgtgacctccctgtttaaaattacaataatcccacctgtgcacccctccctctcgcgtggtacctgctacattaggaatatttgctgaatgaatgaatctcagacaaatgggagatgggcggctaagtctccagattgtcctgcattgaagtgcttggagaagtttgcgaattttcccactcagttcaaaccacatgctcaggaattaaagtgttctttcagctttcagatgttttcgggggatagcattgtaacaaagcatgaaaaaaagcagtgttgggaaattgagattcttattacagtgggagtacctggttgtcatttcaagatgaggatttgttaagggatgggacaagggatgctgcctgggacaataaaccaaagaaagatttaaaacagagaaaagagttattagttacaggactagcacaaacaaagtagggctctccatctttttcctgtctcgctgaaaacccatcttttcttcccttgaataaacttctttgctttctgtccccctgctttgatttattattttaattctatagctgtcttcgtgaagtatgtaaagcatttgggggtaaaatcatgtggaagacattatagaaactaaagatgtgtgatattatgtggtgttgggtagaggctcagcgtgcttatgaatcacacggttgatgaaaacaccaatctgtccagggccattgtctatcagctgtataagaaattggctcattgttgagggtacaagaaggaggaatgtaagggggactgccggaataattcggttagaattcggtaaaaccggagcatggagaggtctggttgacatccctcctttttatactgagagatgtccctgaaggtgaggtttttattttcttgcctctaaaagggaaataatgaatgtttctatttcttctgtcctattactctgtgatgaatgcttcttttatttttatctgagtctaactccctccaccatacttagcatcatgcttgcatcatatccattaataaatggatgttgaaagaatgaatcaaccatgcttgaaaacttagatctctcttgcttttcaagagactcaaatatttaaaagcagctatggagccgtgtgcggcggctcccgcctgtaatcccagcactttgggaggccgaggcaggtggatcacaaggtcaggagttcaaaaccagcctggccaacatagtgaagccccatctctactaaaaaaaaaaaaaaaattaacagggcgtggtggtgggcacctgtagccccagctacttggaaggctgaggcaggagaatcgcttgaacctgggaggtggaggttgcagtgagccgagattgcgccactgccctccagcctgggtgacacagcaagactctgtctcaaaaaaaaaaaaagaagaagaagaagaagaagaagtaagaagttatgggattgtgcttgcaagcagcacagtttattgtgtagcatcagagttttcatcattccaagtattagtgataaaaataattctgaaggataaatggcatattttccattgttgatttcaacacagttagactcagcagtgcaccatttctgataatcatctatcattttactcagcatatgcaaaaaatgatcttagcatcacatggcaattagatgcttttttttctggcacctggtgtgcttgttcatgaagtgcactgagattccggaaatataatttcaaaagcctagaaataatggcccatgtcattttcttggcattcttcaaaaccaaagccttaagagtccatggtttgtccttttaaaccccagcaacggaaagaaagggccttggcagtgacaaagaaagagaaattctcttgggggtctgtagtgaaaagggatgtaatcagtaccaggcaagccactttgattttttttttaaaaaatgaacaaatataaaccattactcaaaatttctttccagtctttttggtgcttcagaatataaatgtggctcatttttctctaataagtttccatttattatcatagtcatctcttcagtgctcaatcaaagtggcaaggttgtatttgtggagaaaacagaatattttgtaacatggctatcctgaattttagaggcacttactagggatggaaaaactggtctgaagttcttaggcatactcttaccacctaaaagtgttcagcgataaaaataattgctttgtttttacctttgaggaactccaagtatcaggttaaaaattgagagaggtagtgaaagagagtcagtgattccagtgtttcagaaagtctgacctggccagggtccagctgggctgcaagaacctcctttctctccctgtctctgcagctccatcactcaccattctctccaagtcccttgggaatacatggggagaacctagtggccatagcagatactgctggtccccctcttcccccactccttgccacctcatcatttgcttgcacaaaaccttatggttctcaaggcccagcacctgtgactctgcccgagggtttcctctggctgtgggagccccctgcacccacacagggggcaggccacttgggagcaggcccaggtaagactggcaggagttggtggataaacaccccagctctcttgtctctaggtggggataattctgaggcatggtctactctgtctcccatatttccctggcaggattgagccccagttgtctgtgtccataacctgcttgagaacacagactctggtatcttccttccttcccttctcccttcctcactgtcttatggctgttacctagagtcacctcccagttaacctaccagcaccctcatccttgtacaaggatatgtctgagggaacttggtataagatattggaagtatatgctcttttgtccatccatccatccatccatccatccatccatccatccatccatctctccatccacccattcatccatccatccatctctccatccatccatccatccatccatccatccatccatccatctctccatccatccatccatccatctctccatctacccatccatccatccatccatccatccatccatccatccatccacccacccaaccatccaacaagcatttggtaagctcatgctgtatgccaggtattgtgttaggcaccgaggagagcaagaggacagccaccgccctcagggagctctcagtccagcagggcagccagtcccaggataggacagtgagaaaggacatggaggttcaagacagaaaaattcataaagccatccagtatggcttttgctctcccggtgtcttcaggttgtttaaaaattaaaggtggctttccagcacctattattatcagaaatggtcttattggttcacttgcttactagtccattgcctgtctcccttcctagaatgtaagatccatggaaagaggtacttgtctagcttattccatcattgcttcctcaactcttagaacaggggccaggctggcgcatgataaacatttggtaagtgcatctcatagtcattaaggcgtctgctgtggaaagtttgtcagtttcctcctgttcctcccggagtaagctcatccatgttgaaatatacccaagctccactctggatgcagtgttccagtgcactgtggaagtctctgctcaggacaggagggatagcaagtgtgctgcccaccctaggtccgaggtggccacttcctgctagccactgctccttgggaacaaaggacacttgcccaagtgtgtccctaaggtgagcgctttagcatcaagaattattcaactgaaaggagttggccggacccagtggctcacgcctgtaaatctcagcactttgggaggccaaggtgggtggatcacgaggtcaggagttcgagaccagcctggccaacatgacaaaaccccgtccctactaaaaatacaaaaattagccaggcgtggtggtgcgcacctggaatccgagcgacttgggaggctgagacaggagaatcacttgaacctgggaggtggaggttgcagtgagctgagattgcgtcactgcactccagcctgggcgacagagtgagactctgtctcaaaaaaaaaaaaaaagagttttcttctaaatagcttgctgagtttctctattttctttgtacactgaattctaaactctcagttgggagattctgccaatgaaacactctttgcagtctcctacctctgctacctgggcttgcttgatgctgggtgatgaaccacccaggtacctacacaacaccctggttgtcagcagtggcagtggaaaggagagtttgaatttggaatgtagacattttgtaaacaggttcagagaagtaactgcccaccgtcctccccactgtggtgtgcaaagctaaagagctgactcatgtgatcgtgggggttggcaagtccaaaatcggcatggctggagattccagcaggagttgatgttgcagcctggagtccagaggcagtcttaaggccttcaactgattggatgaggcccacccacatgaatggagggtaatctgcttttctcagagtctactgactttaagtgttaatatcatctagtaaataccttcacaacaacatctagactagtatttgacaaaacaactggacaccgtagcctagccaagttgacacataaaattcatcacctcaagaatcagcactaggtttaacatgaaaacaacttgtatttagtgcaatttatcaagtgcatattgagactggctgaggttcttcctggaacttacttctctctctcactttctccctctcttttttttttttttttttgtgagtcttgctctgttgtccaggttggagtgcagtggcatgacctcagctcactgcaacctccacctcctgggttcaagtgattctcctgcctcaacctcccaagtagctgggattacaggcacgtgccaccatgcctggctaatttttgtaattttagtagagatgggattccgccatgttgcccaggctggtctcaaactgatggcctcaagtgatctgccagccttggcctcccaaagtgctgggattacaggcatgagccaccgcacctggcccctggaacttatttgttagtattcaggctactgaggtgttgcacctgcagactctcaggtggcactcacccattctctctctctgccgagctcccgtgttccatcctttgttcctcagtgtccccacctgttaacgtgttgaatgtaatccccgtgtcttttggataaatcagagaatcccatatcatttgttacttaggatcctgagcattcagttttagctttcacactaaagatagagaaaataaaaatagataccattaatctttacacttctcctgtggtcctgattgccaaccatagtctgaaagatctgcagtggatttattactttgcatgttctttatttcctttaaacccgggcgtgtgaggaacgttgatttatggagcctagatcatgcttggctggggaatgggaggagggaagcaaagtgttgttcaagctgcagtaaatttaaacatcactagtatttctttacacatgcaagggggaaaagtcctaacttaagtccattgctacaggagctcataaattaaaaataacaagactatttcctatacacctggagcttcaaaattacatgccgttaattctttgattgcccccttcacaaaagagccattgagggtgacaactcaaacaagatctccaccacagccgtgaaatccaatcagtgattcaccttgtgtctttgaccttgttcaagataaggaagtgacttgtctgaaacatagactctaagaatttagtcccattatttttttcctcaaacttttccctctcattactctcttctctctctctcctctctcgttttattttttctaattttacataaattttaaaacaaatctaacagcatcagaagaccaaaacacaggaaagtcttcttgactttccactatgttctgagccataaatcctttcgtgtgctcaaataatacaccccagctggtctgttggatgaatttggttagcctcttaaatgttttagcacctgtacaccacagagctcccaaaagcgaggaaattatgtttcctcctgtccccaacggattgcttttcacctgggccatatagctgctgtgtgccactttacagaggttaagactgagcagtcctggaggacacagaaagctctaaagaagtacagacacaacttcaagtcctcatatattttacttcttcatcttgttctttgagaactacgtttactttctttgagaaaatgcataaaggagaaagagaggatatactttattttgatttttagagaaccttgaaagtgtcatgccagaagcggtggaattgagttttcactcttataccacccagacctttcactctaggtatataccaaagaaaaatgaaacgaaggcgtttgttcacgtcgagacttgcccgtgaatgttcatggcagtgttattcatcaaagcccccaaaatgtaaactacccaaatatccaccaactgataaatgaatagacaaaaaaaacatggatgtccattcagtgagatactcttcagaatcctcaaacgattgctacacgcaacatgactgaatctcaaataatgatggtaagcgacggaaaccagatcccacctctacagatggaaggctacatatgctgtgatttccttcagtgcaggatagacaatagaaactaatagagtgacaggaagcatatcagtggttgatgggaagtgagggtgggagggaggaaccgattacaaagggctgtgaggaaatgtttgggggtaatggatttgcttatgatcttgactgtgatgatttcacaggtggatacatatgacaaaactcatcaaagtgtgcagtttattatatatcagttacatttcactaaagccaataaatgatggccaggcatggtggctcacacctgtaatcccagaactttggcaggccgaggtgggaggatcacttgggtccaggagtttgagaccagcctgggtgacatggcaagaccctgtctctacaaaaaataaaaaattagccagacttagtggcatgtgcctgtagtcctagctgctctggaggctgaggtgggaggattgattgagcccaggaggttaaggctacagtgagccatgattgtaccactgtactcgagcctgggcaaaggaacaagaccctgtctcaaaaaaaaaaaaaaaaagaaaaaagaaaggtaataaatgaattttgttgggattagagaaaatgttttgagatggggcgagaattgtcttaaaaagtaaatagagttgcaataagtggtcgttttcctctggaaggaaaagtgttaataataggaacccctatgaaatgtattggattggcctcattaactattttttcccccaagggctcaagataagaaagtaccacgggaaatctccaaattggtacacaaatctaaattattttaggtaataaaaaatcatcaaagtagaataaacgggaagaaatgagcagaggagctttaatgagagcaaggagaaacattttgggtaaaataattcaaattattcttatgagatgatagacttggagaaactgtttataattgaggaaggggatgtaaggactttgttgccagaagattcagcctaagatcaccaggagtaactaaatgtgttggacatcatcggaaagaatattgaaaatattgaaacaaagtgaaaggtaccaccttacccttgggcaaagtgaacacttctttcaacctagaagttcctataaagttctgacaggccaggtgcggtggctcacgcctgtaatcccagcacttggggaggccgaggcgggcagatcacgaggtgaggagatcgagaccatcctggctaacacggtgaaaccccgtctctactaaaaatacaaaaaattagccgggcgtggtggcgggagcctgtagtcccagctactcgggaggctgaggcaggagaatggcgtgaacctgggaggcggagctcgcagtgagccgagatcgtgccactgcacaccagcctgggcgacagagccagactctgcctaaaaaaaaaaaaaaactaaaaggttctcacaagttcaacttataaaagggaagcaaagcctggtgagcgggtagagactcccatttgagaacgggcatttggaagaactccctagtccggatgacaagagctagggtgcaatctgagtagctcatttggcacgtggatagattattcattaagttttggaactatctcttaagacggggaagaagcagccttagggaacaacaaaacaagctgtattccacatcctaagacacagtaccgactgagaatataaatctgcaggtccagattaatccacagatggcaggctgcttgcaagctattagacaaagccaggggtgttcgggagcagatccccaacttctgactccatagagggtcacagcctgcctctcttgcacagaaagagatggaattctcagctaagtgccacaggacttctgtccaatacactagcccttctagtctgtttctgaaatagtcttttctacatcattttttaaagcggtccgttattccgagcacttttatcatgtaacacatcagctgccataaaagcttgaaggtggctgaaagtgggcgaggatctagaagccccttgggcaagtccagattggaaacacgtcatgggacctccttttagggacagtctcacaggcaggctgccgtaggatgacctcaggtgtcccatgttttgggtgggaatgtcaacagagcagatgcgagaggcatttcacccaagcacctggattgtttcatgcctgaaaggaggcaagacaggaaggtataaaatccagatcggtgcagttgctcagaaaagggacaggtgacggcctggcgttctctccttggcttcctgtggaatttcaaagttactgctttgggattgtgaactccagccatctgcgtgcttggaacctggagagcaatccagctggtgtctaccaccgtaattaagaggggtgtggagcatgtaggtgttatacacccctgccaatcaccaggaaggagctgagtgtggaattcacatttgaaagtgaagatgcaggaagcctgatagctcccaaaagaaacggccaccagattttgtttaaaacaaacaaacaacaacaacaaaacacacaaaaacaacggaagggtacactttagaaaaactattgactttttcccaagatatctgtacctcagccacaactacaaaaaagagtctcttcctctgttgctggcatctagtctgctgtaattgtagaattttctgatgctccatggccatcgttgcttctttgtcctccccactatttcatccgccggctcctgggaggggagggttccagttcactcggctaacgtgtgtgagtccgacagtaacgagcaacgcagaccccgggaagaggaacaagaataggacattcctatatttttatgtggagattgataatcaaggctaacaatcctggcagaaggtgaacaacacattaaacagaggggaaaagataataaaatatctcctgatgcttaacaatcgttgggtggaaacattccctggaattatacagctgttgcatttgatggctcataaagcctcagtaaagtccgtcaagggccttttttcttggcgagggaccattcttctcatgcggttatgatagcatctgcttcctgtccctggaagtgcacagaatccacagacactggcagacggaagcaggggaggagccctactgcagaggcatctggccctttgatggcttttgggtaacttctgatctacagggcatcgtatcaaaatgcagactgagatttagtgggtagccagtgagcacttgctaggtgccaggcactggcttagggtatttcattaatcctgacaactatgaggtcagtattaccatttttaaaacaatactatggaaaacagagccctagactccttaagaaacatacccagggcatgcggctgacaagtggcaggctgaagtccccacgcctggtagccttttttctgttactgcaaagatggaggaagaggcgagagttgcttcctgtccgtgctctgggtacgtgtgaaatcttgtgcatcttcttataccgggtgttcaggcacatgtgtgttgagaagggatgctgttttccagaagactcaaaaacaatgatgggggtcctaggtgacttactgttttaggtcggggtccccagaagcagatcttgatgaagtgaggatttctctgcaagtgatttattaagaatgtggtcctcagggaaactgggaagggagtaaaggaggcaggaaagggaaagagacaagccaaagatgagtcctttctcaggcaaaatccggtggacagcggcttttagcttcagcctgaccatactggggaactctgggggtttgtcctgatgggaagcagcagaggtgagcggtcatctccctcactgttcaccctgcagtcatctccctcactgttcacctagagctgtcatctccctcactgttcacctagagctgtcatctccctcactgttcacctacagcggtcatctccctcactgttcacctacagcggtcatctccctcactgttcacctacagcggtcatctccctcactgttcacctacagcggtcatctccctcactgttcacctacagcggtcatctccctcactgttcacctagagcggtcatctccctcactgttcacctagagcggtcatctccctcactgttcacctagagcggtcatctccctcactgttcacctagagcggtcatctccctcactgttcacctagagcggtcatctccctcactgttcacctagagtggtcatctccctcactgttcacctagagcggtcatctccctcactgttcacttagaggagaggtcatctccctcactgttcacctagagctgtcatctccctcactgttcacttagaggagaggtcatctccctcactgttcacctagagctgtcatctccctcactgttcacctacagcggtcatctccctcactgttcacttagaggagaggtcatctccctcactgttcaccctgcggtcatctccctcactgttcacctaaagcggtcatctccctcactgttcacctagagctgtcatctccctcactgttcaccctgcggtcatctctctcactgttcacctagaggagaggtcatctccctcactgttcaccctgcggtcatctccctcactgttcacctagagcggtcatctccctcactgttcatctagaggagaggtcatctccctcactgttcatcctgcggtcatctccctcactgttcacctagagtggtcatctccctcactgttcaccctgcggtcatctccctcaccgttcacctagagcggtcatctccctcactgttcacctagagcggtcatctctctcactgttcacctagaggagaggtcatctccctcactgttcaccctgcggtcatctccctcactgttcacctagagcggtcatctccctcactgttcatctagaggagaggtcatctccctcactgttcaccctgcggtcatctccctcactgttcaccctgcggtcatctccctcactgttcaccctgcggtcatctccctcactgttcaccctgcggtcatctccctcactgttcaccctgcggtcatctccctcactgttcaccctgcggtcatctccctcactgttcacctagagcggtcatctccctcactgttcacctagagcggtcatctccctcactgttcacctagagcggtcatctccctcactgttcatctagaggagaggtcatctccctcactgttcaccctgcggtcatctccctcactgttcaccctgcggtcatctccctcactgttcacctagagcggtcatctcccttactgttcacctagagcggtcatctccctcactgttcacctagagtggtcatctccctcactgttcacctagaggagaggtcatctccctcactgttcacctaggatggttgccgtggggaggaggcgggtggtgaatcccaggccttttcagcggccctccaggcctgcaggttcaagcaggctccagtggcctgagggcaggcctttgagaaagaggctgactgttagaagcagaagcccttgaaggagcacacagaaggggtctgggctaagcagcagcgtggcgacctacacccgcccctcctccgtaccttgcaggaggcagcgggtgctgaggaaatgggaaaagagccgcaagattaaccagatacccgtggtattttcaagcaacaccatctgctgtatttccacagaaagggtgttgattttcctgaattctagaggtggtgttttcatcactgagttcagatgcctttgattgatgagccaccttcaaaccaagtcagcatgaaacagaagcttgggttagttcacgttgtttgatataataggacaaggcagactaacgtctcttgagaatgaagggaagtttttcctacataaacttccacattctctcacaaggtgggaaaataaaaagggaaaatgacgtgaggggttgcccaagacagggatccttcccatctgaaaccatgctgtgacatgaagtgccacagattccaaaatccacgtgtgtctttcttcgaaaccaatagccacgtgtaaaaaaaattatatagcgtataaacccatagcagcaacattttaagtggaaacagatttcttccattttaaagaaatgtcaactgtgttagggagtctggggatccctcgcatacatcccagctgaacatgaaccccaaattcctgtgtaatgtatcgcagaatctgtcctttgctcacttcgtatctgtcatcaatcaacactgcagactctggaagcaagcatgttatggttttactcttgtgactaagcggagacaagaaggcatttttctcctccttgggctgtttggaaagcatagaatgaaatccagggcatggtcatcatgaattatagcgcagccaggctggtctagaatctctcatcttccaggcaaccccagccttggcagcaccatcaaagggtcatggataacaattttaaaatgcagtgaatgaaagtgttcatatgatgctaatggaatcataatttttaaagtgtcctcatcctttagagatatagactaaaatactggcagatgaaatgctatgattatgggacttttgtcacagtaatactacagagagaagtgcgtgcgtgcgcgtgtgtatgtgtgtgtatgcatgcatgtgcgcacgtgggggggatacacatggaataagattggttatggattggcaattgttgaagctgagtgacagacacataggctattctatttttgtatatgtttaaatttttccataataataggtcaaatagatcataagcatagtgtatactcacagatccctccagaagaatctaaatgcccagctacgctggtcaccgagtatccgccttgctctcccaggtgtccataagcccctgccacagggctggtgaggaagcctggctcccagcttgtggctacctttacacccatcactctgctctcctcccagaactccattcctccagtcacagggcccccagcataacaattccattagcatccttccctcccttatttcttgcaaaattactcttatcatgaattccagggactgtgttcatttgagtggcatcatctattactatttcatttaccccatcacatttctttttctcacataaagatacagtcatttgtcacttaataacatacacgttctgagagaggcattgttaggtgattctgtcattgtgcgaacatcatagagtgcacttaacataagcctaaatggtgtagcctactgcacacctcagctatatgatgtagcgtattcattctaggctataaacagtatagcatgttactgtactgagcgctttaggcagttgtaagacagtgctaagtatttgcatatctgaacatatatgaacataaagaaggtatagcaaagatacagtgttatcatcttggggactacagttgtgcatgtggtctgtcattgaccaaaacgttgttctgtgacgcatggccatattaaggtatacactgggtttggctgcttctatacaaggagtttggataaatttcatatagtgtcagtcaaaaaagtataagaaaattaagccaagtataagaagctgtgatttgtcccagacatcatgacctcagaaacagagtgtctgtgtaggtgactgctctacaataggctcaggaaggcatcgtgtctgagggcccaggctacagactcctaagtgtgtttttagcccccaaggccatctccttttggtcattatggaaattctggagcttaattaaaaggaacctagagtgcaacctttagatttaagagtaatagaaagaataactccaaaacctgtttattgtagggcagttaactcttatgtgagctcttcatctcatgatagaaaagggtccctggtggaggggtctgatacaattataattctgctctcccccaatccccaaagcatcaaaatagaactctggcccctctcattatatagagaagcaaatcgttactgtgatcactagggagttcccaccagcattgctgtgggtcctgaaagagaaaaggaggttccatgatttgggaagtaagtttcattttctttcatatttggagagatagtttctgattacagccagtggtctcttctgtaaatataggtgggccatggactctagagactctcaggatataatctgaaggattgattgcatatgaacctgcctacagatgcagctcttggttctgttttggctttgcctcctcccctcactgtgtggtgggtggagctggctcctctcaagctggtgccttcctggtgtgcttgctgctgctgtggtgcccgtggcccatctgaattaacatcttctgcggtgctttagggtgctttgcacaaagtcacttgagactgatggtgctaaggactcatgggtaatggtctagtcttaatgttctaattcaatccaatccaacttttttgttttgcatatctacaaagtgcataggaatatgcttcgtactgggaggagaactcatagtgcttaataaggactgctatggtctgaatgttggtgtgcccctacaattcccatatgggaaacttgatcttcaatgctatagtattaaaagatggagcctttaggaggggatcaggtctcgagggctccatcctcatgaataggattagtgcccttatcaaagaggccagcaggaacttgtccctcccttcgaggtgggaggcggggctggactctggagctgggctcagacaccagaccaaaatgaggactagataaaacagggaaggggcaaaagcagcttttcataagacatgcccaccagtgtgccatgtccgtttactattgtcccaacaacactcaggagttaccgcccctttccgtggcagtgaccccacgacccagaagttcctacccttgtcctagaaatttctgcataaactaccccttaatctacatgtaattaaaagtaaatataaatatgactgcaaaactgccttgagctgccactctcagcacactgcctatggggtagccctgctctgcaggaccagttatggacctgtaacactactggagctgtgacaccgcctctttaataaagctgttttctgctaccctaccaccagctcgcccttgaagttttactgggtgaagccaagaactcttgtgggctacgccccactttggggctcacatgccctgcatcaccttttgccataggaagacacgttgaaagcactatccattagtaatggcccttgccagacaccaaatctgctggcactttgatcttagacttcccagcctccagctgtgaccaataaattccattttatttgtatgttttttttgttgttgttttttcttgagacagggtctcactctgttgcccaggctggagtgcagtggcatgatcttggctcactgcaacctccgccactcaggtgcaagcgattctcctgcctcagcctcccaagtagctgggactacaggtgcacaccaccacacctggctgatttttttatttttttggtagagatggggtttcatcatgttggccaggctggtctcaaactcctgacctcaggtgatctgcccacctgggcctcccaaagtgctgggattacaggcatgagcgaccatgcccggcttgaattctgttgtttttaacttacccagtccaaggtattttgttatagcagcaggactggactaagataaggactaatcttagtaggaaggaattaacatggaccttgtgagttatggctgatgctcaaaagcctggaggacgccttgcagctctttccacatggtgtgttctggaaacactgtcttaactcctctcagtttggtctggagtttgatagtcatgtagatttgggattggcatcacaacctatagtcaaagtgatgaatcctcttgcataacacaactactttgcattttaataattttaataactttgataactaaacatttactcaaaaatgtatttcttgaacatctatggagtccagatattggggtctactaggctttggctgtccttgtgatttttaaaaccagaagcacccagaaactattaaatccttaaagcaatacaaaatattcacagccatagcatgctcagtagagaacctctaatgcctgaaacaaggagactgtttactttagcacgtcagtacttgaggatttattctgtgttgcggcttctggcctgcgagttcagaataacatgatgtggatttggaaccaaaatgaacacagcaacagacagtctatcacgataatgggaaggagctggagtctgcagctgccatcggcatcaaagatctagcttttattgagctctctatatcccgacagatccttgtcgtatggaagtgatttgcgtaggctgagaacagtggggtgaaaagaaccagggcatttctaaaaaccagtgagagcaatttacaagcctgagccaagaaacaagctggacacaccacaaaggaaatgcattttcccagtaactttttttttttggaggaggctttagagggctggcctgtgaattgcatttgtttatgaattgtctagtaatcacttgcattgtcgctggatcaggaggggctgtattttcttcccacacctgatttccatgattcagtgcacctcaagagctccatttgtgtcaccttctctgtggctgacgtgtgcgtttccactttgtactgttaatcagttaagtgaatatgagctgggaagtgtgttcaccaaacacctggctagcccgaagctctttacatttgacaaaacgggagacagaaattagaatggcttttctattttagtctagattatggaattctgtaatcaagattactttaaaaccatcatttgaatgaggaggtaaaatagccttgatacttcactgctggagaggaacaatagacaaactcaaaagacaaaaacatgaattttaaatgacagtttgtcccaaggacatcgtcatactgtgtgctttttacagtctgcttgttatcttatgcaattattgccaatgtgttttgctaatggattcattgcaagtggacttaccctacgtggaatgaggaatgtccatatgtggtagatgtgttatttattgatgaggagaggaaagtggatcaatgtggtctttagatgtgcgtgctttgccttgggaagcaccagcattgtcgtctgaactacaattggtgtgtatctgggtggaatgtggtacccgtggtgagtttgcttgttctctttccgttggcccacttgcagcaaccaactgttgcctggactcggtattttgggggccattttctcttacttttatctgttggccttgtggttccatctgtaggttgctctctccgtctagcttggaaacaacataatgattccttccgaatcactggattcacagggttgagggacttgcctgccactgacattcgttgactgggattagaatttgaaaagattttcgctgttgcctcaggtgttctgaaaggtggaatgaatcatttccactcagttttaatgctagagggagaaaggagtcatgttaattagatgggaaagatgatctaatcctttctcaaagagcctttctataaggtttagggtactgtccagccagcctgcggctgcgtgagactaatgatgggtactgggctgttgttccatttctgctaccattcattgttggtgcctttggtaaataattccatttcattgtgacttcatcttctcattgggaaaatgagactggtgatgttgcgcctcttgggttaggcgtattctgtggtaggatttagagtcaaaagtgttttttatactaaaagacactatggcacatcttcgtaggacattagcttttctttgaagatctggtggtggggggaaggggaaccattttttgaacagtaaaaaataaagagatatagtatggaaaacaatgtgaaatgtgaatgaatttttaagatagatattttaagatgaatttttaagatattttaagatgaattttaagatgaatttttaagatagatatgctgctaagtaatttcttgctagatttcaactgctttggggtgtgtcttcctatggaaatgaattcctcgtgcccacggccattacatttcctacaacggaaactttgacttttgtttttttttgaagagacattttgacttattttttattctaccgtttttctatttgctacctcatttatttctacttctagtttgttattttcttccttctgctttatgttattcttttttgtaacttttagaatttggaatttaatgctttttaaaatttttatcaatataagtatttaggccataaatgtcccactgttcagtactttaattgtattttatgtattcagatagatagtgtttttattaacatttcgttttagaaattctgcaatttgggtttgtagttctccctttacccaataattacttaatatcaaatttttaaatttctgagggtaacagcctctttgttttattacatttatttatttctggttgtcttctattatgatcagataatattgtttttattttttaatttatgaatttattgagatttgctctgagttagttaatgtatagccaatttttatgaatttcacttgagaaggtgtattctcctttgggtacaaagtataatatgtatccagaagatctatcttttttttttttttttttttttttttttggtttttgagatggagtcttgctctctcacccaggcaagtgcagtggcacaatctcagcttactgcaacctctgcctcctgggttcaaaaattctcctgcctcagcctcccgagtagctgggattacaggcacccgccatcatgaccagctaatttttgtattttttgtagagatggggtttcaccatgttggccagcctggtcttgaactcctgacctcaggtgatccacccacctcggcctcccaaagtgctgggattacaggtatgagccaccatgcctggctaagatctatctttttaaaaaaattatttactgtggcaaaatacatttaacctaagatatgcgattctaagcatttttagttgtacaattcagtggcattaattacattcacattgttgtagaactatcaccattacctgttttcaaaactttttcatccctccaaacaatctctgtaaccattaagtaataactccccactctcctcccctcaacccctggtggcctccaatccactttttgtttctgtggatttgcctactcataaaagtggaatcatacaatatttaaccttttgtgtctgatttatttcacttagcataatattttcaaggtttatccatgttgtagtgtgcatcggaattttattcctttgtatggctgaataacagcatatcattgtatgtattatatataccatacttttttatttatttatctgttcatagacacttggactgtttccatctttggctattatgtaagtaatgctgctatgaacgatggtgttcaaatatctctttgagtctctgtgttcagttcttttgggtttataactatgagtggaattgccgagtcatacaacacttgtatgtttagctttttgaggaaccgtccaactgttttccacagcggctgcccattttacccatcagcaatataccagggttccagtttcttcacattctcgacagtatttattttccttttttttaaaaaaagaaaaagttatggccattctattagatatgaggtggtatgtcatgattttgatttgcatttccctagtgactaagagatgatgttgatcatctcttcatgtgtttactggtcatttgaatatcttctttggaaaaaaaagtctattcaaatccttcgtccattatctttatattgttgagttttaggagttctttatatattctggatacaaacatttatcatatatatgatttgtaaatattttcttccattctatagtttgtctttacacttttttgataatgtcctttggtgcacaaaagcttttaattttagtgaagtccagtttatcttttcttctgttgcttgtgcttttagtgtcatatttaataatctgttgtcaaatcctaagttgcaaagatttacctgtatgttttctcctaagggttttatagttatagctctcatatttgggttctttacctattttgagttaattttttgtgtatggtgtgaggtaggggcccaacttcattcctttgcatgtagaaatctggttgtcccagaacactagatctgttttattgatcatgttatttagatcttctatagctttatttttttaaaaaatctccctgaattaccttggactaagagtggcaatttcaagcagcattattaagagccatacagaagcctgaggcaaaaggaaaaatcagtaatactgcatcctgtctttatataaaatataaaattttcacattttattcatcacaattttttgcatttatttttattttttaaagtattgcattaaaagattattgattttggttcctgagtttttgccatcaccttgaattatgtgaccaagaagagtgccttttcaccttactatagtcccagccctggggtaaaggctcctaatttgagtgtgtttctgtctatgtcttcttgcagctcatgtggttttgcatttttgaaagcggttgccatgtatctggtataaaaatattcacaagtgttttacttctgctgtaaattgtgactttttctattacagtgttatttgtcgtaatactttttggcatggattctgccttgtctgttatcaggattacaaacgataggggaaaagataagacactaacaagtcttcagtttaccaatgatgaaatcagggcccaaggactctggcaacagttgaaagaattatgatcattaagttaaaaatgtttattacttctaaatcctgatattaaagtaacagcccagcgtacttccatgtagaaatgatgtcattctgaaatggtataaataaaaattatagtcaatattctcatcatgttcaagcagggcatgggccacaaacccacctaaggacctgggaagggcgggtttcaataaccttcaggctgaatgccactcatacaaataagaagcgtggaagctgagggaaggccaatcagttgaagtagggtgattcagcccactcaatatttgaaatattggttttaatgagatcctagggctccattttagagctactagaagttttatgagtgaagaagggagctgttttactgcactatacagagtctccttatctttcccttttgtcattcttgccataaccttatagcctctaacttaatcagcctggcttccttcacgtaatacagcagcacttaacattgccttcttacttttcttctaagtagttctagtttctatgtctgagcatccagggaggtaaatgcaaagaaggatggaaataaaatatggctcagctgtggcctgagcagccccttccaaatgcactcacggcttctctgcacatcttgatatgtgaatgggaaagaaaaaaaagcacattttggtccagcaggttttcttccctttgtctccctctgaggtgctcagaggcatcagtaacagagcaggaaggccctggccaacaaaccttagccttttcctttgataccttccattgggagccttcatacaatgcatttgaaagcactttgtcagcagactcctgcttcaggcaaacattgagaaaactattgaggaggcctcaatggaaaggatctgatctgccccagaaactgccctagttctctggcaggagagccaccagcaggagaagagaagtcctctctcctaccccattttttttctttctcctttttcctctcctttctattgtaagaattgtgggaactctctttaaatgaaaataactctcaggctgagctttgtctcccaatgtggataaatgcccagatatctcatatcccctctgtaaagctggagtctcagttttggatgatcacaaactatttgggacaaatgtttgagctcaaggagaaacacatggtaggtggtgtgtgcatagctttttctaaagcacctaaaaattgaatacttgttcatcagcctactgcttgcaagccctttgctaccacttgctggtctgttgtttgcgcctctgcaggctggctctgtgtcatgtttgcattggtatccgatctctccctgcaccaccccttgctcgattttaattgaatttaatgatttctgaacccctaagcgtctatcactttttaaaatccatactacaggccgggcatggtggctcacgcccgtaatccgagcactttgggaggctgaggcgggcagatcacgaggtcaagagatcgagaccatcctggccaacatggtgaaaccccatctctactaaaaatacaaaaattagctggggatggttacacgtgcctatagtcccagctactcgggaggctgaggcaggagagtcgcttgaacccgggaggcggaggttgcagtgagtcgagatcacaccactgctctccagcctggtgacagagtgagatctgtctgaaaaaaacaaaacaaacaaacaaaaaacaacacacaaaaaaacatactgcattagtttctacctacagtttcagtataagcaaatgcttaaggtgacgatgccaagagaaataaaagctctctttagctgccttcttctcccgtcattgagaagagccttattagatacagatggatgaatattcaagaagccagagagtgtgaagaagtgagagaggctgacccttgccctgagcaatgctagactcttggttgggaagttctgttctgccagcacccctgaggccagagaggccttgctggtcttctctgcgtctccctcaggacatggctgcccagtggaggacattcagccactcagcactgggtatgatcttcccttaacctattcccgtctatcaaaatgaagagccacttctagatctaaatttctgtaattatctgataatttatgttttattctaattacaaatctggcccattaaaaaaaattgagactgtatcagggtataaagaaaaaagacacccatgattccaggagtcagggataaccattagtggctttttagtgtgttaccttctcatcttttttcatacatctgtagttattttgcagaattagattcctgtgtgtatgcaacattttcttcactaaccttatctcttgaacatttacctgtgtcatttagtataaactgaaaaataaatatccgtgaagactctagatcattacattatgtggattatattttatttaatgaataccttatcgttgtatatttaagtgttttgctgtgataaatgatgctgccatgaatatgtttgcacacaaatctttgtacacatctgcgtttatttccttagtatataattctagcagtcaaggtgttttgatatttttaaggcacttaatacacaatgccaaattctacaccagcactatatgaatgcccagtttctggaacccactccaatactgaatgcgatctttgcgtatttgatagtttaaaattatacctcactttaaaagttgtttccttttcttgctcatttggttgaatgttttcatgtgtctatcagccatttaaattatcctgctaaatttttttctgtggcttttagtcttccttccattaggatatttgggtttttcttagtgatttttaagaactctaggattctattattttaaaatataaattgagttaccaaaatagtttaaattttaacaaaactgctgtagctggcctccttttataaggtaaccttgttattgtttgccagctgttgtgcctggcacagagctatgcatacccaaggggctacataaatgctttttcattttttatttttatttttatttatttgtttacttatttattgagacagaatctccctctgttgcccagtctggagtgcagtggcatgatcttggctcactgcaacctttgtctcctgggttcaagcgattctcctgcctcagcctcctgtgtagctgggaccacagctgcatgctaccatgcccagctaatttttgtatttttagtagagatggggtttcaccacgttggccaggctgggctcgaactcctgacgtcaggtgatctgcccgcctcggcctcccaaagtgctgggattacaggcatgagccactgcacccagcccataaatgcttttttaatgagagaatgacctattatctaaacataattgatgtacagtgttggttagcagagctagtaggagaatttttagtccattaggagttataagaaaagcttttagaatgaattgtcccagaaaggagagctggaagaaaaaaacccaaaacaatattccacatccacatatatgacctaatgttagcggaacatcacagaggacaaatatcgcaaatcagaacaaaaggacagctcagaggtatttttcaaattgaacaaaattgtatgcatgcaaaatataaatagaatgatattagaaagattttatcaaatcttaatgtttcggcacttttttcctgctgtttttaaagaaataaaacatgacagaacagttgacacctctgcatttctccttttatctcatccccctttcatctataacacaggtggctttgattttgaatatggtgcttatcatctgagtgtgtgctttcatgctttgatgacataagtgtacaaatggtatcatactttgtttcctattgcaacatttcttttctcattcaatattatatatttgagattgatccattttaatagtattacatcataggagatttcacaacttatttattcactctctcatgtatggtcattccagtattttgctcttgcaaatgttgctacaacgagcattgttgatcatgctcccttttgcacacagataagtttctctagggtggaaatggaattgattgctaagtcataggtatggatctccttcttttctagaaagagccaaatcatttttcaagtttttaaggtattatataaatacctgcatttcccccaaggacattttacgtaaatgatgccagttaatatttgtgagtgcttcctatgggccaggaactgtcctaagggttttatatgattccacacatttgatcctcaactattcatttgacaagtgaggaaactgagattcagagaacttgaggatcttggccaaggtcttatagcaagtgccggagcccactcaaacccctcggcagtgtcgttctcaagccctctctcttaaccccaggctgtgctctaggtgctagaaagacactacccatgccagtttatagggatataaaggcagcggctatttaggctgtaagaaaactccaacaaaccgaagcagccttcctagagcattgctgttgtacagataggaagaagaaccagatggttgctcaatgtgtccaaggtccgcccgtcagtgactgatccaagactaaattccaggctctagacgcacatggcagccaggttctttgctccctggctctcgctgtctcactctcccttgctccctccttccctgtgtattcctgaaggcatatagctacatcttcatgtgcttttaatttcttttagcctagagtagacgctcataatagaaaggtcaaataaaattttttaggagtagtaatggatgtaatcttgtacatgtacatgttaattgcagcactttaatccccattctaagtaccaaactttccggattaatttcctgcatctgttggtaacacgggactcagtcttctgaccagattctttgcccaagggccctcatttactaatgagtaatcactgcaatttcagagaaaatgctactggtacactcatgtttgaacattcatcaaatatgacgtgagcccagttaggagagatgttagcgtccttagcctacaaataagggcatagaattaaatctccccacgctataattttgttggggttattacttgcatcaatgtttggaacagttggtgataaaacgtttcatggtcttacagctcagtagataggagcatgtcatgagtcaggcttaccaaaggacttactgcagacttacttccccttgcctcctgtgattcaagccaattttgcaaagagaagacagaggtggaagaggaagtcccttcagcaggaatgcatttctctttgtgcacatatcacagacacacagcactgacacactaattatagctttaggttgagcatttccagtttctgcattttgtttgcaaacagcccattatttctatcctgtgtgctggaaaaacacaaaatgaagcagtctaatcactactgtttctggtaggtccagctgtctacctgtctcccctcttttggttttatttttttcagggtgggcctgtaactcctcttctatccccacccgattttgttttttggaatctttctaacctgcctgcagaccaggggttgcagttccagctttccatgatcttacctgtgttcagccttatctattttgtattgaaagaaacagtcaacacagtcaaatcctttataccttccttaagactgcactggtgtggcctacatagccacctgtgtgccagctgctgtttgtcactaggaagacagggtgggatgtgcgggtggtatgaccgaggtgtgaagaatctcagggttggctgtgtcagtgaaggagtgaacgggcactttggggtcacctgaactgggagaactaagttctcaagcagcaaaaacagaggcacaaaagtggataaaaacccaatagtgcagacctggagctaggcttcttctctcagtggtggcacagaaaaggatgaaagtctctgaaatgtgcacctgtgattcaggttgccacccactgaaaaatcatgattcaagatctctcctcctcataaaccttttttttttttccctgcctgcagcctaagatagaattaggaagtcaagaaaggctctagatgactttcagagtgttttttgtttgtttgttttttctttttgagacagtctcgctctatcatctaggctggagtgcagtggcatggtatcgtctcactacaacctctgtctcccaggttcaagtgattctcctgcctcagcctcctagcagctgagattacaagtgcctggctaatttttgtatttttaatagagacagggtttcaccatgttggtcgggctgtctcaaactcctgacctcaggtgatctgcccacctcggcctcccaaagtgctgggattacaggcgtgagccaccacgcctggcccagaggtttgttttttttgttttgtttttgtttttgtttttccagaattagcacatcttctcttctctgggtcatttttctcttaaatcagagattgcaaaatgtggtccaagggtcaaatccagcctggagtcccctgttttggtaatgtttccttgtaacacagccacccccattttttacaggctgtctgtggctgcttttgtgatacgatgcaggagttgagaagttggacagagaccatatagtttaaaatatttaccaccctagcctttgcagaaagttcgcccaccccttagagtacagaaaaagaaagatttcagagatgtcagtttgggaaggtccttgaaaagtcacttggcaaagaaaagttgtgagaagaaggttgatgttttgtcaaagaaatgcaacgatgacagatgccaacctgccttttcttccagcggcagaggacctcaggccgtggtgtgcatgcccgtgtatcggtgtgggtatgtgcacctgcacacatgtgtgcttacacgcagctcaaaacggtgccaccctgtccagagttattttggccatcatggttcaaatcaacagacttttctggaaagcttctgcacacatgccatgctcagaacaggaggtgcaaagatgggaaaggattctgcctgatatgcaaatagtgaccgaaaacaaatagtaaggagtgaggctgatggagagctaggggaaacaactcactgtccctgggagggctgcagaggacccagcacaggcgttctggggtgtaatcttccttccattctcgtgagagaagctgagtggaaaccaagagcctggcttttcagtgaggacatgaagcctctgatagttgccttccctctggaggtgaagcagtcctggaagaaaacatattcttacctcaaattccaaaacaacatgtggggactctgttgagaagcctgggtgacctagggctgacgtggtagaatccagactgattctgcttctgctttctcttaaagtcagctcagttttcccaatttttatctttttttttttcagggtctctctctgtcaccccagcaagagtgcagggctcactgcagccttgacctcccaggcccaagcaatgcccccacctcagcctcccaggtagctaggattacgattgcaccccaccatggttttcccaatcttataactaattagatccgctcatcacgtgtcctgcaagcatgcagtggcatgtcacagtgcccatctgacagcagggcagggtcgtttgttgagagaaacccactgaggaggaaataaattaatgtccatcctttgctcccatcacctccagctgcaccatccttcaccaggacccatcagagcttccccggggatgctgccctgtggttctcggggaagctgagagctctatgttgcatcttccagggcacctgtggtctccgaagtgttggctgcaagaatggctaagcagcgcactctcttcagacaagaatagtattttaattgccgacagaatgcagatatcgtttccactattgcctctgacacttaattttaggccgggcatggtgactcatgccagtaatcccagcctttagagaggctgagcctggaggactgcctgaggctagaagtttgagaccagccctggcaacatggtgagaccctgtctttaccaaaaaaagaagaaggagaaggagaaattaaaattagccaggcatggtggtgcatgcctgtagtcccaggtactcaggaggctgaggcaggaggccaggagtttgaggttacaagtgagctatgattgtaccactgcactccagccttggcaatggagagagaccctgtctcagaaaaagaaaaaaaattaaaaaatgaaaaaaagaagaagaaatgtaagtttaggcatcttgaaggcaggagattttgactggtaatggtggaaggattttgcaaaactccatgagttgacctcattcctcagaaattccattgagaatggagggtgttatgtgaaaatccgaatcacaggggatggcttcgagacatgtggaaagaatgccgccattacatatgcacgcgtagtgtttgccccagaggaggcttttgaaaagttcatctacaatgtgctaaagtcgagttttgcagtgacttcctagcgcatttagactgggcatagtttacattactgagtatttatcagccagcaaatcaaagccagaaataggttactcctttgtggagcaggagacagtgactgtcctgggaggaagtgactgtcacagcaatggattcctttagtagcatcttcactgtgtattcaccgggtacccaccgtgttagcgatgacagccaccctgtatcaggtactcccaagtgtccgttcccctgttactgagcactttacaggcactcttgttttgtgctcacagtaaccattgagggagatgaggcacagaatatgaagttagttgccaaaagttgccagagctgggatttgggctccaggtggactgactttagaggctgtgccctccatccttgccctgaacaacctcctgtgaagaaatcagtgtgaatgaatgaatgaatgaatgaatgaatgaatgaataagacctgaagaggcaggcaggctctgggagatgcagagacaacttctgcccagtttgtgctcaggttgtggagacaaggcttcctacgagatgcacacacagaaatttggcagaatgggtaagtggatagcacacagtatgaggtgggtccaatgactgctgagattccctctgtcctccacccacactttctcaacggtgtccttctcagaagagaacctgcttcttcgaccggcctggtaggaacagcactcaccacccatttgtgtgccagtacaggtaagtaagagtgctcccggccgcccttcagccgtggtgctcaatctgctgcatgcatcaccttagccaatcctcacgtcaatcccactaggtagggattatcactgcagttatatagacaagggacctgtggctcagggaggttaagctacttgccagatctcatggctaagaagtggcagaaccaggattcatgcaatggtgtggccgtccttcaaatcctgtgaacctcccatgggaacctcccatgacatcttgtgtctcccctggatatacatccgtaccatgacgggttttcttttttcctggtgggaaagggcagctgggggtgagaatgctccagagagtggcagaatggagctatggacatgaaagtatttggatcgttgggaagtgcagaggtcagctccgcacacacttcctgggactttgcagtcaatggttactgaagttacttaatacccacttgtcccacgactggtgagtcccgcctattgcctgctgtcctgtggtgcagctgctgtttgtccatctccagggccaccaaagcccgtctggattgtgattcaaggtgtaagaggacatggaaaaagaactgatttgtgttgtatgagtttagtttaacttgattacaggaaactgttggtgggtgaatgtaggatttcattgcgtataaacatttcagagacaagtccctttcagctactttctacttgggaatacttgtgaggtttttcacctaaggcttccccgtaatgattttgtcctgatgattcattccttaattagtggtattttattgccgctttgccacagagctttcaaaaccatcacctcctcctcctcctctggaaaacgtgcacagactttgcccacatttaatcatgccatccccaccctttctagtctttcttcaaacttctaccagttcctgtgtttctgagaggagcccaagtcaaacactatgagataaacatcaagagcttaaaatgaatgcatgttcaaaaaatatgctggtctctgattccaaacatggctactgctaacccattgaagacccatcaaagacctgactattctgaattgttttaatagcagtgaggggtgagtcgatgtctcaggagaggatggcccagacctaggtaatgtgtgtcccgtcccccgacccagtgagcacgtgtgtgcatctgtgggtgtgtgcgtgtgtgggtgtgtgtaggtgtgtgtgtgtgggtgtgtgcgtatgtgggggtgtgtgtgggtgtgtgcatgtctgggtgtgtgggtgtgtatgtgtgcgtgcgcgtgtgggggtgtgtgcccgtgggtgtgtgtgggcgtgtgcatgtgtggatgtgtggcaccatgtgtgtgggtgtgcgtgggtgtgttcctgtgtgggtgtgtgggtgtgtgtgcacgtgtgtgggtgtgtgctgtgcgtgtgggtgtgtgggtgtgtgcatgtttggcaccgtgtgtgtgggtgtgcgtgtgtgtgtgtgggtgtgtgcatgtgtgagtatgtgcatgtgtgtgcaagcgtctggcacacggtgtttttgactggactgaggttgtggtaccagagtccagaagacagacagttgaagttgtgtcgtggagggacactgacatgaaatctggcaagtcatgtccaaaccaggtcactaatcaattgtgagcagagagcagtgagcagagggcagcagctatgtgcagagccagaggccggggttcgaatgcacaggagccacgtggacactgctgcaggctgcccgggcacccagccgcagattacctgtgttacctcatgcctttttttttttttttgagactgagtctcactctgtcgcccaggctggagtgcaggggcgcgatctcggctcactgcaagctccgcctcccgggttcacgccattctcctgcctcagcctcccgagcagctgggactacaggcgcccgccaccacacccggctaattttttgtatttttagtagagacggggtttccccatgttggccaggatggtctccatctcctgacctcgtgatccgcccgcctcggcctcccaaagtgctgggatcacaggcgtgagccaccgcgcccggacccattgcctcatttcttcctccagccgcctgtgggtggggactgttcccgctgcagtctcctgggtgagagatgagggagctgctggtgagaggcggttgccccatcacctaagctcgtgaccaggggagggggaaaagcatcactgctcaggcaggagcccccatgcctcctgcttggggttcacttaaaggcacggcttagagagattctatcgaccaaaggatggaaagagccacggagaaagtatctttccggtttttgctttcctctgtgttccgtttccttcccatttacacaggtgcctttagcacgtagatattcacagctctctagagtcaccaactcctcgaatatccctggggtcctggcagaaagcggatggcgcgctgcgtctaacggagagtttttggaaaggactgtttacaaaagctgtcgcaggtgcaggcaagccgtggtgcgcagtgctcctgccagccgctggggaggcctgagggcaggaggggaagccacgaccaccaccccgagagggaggacccgggagcatcagctgagaggcatcatgggacaggagccaggaggacaagtgccctgtcctctcccatctccttctgcgctctccaagggctgagcccatcctgaagccagaaggaagcctgtcgaggcagcttgcatccgtctgcctcctggcgcagagcagagtagagagattgaagagtggacctggacgggcaagtgttcatagaaggcgcacagtacgagcatctcatgaaaacagtgggccctgctgctcagaaaaatgcccaaacacaccaaatgtggcatatgttttcaggggatccatataccccttttagccagtctctggaccagactgtagagtaagagtctgatttagatcgatgggaatgtttgtttgtttgtttgtttgtttgtttccctcctgataaaaaatcctggggtttgtgctctcctttaagtctgtaacagctgagtgaacaaatggcctgcacgccggctcccaggtcagatgtccagcaagcagacgcttcttttcttgtttctctgtctcaagggagcaagtaagtccagaagaagaaaggatctggtgaaggaggctgcaacccgaagttattttaagagagtgttgaaaatgagggctatctaaagcagaatgtgtggctgggatttacaaggtaaatcaaagcagctgtaggaaggaaagaaaagattttcaatgacaaacgttttcctttttacttgttcttttgaaagaaaggggaatgtgtgggcagacagttgtgaggatcttgacttaaatacttgactgccttttcacatgcatgctttaaaaactctctggttccggctgggcgtggtggctcacgcctgtaatcccagcactttaggaggccaaagcaggtggatcacttcaggtcaggagttcgagaccagcctggccaacatggtgaaaccctgtctccactaaaaatacaaaaattagcagggcgtggtggtgagtgcctgtaatcccagctacttgggaggctgcggcacgagaattgcttgaacccaggggacagaggttgccgtgagctgagatggcgccaccgcactccagcctgggcaacagactccatctcaaaaagaaagacaaaccaacaaaaagaaaaacacaaaaactttctggtttcttaaatgaatgacactcacttcgagaagaaggcccgtctaacctcagccttatttttgcattcagctagataataaagtcactcaaggtcttgggtccaaccagatgctaaaaatggctgtttttgctcaacactataagattggaagtcagggagctttggactttggacatttggaactgaggattcacctagaacatcaacgtttttgaacattccataataaaataaatcctgttaactcttaggcatttatacccccaatgtggtgggataaaaggatgaggaaaaaagtggcaccaagatgatgcgagctctttattctgtgtttcggtctcatcccattcagatgcttcttcatggaacatttccaggcagtggtgcctgatattcttcatttcttgaaaattctggttttgttgccctgagagtttgagatgaaaatctggttcctggagaaaagggtcttcttctatcagtgaagcccgtcagtgtttggttctggagtgactgcaaacaaaaagagccctccaagtctcagctcttcccctctctgctggtagatggaaatctctggatctgaattcctaatgggccccaccagtctgatattttaattagtctggtttaaacatggttggaggccgggcgcggtggctcatgcctgtaatctcagcactttgggaggctgaggtgggcggatcacttgaggtcaggagtttgagaccagcctggccaacatggtgaaaccccatctctactaaaaatacaaaaattagttggccatggcggtgtgtgcctgtaatcccagctactagggaggctgaggcaggagaatcacttgaacccaggaggtggaggttgcagtgagctgagatcttgccactgcattccagcctgggcaacagagtcataaaaaaaaaaagtgggggttggggggttggcagtggccttcacacacagcagtctctgcctttaataatggtttaaatcatgtgttagatctaggccctttggtgagagccaggttgaacacccctgaagcatttgctctttgatctatggcctcctattcctttgaactttcccagaaagcagggtgggggtggggatggggaacactaacccagaattctttaaatttctttctaatgatttggaatgatcagaaacttttaaaccaacttcatttccaccttccagccatgcttatccatcgtaagactatttttatcttccataagaacccattctccagtgactcttagatggaaaacacaacactacagagttaccataaaccacttttccttaattgctgacatggaaccagacagaggggggtcattggtttggagaaggagagggagggagaatatctacgccctctctgtccccttcccagacacctcattgcctctgaggattctcttcccttcactctcatcacaaaagaggtaattaccttatttcaggcatcctttttatagagcaggcagcagcctgtcacggtagtagcatttcactcttccaagaatggaaccattgcacaatgtcccaggagtcatttgtgatttttatgagaacctgaagaggttaaagaaaagaacagaaaaataagaaagcctttgctgagaagaagggagctgttagccaaaagagggaatttgggctgagaaattattgtctgaaatacttacatcttagagagagagagagagagagagaggtgagggaggggctttgttattgaattgagtgacatttctctttattataaagttataacgtccggcagtagaactgccagtaaaactcgatctggagtgttttctttccccctcgctatgctcttttagcagtttgcatctggactgttaaattaagggttcttgcatgggaaatacttcttattccttcagcaagtgaaactacttgctaaagtaattatttttaaatgcaaatatatatacacacataccttgtgtgtatgtatttttaaatatttacacacaatatatattcatgtatatgtatgtatgttgtatttttgtggttttgtgttttaacatcagctgcggtagaaagagaagggtggctctgctaagagtccctcctcaactggcctctggctgcaacgtaaatgacctcccttgttccctaccagcatggctggagcaaaaacgccagagtctcacgtacaaacattacctggagtcttcctactgcactcctgcactgtggcatccagagaaacagcgtcacttggggagaatgtcatgcactcctgcactgtggcatccagagaaacagcgtcactcaggggagaatgtcaggcagggatgagctgccttgacttgaaatggtcttgcctctcatctcaattaaaatcaagccattaactggctttaatgtagagattttgtggttcagttttcttcagtggtatccattataaaaaaagatgggggttataggtagcagaactgattggcatagttgtcaggcatatagtatgtattattaatatttaatatgtattattaatgttccctacctatagtgagagctatcctggcttaatcagttatccttcactccaggacgaaaccatgctttctgtggttacctgaattccaggtggggctaagcacagctaagagtatctggtagcctcttcaagtggcttttgtatcacccaaaccttttaaaaactgccacacaaactgataaaaacgtatacttctgtctatccttgattgaatgtaattgtcactatttattttaaagaaatggacaacttagagccctattgcaacacatcccaaacccagctcacttaaaccattaatcaaaacatttttcctccctacctgtggtctgtaaggaggatacaatctagtctctgattgcacaattaaacaggtgcagaaagcagtctatggattcatgccaaatgagtggtactggaagggaattctatgggagttcaaagaaaccggaggtcacagtagatcagagttggttggcgggagtctcgggggagaaatggggtttgacgtaggccttgaaagaaccgataggattcagacaaacctgagtaatgggagggtgttccgagccacacacactgattgttcagtttggtttgctcagctagaggacgtgttgggaagatgggtctgattggaggtgacgttgacacccagacttagattctaagggcagggggagttccctgaaggattttaagtgccaggggcctggtagtgctcgtgtgttaggcagaagggaggcgaactaggctgtcacaatcatctagattggagttactgagaatctggatcgggtggacatgaaaagaaagcagtggattcaagttacaaaggaagaattggcaaggggtggcaaaacagtcactgcttggaaaaaccatttttctgaagcataatgccactttgtttttgtttttgtttttgagatggagtctcactctgtcgcccaggctggagtgcagtggtgcgatctcggctcactgcaagctccgcctcccgggttcacgccattctcctgcctcagcctcccgagtagctgggaccacaggcacccgccaccacgcccggctaattttttgtatttttagtagagacagggtttcaccgagttagccaggatggtctccatctcctgaccttgtgatctgcccgcctcggcctcccaaagtgctgggattacaggcgtgagccaccacgcccggccaccactttgacccctgtctttgctctgtgtctcctgaaggacaagaaggccatcgtgctaggcttcggaattccctgcctattcgtgcataatttgaaatcatctctatgtagctttcagatgctcatttccttctggactccctagtacaatttcatcaatttcatattctctctctctctcctctcataggtatatagtatatattttacttgatgactgactcaagaattttcagatgggttctgatcttgtttagctggaagcattttctagagagccaaagccattgttattttggcttctacatttattgtcgtatattcaagcagaacagtgtaaaaatgattaccaaagttgagcctattatttagattttgatagtatgtgtgtgtgtgtgtgtatatatatatatatttgagaaggagttttgccctgtcacctagactggagtacagtggcaccatctcggctcactgcaacctccacctcccaggttcgtgcagttctcctgccttggcctcccgagtagctgggattacaggcatgcaccaccacgcccagctaatttttattgtatttatagtagagacggggtttcatcatgtcggccaggctggtcttgaactcctgacctcaggtgatccacccacctcggcctcccaaagtgctgggattacaggtgtgagctaccacacctggcctgatagttatgtttttaactctagatgactaaaagacacctataaagatatagaagttaagacaaaagtcacaattatgttgacaactgctgttacagtgttttcaatatatttatccaatagaaaagttttattttactgcacaataatatgttctattaaattaataaaaacgtactcatgagtgacttcttgtcatacagatctctatatctcttagagctgtatgtcggcgttttctctctggatatataatatacatattaatcaattcattcattgagcctgtgcttggcatgattccaggtgcttcagtataatagagcaataaagacaagccccctgctctcttagatcttacttttttttttttttgaaatggaattttgctcttgtctcccaggctggagtgcaatggcacgatctcggctcactgcaacctccacctcccgggttcaagtgattctcctgcctcagcctcccgagtagctgagattacaggcgcccgccaccacacccagctagtttttgtatttttagtagagatggggtttcaccatgttggccaggctggtctcaagctcctgacctcagatgatccgcccacctcggcttctcaaagtgctgggattacaggcgtgagccactgcgcccagtcagatcttacattctgatagagggatatagacaataaacaagccagaaaatacctgccagtcaaaaagctgtgatgggaaccagccaggcaaagatctagagggagagcaccaggcctgtctccacttatgtgagacgtacagaaacacacagcgccttgcccgtgggaggttctcaccacgtatttattgaggaataaatgagtgaatggatgtattcattggcctgcttgtaaaaccttcaccagtggactcttggcttttagaactttattacaggttgagtaatatctgaaatatcccttattcagaacacttgaaaccagaggtgtcttggattttgaattttggggggtttggaaatatttctactgtacttatatttatcaagtgagcaccctaaaatgaaaatctgaagtcctgaatgctgcagtgagcattctctttgagcatcatgctggtgcttaaaaagttttggattctggagcattttgggttagggatcttcaaccggtatgctaacaatagtgatcttatgtagtattttccctccaaagagatttgagagagaaataagtggctgccgtggttggccgtctttctctggctcacttcaccttgttgccctcggataactccagtgaactccttcttacttttcaaggccatggctcttccaagcaacctccctgagccccttgggctgggtcaggagggttccccaggcctgcatggacctacaatgtgctactgaaatgatcatttatgtgtctgtctctttctctaaacagtgggctcccccagactgggcacaaagttatttacctaatgtagccaagaggtaggtgtgcaagaattgttttctgttgagatgaaaatcaccaagcctggtcatttgctttctgtgtagacagcagtgtgttgttcacttaggactctgctctctgtctcgtgcaacttaccctttatttagggaaaatgaacaatctgtaaacaataagagaacactggcaaatcaatacagtcaagacctgtgggaaaatgtagaggtgtcaagagtaagagaataagctgagggagcaggtgtggatcaccatggtctcctttgacttgctcaataaagaccctctgaccaaaggttagctgcaaacgcctttgttttggagggctagtatgcagtggtttcgtgatgtgtcttttatatggtctcatggttttcaatttcttaattgatgtttctgatttacctgaaagctttaaatgttcatgatcttggcttggtacacattagacattaaggtttacaaccgatgcctgtcattgccatttgaatgtgttggtgacattcctggtgtggcaagctaggcgagtgtgcccccatcgacaaaagaggctgaattctatattctgcactatatggactgcctttctctttcactcacttgctttttaaatgacacaattcatcccattcttaatgggggttgggggagaaaggaagaaggaaacgaaagcaagcaaaagaaccactcagtgcccgcaactgttattatgatcttggtatatagctctaaatactttcaaaaatatacttgaaatactttcataggttttacaacaaataggattatacaaccaattttatcacagtgaatttccaagtcaataactgcttttcagactatgttccaaggaggggccggggttgcccagctcaagagaacaggaatccctgcaaagggccaggggcccgtcagtggctcctcctcagtgcagctctgctctctcggtttttttattgatacataatagaggtacatattttgggggtgcatgtgataatttaatacgttcatatcattgtaaagatccaattggtgtcattgggatacccattaccttaaatatttcccctttctttatgctagaaacatttgagttcttctgttctagctattttgaaatatacaatagattattgtaaactgtagtcacctactgatctgtcaaacagtaggtccttttttttttttttttgagatggagtctcgccctgtcacccagtctggagtgcagtggcatgatctcagctcactgcaacctctgcctcccgggttcaagtcattctcctgcctcagcctcccgagtggctgggactacaggtgcccgccaccacatctggctaattttttgtatttttagtagagatggggtttcaccacattagccaagatggtcttgatctcctgacctcgtgatccacctgcctcagcctcccaaagtgctgggattacaggcgtgagccactgctcctggcttttttttgttgttgtttttttttttttggagtctcactctgtcgcctgggctggagtgcaatggtgcgatcttggctcactgcaacctccacctccctggttccagtgattctcctgcctcagcctcccgagtagctggaattacaggcatgcgccatcatgcctggcttattttttgcatttttagtagagatggggtttcaccatgttggccaggctggtcttgaactcctgacttcaggtgatccgcctgccttggcctcccaaagtgctgggattacagacgtgagccaccgcacgcagcctcaaacactgggtcttatttcttctagcacactgtatacttgtacccactaaacaacttctcttcgtctcccatccccgctgcccatcccagcctctggtaaccacccatctactctctgtcttcaccaactccacttgtttagttcccaaatatgagtgagaacgtgtgatatttgtctttctgtgcctggttcatttcacttcccataatgacctctagttccatgcatgttgtacagctcttctctcattggaatatattttgtaaaacaaacaaaaaaaaattgggggtatgaaaggttttcactgctcatataaatgacaacttgtaaactactgtgaatagcaatattttcattgagtagagtgctaccaatatgcccattcagaatgaaaaactctgacaaacagctctgtccgtatatccttatcactcactgacaatcttttgattggcactggagcacccatctgctgggttttgtggagactgtggccatctctgccttttagactgagctgctcagacagttgacccaacaccggctgcctccttgccactgaatcggaatgaggtcatacttgtacatgcttcttggaaggttttcaggcctcagctctactgagcgaagacttggttgagtaacaagtgaggaggaaactgtagggttccattgtttacaatggggacagcctgcggcaccactagacattctgaggcgggtcctggttgggggtcagaaggtcattggataggcgggaaaaaaaatcattgcaaggttatgattgcaccagtgcattccagcctgggcgacagagccagactccatctcttacaaataaatcagaggaatgggagaaaatatttacaaatcatgcatttgatatttctccaatcatataccggtggccaataagcacacgaaaagatgcttaacatcattagtcattaggaaaatgcaaataaaaaccacaatgagatgccacttcaaaccgtctgggatgactataatcaaaaagacagatcgtgcattgggggcattttgagcattggtgaggatgtggagaagctggaacagtctatacgttgtttgtgggaatgtaaaacagggcagccgctgtggcacagtctggctgttcctcaaaagcttaaacacagagttaccaaatgatctaacaattccattcttagggatatacccaagagaactgaaaacatacatccacacaaacattagtacacgaatgttcatggcagcgttagtcaaaatagccaaaatggaggaagtaacccaaaggtctatccctgatgcatgaataaacaatgtggtgtatttgcacaatggaaagttattcgccacaaaaaggaataaagtgctgatgcatgctgccatgtggatggaccttgtaaacgttctggtagctgaaataagccagatacaaaaggccacatatagtaaactgcgtttatatgaaatgtccaaaataggcaaaactatagagacagaaaatacatttgtggttgcctagaactgggggtgttgagtgagacgaggagtgagtgttaaagggtgtgagtgaggaagatattccgtgttccatgatgattacatcattacatgcatagtgattgcacaactctgtgaatatatgaaaaatcacttagctgtatacttatggtgagctttatgttatgtgaattttatctcaatattaattttaaaatccaatgaagggcaaatttatattgtttttggcttttaagaaactgtcttaaaagacacatttatttatttatttatttatttatttatttacttacttacttacttacttacttgagacagggtcttgctctgtcacccaggctgaagtgcagtggcgtgaccttggctcactgcagccttgacctcccgggctcaagtgatgctcacacctcagcctcccgagtagttgagaccacagacacatgccatcatgcccagcgattttttgtagacatggggtttcaccatgttgcccaggctggtctgaactcttgggctcaagtgatccgcctgccttagcctcccaaagtgctgggattacagacgagagccaccgcacctggccaccccttttatactttgttaatggagaagtaaataaacagccagggtgtaaacaatacatgcacccccatagttcaaagggacaatggagcatatgtgttgatgtgtctgagaaaaacagaaaaaatgcttgtccctggaatgatggaaagaattgttacaccttgagaggagaggtcaagggtggaagtctgaaacaggtgtgggagatgatatttctaagagtgagccagtacgtttctggcaaaataaagactttagcaggctactagtttgtaaaaattaaactgcaaaactggagctggtttcacccttattttttaattatgtgggattagtcatttgtgcttgatgctccctcttagctcagccccatttctcttttctaaataaaaaacacttggttctaaatcctggcttagaaagcatatttttgaagctcaagacagaaaattcatttgtttgtgcattcagcaaatacttttcaagcatgcactgtgtgccgggcactgtcccaggcacctgagacacactggggaaccaagacgaagattcctgccttcaggcagcttagatcctggtgggggtgggggataggaaggggcagagacagatcatccaccacaaacacagtaggttagtcaatcctgtggcagattggaaggtgataaatgctatggagaaaaaagaacaaggtagcgcaggtacggaagtggaatggtgcaggtggcatgagtagccagggtccataacatggtgagatttgggcagaggcatagaggaagtgggggagctgaaccaagcaggtgtctggatatctctgagggaaaagcattcccagcagagggaacagcaaggttaaaggtttgaagggagagcgggcctgtcatgttcaaggaacagcaaggagtccaggttggctggaaaagagaccgaatggtagcagagcaagtcggggaagtctcaggagggtcagagtctatagggcctaggaggccattgtaagtacttggcctttttaacaatttaaatgtaattcatataccataatatttgcccctttgaggcatataatttactggtttttagtctagtcatcatactgtgcaagcagaacattttcttcaccccaaaaataaactttataccataaacacacacccacacacgtccctcttccagccgctggcacccactcatcaacattctggctctacggacttgcctattctggacatttcatattaatggaatcatacaatacgtgaacttctgtgtctgctttctttcacgtcacataatggtttcaaagtccatccatgttgtaacaaacattattagcacctattcctttctgtgtctgactagtattccatggtatggatagaccagtttttggtgatgcattcatcagtggatggacatctgggttttcccacgtttggctgttgtgagtgatgctgtgatgaacgttcatatccacgtttctgtgggggtgtgtttttctttcttgggtgtctgccgaggagtggaaggacttgagcattgcttttctcctgtgtgaaatgggaaccatcgcagtgttttcaccaggatctgactcgcatttttttttttttttgagacggagtcttgctctgtcgcccaggctggagtgcggtggcgcgatctcggctcactgcaagctccgcctcccgggttcacgccattctcctgcctcagcctcccgagtagctgggactacaccacgtctggctaattttttatatttgtagtacagatggggtttcaccgtgttagccaggatggtctcgatctcctgacttgtggtccacccgtatcggcctcccaaagtgctgggatgacaggcgtgagccaccgcgcccggccctgacttgcattttaaaagggtcgctttggctgcctgttgggtatcgactgtgggtgaacagtgagtagcaggaaggaaaccaggcaggatgtgatggcagcgacgtgggtgagagtggtgatggatcagaccagggtgggagcagtgaaggggttgacagattctggatgtattttgaagatagccaataaaattcttgattactgtgagagaaagtaaggttgtgagaatcagcccgaggattttggcataacctgttggaaagatggagctgccattaaatgagatggggaggggtcctgagggatcaggagcgcagctgaatgcaccgaggtggagatgcctactagacatcaagaggagacgtccagcagagggctggatggatgagtctggaattcaggaagcagcctgggctgcagatataaatttgggaatcattggcatctagatggcatttagaaccctgtaactgagtaagatcactaaggctcccatttattcaaaggacaaaacaacataaatgttgacagagagtaataatcttttctatttattgagttccaacagtgagctcctgttatcactaaaaacagacatcgcagataagcttctccagaaatacatatttcaacctggttgagctataggcacccagggtatatctacagaagccaggtattaatatcttagaggcatatgcatcaatatcgtgtgaagtcttttttgttagctcttttctgattatgctttcagagtttttttgttgttgttgttatatttttgttctcccatgtataccttggtttgtgatcagtgtgtaaaggaggaggaatggttgtttggttgagacatttgcaaatagtaagcagtcaccttacctaacttggctaatttgcattgtttccatacagagaatgtagtttgacagtcaaggatgatagaaagtcagaggatgatagaaaacaatcctttcttcatacagattaagaagaagaaatgaataatctaaagaaagaaataacaacaagagacagatgggatgctgactggtccagaaaccgtcaggtagcaacagttgcaaatctgagggagttcagcctggagaagaccaaggggagagagtagaaaggatactcaaatatttgaaaggacacaggcttcttttctgttgctctatatagaactaggattcgtggataaggattgcaaatagacaaatttccacttaaataagaaaaaactttcaaataattaaagctgcccggccaggtgcagtggctcacacttataatcccaacactttgggaggctgaggcaggtggatcgcttgagcccaggagtttaggaccagcctgggcaacatggcgtgaccctgtctctccaaacaaacaaacaaacaacaaacaaaaaactagcctagtgtggtagcatgcacctgtagtccgagctacttgggaggctgatgagggaggatcacttgagcctgggaagtcagggctgcagtgagccatgaccgtgccactgcactccagcctgagcaacaaagaccctgtctcgggggggaggaaagaaaaaaaactgccgaactacatgcagggtgggattgggcatggtacctgggccagcctgttggcataacatgtggaagcgggtgacccacagtcaggggtcagtctgagggactgccatactgggctagggcctctgagtgctctgccagcttaggggttccatgattctcagcagatttccagcaggtgtttgagggtttctgcattcagtgacataaacaggccctcgtgcttctgtgggttataggccagcttggtaccgtataaccagtacatcaagagttgaagtgttgcactaatgctttccaagagtcagagctggcagagtgaccgggtatacaggcagagtttgtactctttccttttagaaacacactctgctgtctgtacctgaattgttctcactctgtggaggacttgggattcttgatgttatttatcttatgtgttccaagtgctaagtagtttaatcctaatacttttaaaatgttaaaaaaaaaaaaaaaagagagagagaaatgtttaaagtttggatagaaacccttagaatcattaaatattctcagtgaaagggaccacagaggtcatctgggcccatttcctcattttatagaaaaggagtctgcaagatccagacagcagttcacccagattagttggttgattcaaactttcccttcctatttctctctacagtgttttatctacaattatattatatttaagatttggcaacaatgaccatatgagaagtccttgtaatatgccaggcactgtgctggccgtgcgttgtgcgtgcattttcctatttaaaatgccacctataagtgccatctttggaatatttgtcctttagaaagaagcatctgcttcaaaccaatggcagagacaaaatggcttttctcttatctttactactgtgtggatttctccataaacaagaactggcaaagggcctcataacagctctgtggccctctctgggctcagagaatgcccgtagccaccagcccagctggcaacaaatggttgcaggttctgtttccatgtttcagtcaatctgtctagagaacaatggaactcctgaaccattcccgtgctcaaatgtaacgtaaaaaggacaatataaaatatcaggcttctgtgtttgaactgctcccctggggaaaggagcatggtggttgggaactcagcattaaacaaggaaactcgatgtgtatccagcatcactgagtgctcaggtctgcagactgcagagagatgtaatgcttattcctgttcccacatctttgatctttttgcgtgaagctaatatttgagaattctttatttccctggagtgtcaaacctcctgtcaactcgccataaagacaaggaagagatttcctttttcaacaagtgaggacagatgtggccaagcgttgattattattgtaagagatgaatacaaatgttatcattactgagtgctaagctttgtttatttcttcagaattcccctagtgcctctgggctgggaatctcacccacagaccttgatcaatgtcccctggcactttgaacagtccttggttggacctgacagcacgctccagtcttacctttcactggtagcacagcagcgtctaaccgatagggactcttcttggctctgtgtgtacttttaccatcctagataatgaagaccagagccaaggaagagaaagataacaaacgagagagcatatttgattctaggagatttgactgaagatggagatggtcaggtaggcaattcaatggggaaagacacttattttttatttattgacttattttttgatacagagtcttgctctgtcacccaggctggagtgcagtggcacgatctcggctccctgcaacctctgcctcctgagttcaagccattctcctgcctcagccttcctagtagctgggactgcaggtgcgcaccaccatgcctggctaatttttgcatttttagtagacggggtttcaccatattgtccaaggtggtctcgaactcctgacctcgtgatcctcccgcctcagcctcccaaagtgctgggattacaggcatgagccaccatgcctggtcaagacactgatttttaagtaagaccttccaatgagtaatcctttataatcaacattagaactagacgagtattcagaaatgcatgttgttttatatgataacacaaaggactgaatacaaacatcattaaccaagctcttctgagagcttggggaaaaagctgcccgagggtaccctgctttgtgtgcatgtgatatgttccatctgcctgaaatgttcctttgaaataagaagcgagggcacagctgggtaggagagggttgggaaggggcccatggaggactcacctcactgatgtgctgtggaggttcgatgaatacattccccgcttccctcctacccagtgtggcctgatgatcacgactagtgttcctaccagtgaatggttcaccccgaggcaaatgcgttccctaaggaagatatgtgctgtgagtttccagttgtaagaagccagtggagacacccaggtagtctgtgttgttgaagcctcacgatctgggagggcggtgtgatgaatcccgggcagccacacacagtttccggcaataccacatttcatcaattccgtgttagaacattgagtccaagctgttggaaaaagcttccccttcaggtgtgaggaggcccaggcagcagatgccaggactcacactcctgggcatcatttattttggaagttggggaagcaggtgccggacaaagctctgggtcgtcttcttttgcatcccctccagatctcacagggtttcatgggtgccctgtgtttgatgttcagtgtggaatccaagagcctggtgaggagaagctgtctcagaaccagtcacaataaaaataatgatccacagttaacatgcatagagcatttgctttgtctcaaggcatgtgctgggtgcaccattttcatcctcacgggttctgctagtgtcctcatgcatagatgaggaaaacaaagcttagagaggtcaaaagagctgtccgaggtcacccagctggggttgcaatccaggtctgcctgaccccagagctccagctctgaacctctgtgcttcctgacctggcttcagtgcctgtgagtgtcacagtctcaccacagctggtgttaccatagctacttaacagctggtgttgggggagcggggaaagtgcagaaatgaagtttgcgttgttaacaagaaattttgctaattaattttggggggacacattgagcaagtccgcccaggtgcatgttcccacggtcccattccagtgggcagttgaatgcacacgtatgcatgaagggcgtgggtagtgaacttgtaacagcagaggaagcagaaggttaaaaggagaagctaaatacacctcagtgctggaacgttcattttgcagatttttgtcaggtttggcagagaaacctccaagctctaatcttacagggcgactacttgggaatcaatcgggaagcatatttcctgttactttagtgtagcgaaggcttctcctcgttcttttctactcttagtaatgtattagtaaaatgtgtttatgaaaatctgagtttcctcattccacctttatgtttttccttatgtctttataaaatctgtaagttagtttcctcattccacatttatgtttttcctcattctaatgccctctcttgaattgttagttctttgctttaatgacgctttgttaggcctgggctgatcccacgccatttttttatttcttctggtttgatttctgcttacacctcaaagatgtttaccttcatatcttctctttccctttacctgtgacctctctgccttgcctctcttaataagtgttaataatgctgggttacactttaactcactttgggcagtattctaaatcttaatctcttcaaaggaagtgctaatgaaatgtcccaccattatgtatctgtgttctcttacaaatgcagatgaagagccattcaatggagccacataactgcctttcccatcaagccttgaactgcaagtaaaggggcctgattgtgaggagtcagactcaccatctaggtcgcctgacagaggcccctcctaaccctgtccctggacactgtaacttctctaagacatttgatggtgaccaggcactccactcgtccatgtagtttctgggatggattcctctctggaatattagactgcctcacagattaaactgctaaaggaattttgcagcaaaatgaaatagattttggagcattgtttggagattggagatttggactttgttccaaattgcagatttggagattgttccaacaatttggagctgcttctcctccttcttctccttctccttcttctttcttctttcctcctcctccttctcctcttcctcttcttcttcttcttcttcatattattattattattattattattattcttttaattcttcaaaggagaagctcccaagagagtcgatttgtgtgagagggcctgtgactgggcccctgagagttgcttttttttgaattaactgggataacaaaagacaagcaggcatcttggtattttaagtgtgttttcccaatggaaatagaaataaacacaacactgaccaagtattcaacagagggatggctaaacaaactgtggggtatacatggaatagaatattattcagcaatgaaaaaggaatgtcattctgacacatgctacaacatggatgaaccttgaagacattctactaagaagccaggcacaaaaaggccaataatatataaatccacttaaataggggacctagaataggcaaattcatgcagacagaaatagtgattaccaggggatgtggggagggagaatgggtagttaatatttaatgggtacagagcttcagtttgggatatgaaaaagttgtggaacttgatagtggtgatggttgcaagacattgtgaatgcacttaatgccactgaattatacacttaaagatggttaaaatggtaagttttatgctatattcctagcatcattttttttttttttttgagacaaagtttcgctctgtcacccaggctggagtgcaatggcgtgatctcggctcactgcaacctccacctcccaggctcatgtgattctcctgccccagcctcccaagtacctgggattacaggcgcctgccaccactcctggctaacttttgtatttttagtagagacggggtttcgccatgttggccaggctggtctcagactcctgacctcaagtgatctgcccgcctcggcctcccagagtgctgggattacaggcgtgagccaccgtgcctggccttcaaaagtttttaaatgctgcatgtgaaggtaaccttaggagaaaactcttctgcttcttataaactggcgatgctgtgtagccgttttctgtgatcccagagcctgcagggcaaggctttcagagggcacacggtgccctttcacacgagtgatgctgacattttctccagagctgtgatgaataaataaatgaaggaaggagttaagattccttactactttgcatcttggtcaatagtcagtttgtcttctggttaaatatgagtatttttcgtggtggcaaccccgtcctccagctgctattcttacatatactggcatttacttaagtgagccctcttttcaaacaggacctgacctttcctaaaggagctttaaagaaatccatatttcctgattacaaatagaaaacagtgtgctttctcaagggttaatgtgggcaaagcaaagcaatgttggttctaatttaagcacatagtctttaggcttctttcgtaatagttcccttttgtccatttgggctgaaactgcttcagtaagcattttatgaaatcagtgagaaactccagaaaaaggcttctgcctctttttacgagggtcgtatttggagcaaaggagggaagaaaagcatctgtcaatttgataaatcattttcaggaaagaagaagtttcagcaaagtataagatagagttggcaatttaagggaggaaaaaaaaaagagaggagaccatcacatatagtgctatataaatggtttctatagagagcttttaaatatgtaaaataatttcatatatactatctcattagtgctcacggcaatccagtagttattatagagcttttaaatacgtaagataatttcatacatattatctcatttagtgctcacagcaatccagtaaagtagttattactttatgggtgaagaaatgaaggttcagctttattttatttcattatttattttacattttttattttaattaaatttttttttgggacgaggtctcgctctgtcacccaggctggagtgtagtagcaacaatcacagctcactgcagcctcggcctcccaggctcaagccatcctctcgcctcagtctcccaagtagctggaaccacaggcacatgccatcatgcctggctaacgtttccactttttgcagagacagggtctcgctgtgttgcccaggctgtggttcagctttaataagtggcttgctcaaggcctcacagcctgtaaaagaaactaaacttttgcagagcttccttcctgtccatagaactgtcccaaagtcggacgtcctgggcctgaggcacgggtttgtcacaaggggtggctcccaatagtaaaccttcatggctccctgtatgtgtggaatgagtctctaattgtggagaattgagaatggggggggtggttagagtcccttgaagtgttttgccagtgtagcttgtgtcgtgatacctctttgtgtcattgtaagtatgatcatgcccacatctttctgacatggtcttttgcatctgaatttgcagtttcacatttaacagatttaaacagattggtggcccatatgtatctaaaagagaaacatgtcatctccaggaccaactatatcatttgcagggctcagtgcaaaatgaaacagagggactctagctcaaaaatgattaaaagtgtcaatgtagcaacagcagagtaggcaaccaagcacagggcctacgtgctggccagtactctagcctggaaaagtgcaagaccttctgcaggtggaagcttcacagtgtgccttcagggtctgcttttgggctttctgccaatctggctacatacttaccctttgacacaatcaagggcaaagagttaaaggaaaggtagtcttgaggcctgaactctcttctaaccctattttttttcttcttttgagacagggtctcagtccatttgcccaggctggagtgcagtgacacaatctcagctcactgcagcctggacctcggctcaggtgattctcctacctacgcctcccgagtagctaggactacaggcacatgtcaccacatccagctaatttttttttttttttttgagacaagagtctcgctctgtctcatttgcatttgcatttcagacgcgccaggctggagtacagtggcgcgatatcggctcactgcaacctctgcctcccaggttcaagcaatcctcctgcctcagcctcctgagaagctgggattataggcgcctgccaccatgcccagctaattttgtatttttagtagagatgaggcttctccaagtcggccacgttggtctcgaacttctgacctcaggtgatccacccacctcagcctgccaaagtgctgggattacaggcatgagctgccacgcccggccatgtatctttttaagtacaggtggaggtctcattatgttgcacaggctggtttcaaactcctggactcaagccatctgcccatcttggcctcccaaagcactgagattaccagcgtgagccaccacactggccaacccagactttccactggtacactgtcttcattgctttgatagcaacttttaggctcccttagctttaaaaaagaatcctctaaccatatggggaaaaaaaaaaatcagcaacaactttgtacccacctgacattcggccagaatttttccaacagaacctaacaatagatatgctctctgaaaactctacccagatcgtacactccttgctgggtaggattgtttcagaggatatgaaggacaagggactgagccatgacacctgtcacttcccgtctgagcagttcctgaagaaacagcccccggggaatgaactaccccctctgcctcggggacaggcacctcctggtccacatccatccctggaattagatcggagccacagatgctatcactcctctgccgtggccccatcctcctctgtctggcttttgatgaactgaagactggggtccgggttgtaatggagacttagagttgagtgaagcattttagctttaagaagattattataattatctcaaggcactgaagggctgcttcatttgcatttcagacactaaaatcagagggcagatctttaagaggttaattttgtgagtgagtccttaataacagagggaccaagactcgattctttatgccttaggctaggtttgcagttggtagatgcaaaatatgctgataagattaaagctcctctagtgactcttaagcctcaggctcttttatttgcaaatgtcctgcaccctccatctcagagaactctctaggctccggtactctagaatcccttacagtggatttgcatggacaggaaagcgaattctcatctcttccaatcactgcaagacatggaacggatagtctggcggcacgtctggcagctgaacctcttcactgagaatctaggtaaaggccacttactgatcattataaatgcgctcatcataaagcagtccttctggatttctggcattttcttgaataaacttattgaaacaccctaaggagaactcagacatccttttcaaccctcaggagcggataagaggatgcagcttcatttgttaaattgcagttgcatgtcagttatgaataaacatggactggacttctgatgctaatgtaggaacgatatttgtacctcctggaagtaactcctatagctcgttttcttttaaaattatgcaatccacagtcaagtcctggggtacaagtctaagaggcgtcagccacacaagaggctaaagtgactttggggtagtctgcaagtatctcaacctgtcatttctccagacattcagatatagtacattttaaacacagcactgcctttttcttgaaatatttagtttcagtgttagctaagtttgtgattttttaatgcagaaaaaatgatttatttttaatttctgattcctcgtcgggctatgtatatgtaaagtccagggttatgagaaggcagaagtaaacttgctgggtagaaggcgtcatggtatcatgtgatgtggcttagattaatatgggccagaacactttctctttagacattgctaatgttattcttattcttctactattcacaataatagctaacatttactgagtgcttacagtgtgcttggaactttgctgagaactttataccaattatctgagttttacagaaacattttaaggtagatattgttaatatcccaatttgacagaaggaagaaacaggagttctgggcaggtaaggaacatgcccaagcattgctcactaataaatgactgagctgtgtgtaaacatagttctttccacgtccaaagcccatacttgtaaccactgcactgctgtttgtagatttgttcgactcctcagagcagtaagtcagtttcatcttacttgcctggcctctccattgagtattgaacttggcaggaaatagtgttgggagtgatttgtgatgtctgagataggtagatccagtacagaggaatgttgaaattagacttactagtcccatattagattcttctcagactatccacgagagacttctccatggacccaataccaaccaagcttctgtagaacattttttttttttttttttttttttgagacagagtcttgctctgtcaccaggctggagtgcagtggcgcgatctcggctcactgcaacctccgcctcccgggttcaagtgattctcctgcctcagcctcttgagtacctgggactacaggcgcacaccaccacgtccagctaattttttgtatttttactagagacagggtttcaccatgttggctgggatggtctcgatctcctgacctcgtgatccacccacctcagccacccaaagtgctggaattacaggcgtgagccaccgcacctggcctgtagaacacatttttattatgcagtccatgttcatatgtctagcctgtcagtgggttacttgttaataaaaagcagccgtttcatattagtgtctcattgaaagcagtgcctgttttccattcattctaccttggatttgttttcttcctcaatactgaattcttagaaaatgatatgtatgttgaaaaatacttgagaatacctgagaacggttctctgttgcatttattgctgtatgtgaacctgtctatcaagaatcccaggtgttttgtgatttccgtgtttgtgaaatacattaactctccttatggttggagaaatcaaaacagtgcaggtaaatggtgttttgaaatatctgtaatagtagcgaataagtcagagcctcacagtgcttcattttttaatggaaaatttgaacacatacccacctcttcagtactgaagaattttttcctgtttgattttgttgctgagattggagtttgtcccatgagaaatcactgaacagatttaattttgtttattcttttttttttaagacagcatatttgttctctaccaatatcatccaaagaatgaaatgaatttcaaccagagatgtaggacctaaaaaatttaggtcaaagcttacatataagtggctttgtcttgctggcatcagtattttcgtatttctcttctcaaaagaagataactttatatcaatatttcagaattccatgtagcccaccctactgactgcattgttgtctgttatgctgatacaaagatcttttgttttccttgcctgggatgttctgccatatctcagatggctggatggacacaggtggcctaaaattcctgtgccagattcagcatgatcctgacctaacttggcctggatcataaagtaaaccttggggaatgttcccgtagcctgagcgggaaacactggcctctgggagctccttatggaggagagaaaacgaggagctgtaaactggacaatggattaaaactctagtaaactggctggggtgcagtgtctcacgcctatcatctcagcacttcgggaggccgaggtgggtggatcaactgaggtcaggagctcgacaccagcctggccaacatagtgaaaccccatctctactaaaaatacaaaaattacccaggcgtggtggcgggtgcctgtaatcccagctactcagggggctgaggtgggagaaccacttgaacctgggaggtggaggttgcagtgagccaggatccttccactgcactctagcctgggcaacagagcagataatctcaaaagaaaaaaaaaaaatctggtaaactgaattccgggtcagatcttcagatcttacctcctgtgtaaccttggctaagttaccaaatttctcttcacctcagtttctctgactgtaaaatggagacacaagccagaaaatctttaagttcctgccaagttttaagagtttgaagcttccacgatactctgtgcccaggcccttcctgatgtctgcttttacagcgggacaagcagcaatgctgttgtactctctgcatcttggggcttgttcctctgaacccttgaagacaagggctgagccgcgtcagctctttcccaaaacacaatttaaacccttcggagtggtcagaaatgccactttgggaggcctccctgggttctctgggtgttttgttgaagcagtctcaggttctctaacgttctttttgttgaagatgatatctacaagctttataagctttcttctgatggggagagggaagaggttctcttaaatacagtgttcaactatcaaccgtcatctttagggagacccttcaataacctcagtttctctttgtgtataactagagctaataagagaatgtgggtaaattgggctaaaacaaagccaacattacagtagttcacatgatatttttaaaagaaaaacaaaggcggcacgccagactaaataaggctaccatggccaccgaagttttgcatcaatttgtgaccaaaggacatttttcaaactgacctaagccaatttggtatctgcagttatttttggtcaatatcattagcctcccatagttcaaagtaggtggggctataggttttctcctacaaaaccttgtttccaggtcatgttacaaaggaaataagtcttttatttttatttttatttttggagatggagtcttgctctgtcgcccaggctggagtgcagtggcgtgatcttggctcactgcaacctctgcctcccgggttcaagcgattctcctgcctcagcctcctgagtagctgggactacaggcgcgccccaccacatctggctaatttttatatttgtagtagagacggggtttcatcatgttggccaggatggtcttgatctcctgacctcgtcatccacctgcctcggcttcccaaagtgctgggattacaggtgtgaaccactgtgcctggacaggaaataagtcttaaaccaaattctgccatacttacaaacgtgtagcaagctgacaggaaaagtcctacaattcgttttgtaaacttgatgaaaagccacgcccctatccttttaggcaatcctacagcattttacataaagggtaccctagaggcaagtgcggttattgcactaatggcatgagccagataatcatccagttagtcaagcagagaaaagtgctcctggaatgacctgaacaatggaccaatcagttcaaatccctaatttgattaattgggcttgctggattttatacaagcaagaatgcctgctcaatatttctagccaatcactatatcttgaacataaccattttcaccaaagaaaaataatttctaactgccatgattccagttaaactctgccgttgaccagtaatagagatagccaaggcagcgtggcaacggcctttggagtgtaaccttctgatgagactctcagatgataacttggactggcctaggcactgagcaatcagaacagattctggcctcagctgatgctgtgcagaagcttcctactgagccagaattgtctcagagagctgccaaggcaaccaggtcttgagtggccaagatctgagatagaagggaactatagagagtggagaaggtgcttttctctccctgttcatctgctgagaaggcagcagaacttttggcagtataatgaggcttaaaagacaaaatttgggattcagacctgccaaggcggacaagacttaagagatcaagatcctgggaggaagagacagaaaagtgaactggatactccagtcgttgtcccctttgaagcatttgccaaatattagactgtatactgcaagagactaagcaaaaaaaccatttttagtggagttctcagtatcacagtgctaagtggaaaaaaaaaaatcacatggcggggtgcggtggcttatgcctgtaatcccagcactttgggaggccgaggtgggtggatcacctgaggtcaggagtttgagaccagccatcaccaacatggtgaaaccccgtctctactaaaaatacagaaacttagctgggcatggtggtgggagcctgtaatcccagatactcgggagactgaggcaggagaatcacttgaacctgggaggcggaggttacagtgagccaagattgtgccattgcactccaccctgggcaacaagaccaaaactctgtctcaaacaaacaaacaaacaaaaaacaatcacattcaaagcttagccaggagaaaaggcgctaggagataccccactgggatccttgaagaatcataacctaaaaatagatgtgaacctgaagtagacaagcgatacaaaatctcagtgagctcagtctgggattggtttagcttgatcactcccattcagctgcctaccagaggactgggcgaacgatcactgaagaaagatgggagtctctacctttctcataagttgtttcaatgaaaaatgatcaagcataccaagaaataagcctaaaagaaaaaaaataggcactggaaagatacccataatttactggcattatcagacataaatttcaaaatatctgtgattcatatgttcaggaagataaatgatacaataaagaatttcaccagaaaatgggaattcataaaaagaaactggggccaggcgtggtggctcacacctgtgtaatcacagcattttgggaggctgagttgggcagatgacttgatcccaggagtccaagaccagcctaggcaacacggtgaaactctgtctctataaaaaatacaaaaattagccaggcatggtggcgcacacctgtagtcccagctacttgggaggctgaggtgggaggatcacctgagcctgggaggtcaaggttgcagtgagtcaacttcacttcagcctgagtgacagagatcctgtctcacaaaagagaaaagaaaagaaaagaaataaagaaaagaaaagaaagaggaaattctggaacttaaaaaatgaaataatggatattaagaacacaacaagtggatctaatagcagattagatttagtacaagacagattcagtgaaatggaatgcaaatcagttgaaaatatccagagagatacatggagaacaaaaaggatcaaaatacagaaaagagcagaagagacatatggaacacatgtaacatataattgaaggcctggaagaggggaagagggaatgaggcagaagcaatatatttttctttttctttttagttgacacataataattgtacatatttgtaggtacatatttataggatacaaagtgatgattttggtataggtgtacaatgtgtactgatcaaatcatggtaatcagcatatctatcaactcaaacatttatcatgtctttgtgttgtggacattgaaaatcttttcttctagctttttgaaaacatacaataaatcatcattaaccatattcacctgagagtgctgcaggatgccagaactccttcctcctacatagctataatttggtctatagtttggtatccattaatgaacctctccccatccacctctccttcctacctttctcagcctctaacacctaaaattctacttcaaaatgtgatttaagaagccctggcttgccccaaccaggatatacacagagaaaaccacagctgggtacaatgtagtaaaactgttgaaaacaaaagccaaggagaaaaatgattaaagccgtgagaaaaaaattcattatttttaaaggagcaacactaagacagtaactcatttctcaacagaaacaatggatgccaagagacaatggaacgtcatattcatgggttgaaagaatgtaaccgtcaacctaaaagtttacaaacttaataaagatattcgtcaaacattgaagtgaaataaagacatttcaggacaaaaattgaaagaatccatcatcagtagaccaacactaaaagaaatactaaaaggaagtatacggatagaaagaaaatgatcccagaaatgcaggaaggaatgaaagctgacagaaagggtcaacatgtggttaagttcaaatgtattaagaatatgagatgtattgatggctggatagagggatggataaatatgtgataaagtaaatgtagaaaaaattttcacatgcagaaatgtggaaaaattaaagaatctggatgaggggcatatgggccattctatttttgtaaaatgttcagaaaataaatatagggcaaatataaatgaacattgaccatataaaagaacaaaaatggggttttgtgggcactaaaatatatgtagcattaaatgcatgacaaaaacaatacaaaaagtgaaagggggtaaagggagttaaagtgtaataaaatcataacatctggaagtattaaaactcagaattttaccagactataataggtcaaggacacataatgtaatctgtagagcaactagtaaaataatgcataaaagggaaaatagaatgaaaaatacttgattaatctaaaataattcaagaaagaagaggaaagagaacataaactaggtggactaatagaaaacaactgtaagatggtagctataaactcaagtatatccgtaattgagttacatgaaaattgactaaatactctaattaaaagataattattgttagactgtattttaaagacaacaaaatctaattaaatactgcttataagagacgcttcataaatgtaaggacaaaaagaagttgaagataaaagaatgaaaaaaagatataccttgtaaatgccaaccaatataagctggcatagttctaatataagagaaaatagacttttcaagaatcatcatgaagtcaggagttcaagaccagcctgaccaacatggagaaaccccatctctactaaaaatacaaaattagctgggtgtggtggcgcatgtctgtaatcgcaactactcgggaggttgaggcaggagaattgcttgaaccctgggggtggaggttgctgagagccgagattgcaccattgcactccagcctgggcaacaagggtgaaactccatctcaaaaaaaaaaaaaaagataagtatctttaatttatcattaatgttaaatagccaaaaatatacagaattaaaagaagaaaccagtctgtaatcatagaaacaacatgtctctctcaaaaactgatagaacaggcagacaaaaaatcagttaggagagaagatctgaatctctcaacaatgacacaattcatttccaagtacaactgggacattaaccaaaattgaccatatgttggctcataaagcaattcttgacaaatttcaaaggactaaattcattcagagtactttttttttgaccagagagaaattaagctgtaaatcaatgaccataaaaatagaaaatcaccaaatgtttagaaattaagcattctacttgtaaataaccaacaggttaaagaagaaatttcagtggatttcagacaatagtttgaaatgaaatgatgaaaattttacacgtcaagcgctaactaaccactcacccctgaagtgtgtattcctaaggtacttcaaatattaaataactactcctataatgtaaattaataactaacccacacattattatactatgtatactgaaggactgttatttatttatttattttaagacagaatcttgccctgttgcccaggctggagtgcaatggcgtgatctcagctcactgcaacctccgcctcctgggttcaagtgattctcctgcctcagcctcctgagtagctgggattacaggcatgtgccaccacacccagctaatttttatatctttagtagagacagggtttcaccttgttggccaggctggtctcaaactcctgacctcgtgatctgcctgccttggcctcccaaagtgctgagatttattctatcatattatcattcatctcaaactccatatgtaacttgcagttgatttttcaacattcaaacatcatttattattatccatcaaattgccatcttgttccatttccctgcatatctcctttctgtgtagaagtcttccttctgggagcaggacgaggtaagtgagatgagagcctgggctgtcacactttatattctaatatttttaacccaatttgctttagtgtggtcagagaagctggaaattgaatcagagacctcaggggcaactcaggtgataagtcagcctggatgtgaagtttatcagtcttggctccgtgtgtttaattagaagctagtggaatgttatcattgactccgccagcaaacatcttcactggagaggcagctgggttaaggaagaacatgctgaaaatagagcttatgaacatagctgaaaactgtttatccacagcaaccagcagaagtgaggggcgggagagagcccagcagttggcaatcagagcgtgcatataagcaaagggatcatttcttccaagctgtgtcagagggcactcaatcatgtatactgagctttcttcctgaaaagatagttcaaatctgtgtggattgtcaagttttcttcctctccataatatggtcattaatatttcacttcttttagccaggaactttcaataattcaacatctgctcttccaggctgcctgcaagaaaggccagtttccacccactgccctcctgggtttgtccttccaggtacagaatctgagaggtactggggaaaagaggaggcaacgaggctagtctctcactcctctctcttccctacctgtgtttcttggacgggttcacattcttcttgcatcagatagtaaatgcagtcaaggaactggtgaggaaaatgggaagtttttttgtgcatgtgttagatgggaagaggaaaattggcaagtgttctttaagaaaagcagacacagttacattcatgaggcaaccggttgccagactagtgtgactcctgaaggaacaacttggattgcctttttttttaaaatcagtttttatctagaccaaatctcttttatttcagtgatgtcaagcagctcatgttaccttcgcccaaagagaaagatgtatgggagcttcaaactcaggacaattctcaatgtccttagcgttgactcatattaaaaatgttaagagaacactagaataatagtgatgtgtgtgtgtgtgtgtctgtgtgtgtttgtggtttcctttcctggaaaccctttctaggattaacctaggttaatccaacataatgatagtctgaagaggttgaataaatcagcccagatacgcaggtgatttagccaaggctacatggtgagtctaggggcaaagccgaataagggtggagtccctaattcatagctaacctgcactgccatagtctatcggaagtgaggtagagattattatctgattttattattccgggacacgtaaacttggctgaggacacacagctcggaaccctagcccatagataaatagacaactttatagagtataatttgagtaagccaaaaagtttccacttacatatattctagacctccactttaaagtaatttgagggggacagagaggcaaagtgagcagcatttcttcagaaatcacgttgtctggaaatagctcagtagtgcgcatggcactccgttagccaattgctgtcctgggcctggagggccatagagctggacagaggccttgttttgtttggttcggtttgtgcttgtggtattcaggctggtaggtctgatggctggtaaagtgctaaagcaatcatgggtgcgaggtacacagtggggaatgtatcaaacggtcactttcctaagggagacattctcccccttctaggaatttgctgagggttgggctgagtggaagcgtttccttcctgcctgttctctgacttccaatgcgcactttgttttaggctggatagctacacatcatcaatgagattgcagacagtccctgtgcttgctaagaacggtggaaggttttaggactactgtgtcttacatattcattgtctaagcccccaagtgtacagcattcaaagctattccttccagctctgaaatttctttgggtgaaagctgtcgactttccttagaggaaaaagaaagccatttcatcagggcactgacctcattcctgtaagcttgactggctgagccctgggagtgacacctgtcccagtctttggctttagcaagtgattgatttgaagaaatggtattggtcatttaacccacaaactgattctgaaataagactcatttgtaataaatacatctcacatttgaggactgaattcttcaacacacattccaagttttgtcagttagaaaaaatacagtactttgtaaagtataaaatccataactctatataacccaaacaataggttgaaaactgggtttgttgtaagtaacgtattaataacacctggtgtaatacctgttaacatgctcggtgcctgaagcaaattggcaagcgtttcatctccttttgccaataacttgtcagaaactgactgagggttccttccaaactctcagaagaacatccaaggccaggcagcttatgtagctcttgaacttcaccagggcgagggctgggccccggccaactagagaagccacagctgaatcagaggaggaattccgaagagctgggcaggggcctcctgatggcgagatgctgaatgggataagaatgtgatgaattaattgatttgtatcttacgcaagagctgcagtgaggatggtgaaattcatttccttccataggtcctgcccctttctttgtaagtcagtcagcagcattgccagagctgcctaaaatgccacctccatcccctgacaatcaaagaggaatcttttcatgcaggctgagttctaatgacgaactcattaaaatcaagaccacttactatgcgtatgtgatgtgttataagcactttcagatgcatgattttaaacattctggccatcctgtgaggtcagtaccatattatccccatttcgtggacagaacagtcgtttagagaacttcagtaatttactcgaggcaatctggtgtgaaaagtttgagagaggacactgcaaccaggccacctgggtccagatcttggccttgccacttacgagctatgtgaccttgagaaaaggtcttaacttctttgtgtttcaatgtccttatctgtagaataaggataatagtgttgcggatgtcacagagtcgtaatgagggttaaataagttgatatatagacagctccgagaacctggcctggcatatggtaaggactagctacttatttgtggtggtgatttgtttttactctgtgagagatttgaacccagtttagtttgatgctagggtcagagttctttgtcatctgttcttaagaagccagtggaataaatatcttctttctcctacatttacaaagagatgataatcctgctttagaagagttatcatgcctgcagaggtatcatagagattagtttttatccgcagagcactttttaattggaggataattgctacactggactagtgtggtagtaggaattcatatcaaaattagactttgtgactgaaagtgtaaacaaatgcattcttgctaagactagccacatatttagaggcatatagcagtctgaaataattctattcctttgtcaacacacagacggaggaccgttgggccttttgctaaatttggctctgctgcacttccgtctttagaactaggcaattgcttcatcatgcctacattgtgctaccctgatattttggtacctactgcactgccgcacattcatgggacgccagctgtaccatctatataataatctgagaacttggccattcaccatccaaagttttcatacaaaccaatgaaggcggcgtgcacttcagatgagcaaacaccagacctgtagtataggtggacagataactagattttgcttttctgataaaaaaggaatcttgtctgttgttttagaactactttatatggacagtgagtgcagcatgatttcttccaactggagatttaatggagacctggatcaaacattacatactttgttacatctttttgagaatgagttggagtgaggggatgttatgttgaaaaagaagaggcaggctgggaagggtggctcacacctgtaatcccagcactttgggaggccgaggtgggcagatcatgaggtcaagagtttgagaccagcctaaccaacatggtgaaaccctgtctctactaaaaatacaaaaattagctgggtgtattggcgcacgcctgtaatcccagctactcgggaggctgaggcaggagaattgcttgaacccaggagggggaggttgcagtgagccgagatcctgccactgcactccaacctggcaacagagcgagcaagattctgtctcaaaaaaaaaaaaaaaaaaaaagaagaagaagaggcaacacttgtcttggcaaaccatgactagtttagactgcaagctcaatgaagatcaaaactaggttggtcttgttttgtttcaggcactctctgtatgtatttgttgaatgaatgaatgaaaataatagttatgattataatattatctaagtatgaagaacatgcctctggatcagtaaagacacataaaatggtaggagggttaaagaacatcagtgggtaccaactgttttgtcatgacagggggatatctctgaaaaatttctgtattaattggaaaagaagcttatggtgaacttttttttttttttttcgagatggagtttcgctcttgttgcccaggctggagtgcaatggcgcgatctcagctcatcgcaatctctgcctctcgggttcaagtgattctccttcctcagcctcccgagtagctgggattacagacatgcgccaccaccccggctaattttgtatttttagtagagacggggtttctccatgttggtcaggctggtcttgaactcccgacctcaggtgatctgcccgcctcggcctcccaaagtgctgggattacagcgtgagccaccgcacccggccatggtgaactctttttaaatgacacataaaatttcctgatttgtcttttaaaagttacatctagattttcatgtatcatttttcttataaggatagctaattaatatatagattttatgtatggattttcatatttcatgtatataacatgaattaaactgttatttgtatgaagtgccaagctccttttgggtagtacctaccaccctgtatataccacatgccaaatgagtttttaagatattggcatgtcccaaattcaccatttacattcttgaaagtacttcctttgttccatacagatctaactaaatattagaggtatctgaccttttattttttgaaaaaatgtttgatgttctgactatttgcaacaaaagagctctgttctcaaatgccctgtatggagagaatttctcggttcttttgagagggataaaaaacctctcttaagtctgtgagactaaagataaagggcatcccagcaccatgtatctgagggataatgactgtccgtatcggagagctgggcggtgatgggtgtgttggaagcaccggctggaccaatggacttggagctagaacttggttttgctctcggcgttgccgcagggtggctgtcttgccttatgcaggttttgattctcttctgtaaggatctggtagctattccaaagccaacccatctgtgctatgggatttgatgccacatgactccagctaccctggtaggcctttcccaggcgttggtcagagatatgatccaaaggctgtctgtagaagattgttctctcctgagtgttctgatgcagccagcacaagggtttcctaaggaaaggaacctggtcctgcttcggtcgttttcgtatcccctaggggctgctgaataaagtactagttcccaagctttctgtcatatcttctctgcacacttctggagtagagtgggtgagggcaaggccaggaggtcagtgccacagcgtgggaagagaggaggccctgggccctattctctctggggagctttacatcacccattgctctctccatctccccagggcccagatggctccattctagagcttctcctccaaccccttcccaccttccatcccaaacactttcctctctccttcttggtctctctctctctctttctctgcccttccttccttccctccttccctccctccctcccttcctctctttctccctccctccttccctccttccctccttccctccctcccttcatgttttcctttcttccttctttctttttctttttttttgatacagggtcttgctctgttacccaggctgaagtgccacccctgtgatgcctagtggtacaaacactgctcactgcagtcttgacctcctgggctcaagcaatcttcctgcttcagtagctgggactgcaggtccacaccaccactcccagctagttttttaatttttttgtgcagatagtgtctcactatgttgcccaggctggtctcgaactccttgcctcaagagtcctcccatcttggcctcctgaagtgctgggattacaggtgtgagccactgtgcccagcctctctgctctttcccttccttctcctcttagttaaaattgtagccgtggtcagaggtggctctgtctcctcgtagaaagcagggagcaagactacaaaagaaatggtaaaattttaacgaattttaaatgaataaatccctaatttcctatggaatgacaaactaaatgatggtttgtagttggaaaattaagcaataaaatacttttttattttttgagagagagtctcgctctgtcacccaggctggagtgcaatggcacactcttggctcactgcaacctccgcctcccgggttcaagcgattctcctggctcagcctcccaagtagttgggattacaggcacgtgccaccatgcctggctaatttttgtattttagtagagacggggtttcaccatgttggccaggctgttctcgaactcatgacctcaagtgatccgcctgccttggcctccaaaagtgctgggattacagacatgagccactgcgcctcgcctatttttttttttttaataagtctataataggtatacacagggcctgactattccagatagtgtcagctgtgtagttttcttattagcagacttgggatctatatttatagacaattgaagttttaaagatgtaaagaatttatttattcattcatttattcttttgagagggagtcttgctctgtcgcccaggctggagtgctgtggcacaatcttggctcattgcaacctctacttcccaggttcagtgattctcctgcctcagcctcccaagtagctgggtttacaggtgcctgcaaccacgccctgctgatttttgtatttgtagtagagacggggtttcaccgtgttggccaggctggtcttgaactcctgacctcaggtgatccagccacctcagcctcccaaagttctgggattataggtatgagccactgcggctcatacataaagcattatatacaattgtcattatatactgtaatgtaccttcattccttctgtctgaacaatgtggattttagaaataattaccaaatataaacactactaaaatgtgtagatttggtggtgcagcacatcaaggagcacaaattttacaaatttctttttaaccatctctgcgttgtattttcagaatacggatgattcattttaatcctggtgtctttaaatgattaaggattttcatacatgaggtatttcccacagggaaattctaaggtaatttgggtatgattcgtttagagtttttcattatttacaacaatttagtaaccattagactttcttccttgcatgtgaatacatacatatatttttacatcaagtatttccatcgaattttagctgcttatattttctttttaaccattacttggaatggtattttcctataagcggggaataaagaaactacttctgtctctcgggtatattaacagggacagtggggcctaatttcttatgtcccctcagttagcctttgtcacagacactcctgtgttttggggtcaggagggaagagatcattgcagactacagtcatggaatttgattcatttaactgaaaactttttattttactttacccatcttaagtcctcctgatagccctataaagtaataaattgtccaaaccccttcaggaaactattcttaattccatcatcatttatagttgcctatctgcccaataaaccagaatttagccttaaagccatcgctctcttaatctgtattatgatcttgtctttatatatgagttttgtttttcaaattagtggatggccttaggtaccattttgttattctgcttgtttgtgtcttctgaagacagtcacagcatcatagaatactacagattggaggggtctatgggatcatcagaaccagtgcttttcaaaaaaattttaactgcaaactccccatttgaagtgaatttttgtttgtttgttttgtgacaaagtttcactcttgttgcccaggctggagtgcagtggcacaatctcagcccactgcaacctccacctcctgggttcaagcaattctcctgcctcagcctcccaagtagctgggattacaaccatgtaattacactcggctaaatttttttgtatttattagagattggctttcaccatgttgaccaggctggtcttgaactcctgagctcaggtgatccacccacgtcggcctcccaaggtgctgggattacaggcgtgagccacggtgcccagcctgaagtgaaatcttataagaccctcagtattggtccagggagggtagacttcctcatacctcccaggaggcccgagggctccattgcctctaatttcctctagatgagagaactgacacctctagagataaaattagctgcccaacattttggtgagggaggaagagtccatttttgttgcttagaagcttcgaaatcagcagaggtcagtgtatgtggagattgctggtaataagtctggaaacagagcagaaggttgcaggttggaacctggcttccctggaagccaacactcaggtggagctgggcatgcaggatgtttactggaaatccacacccgtagaaaccaggaggatgcaggattgtaccaaggaaaaagtcaaactgccacacaggccaacaaagccttggccagccccacagggaagcgctggagcataaatggcccatcctcgtgtcctgtgttggacttgatggctgggcctttataccctcactgctatcagtctttggatgtgaaccaccttgggaagggcaggcccttggccttctgcagcattctgtggctttcttcagtggaagcaaatcctgaagaagctgtcagctggaagccaattgcccacagctggggcaacaagtcctcccttgaagcaagatctagaaggcacatctccatgtcccctccacatggccccaggattgctggtgaacatgagagacagtggagaggagagtcccgggaggcagccttcccagccaggccaccccaaacttctggttagggattcccagcttcacagcactacgtaagctgcttgccaacagatgttttgacaacatctgttgtcaaaggttgacaacaacctttggtccttgcgatggctttctcctgtgtttcaagatggattcctattggcatctttcatttccacctctgtttcaccaagtttagtgaccattttcatacattggggcttaatgtggtgcagtggaaagtgtagcagattgaatgtggaagatcgggttccagatctcgttcaggaagttagtagctgtgtgaccaagagcaagtcgttcagcttttctgagccatgattcctcaggtgtacacaccaagtgatgaaacactttaaaaactaagaaaacagtgtttgaaatgcccctcaagtgctggtgtttccccaaggatgttctagacccttcaccattccattcattcattcattcattcatctattcgatgattagtgtgatccctaacttttttattgttgttgttgagacggagtctcgctctgtcgcccaggctggagtgcagtggcgcgatctcggctcactgcaagctccgcctcctgggttcacaccattctcctgcctcagcctcccaagtagctgtgactactggcgcccgccaccacgcccggctaattttttgtatttctagtagagatggggtttcaccgtgttagccaggatggtctcgatctccttacctcgtgatcctcccgcctcaacctccccaagtgctgtgtgatccttaacttttaatctacagttcctcttttttttttaagccaagtagatgggtgattttgttttctgctaattattttggtatctttcattccacctctgtttcaccaaatttagtgaccgttttcatacattggggctaaatgtggtggtcgttctccagaagagtgagtgtaagttcgctcttactttgagcagcttatctctgtttaggcgatttctttgtcaccattaatggaagtgtgacacctttctgagtcccaaatgtatcggtttatcaaaaaccacatctgcaatgctgcaccttgtactgagttcacctcagtctggtactttctttgccttttgtcttgtttgcctccttgttagattagctccttaaaactttttcttttcattttccactaagtcataactctctagactaaatcctattaaagaaacatttaaagtgtttctttactgtgaagtgtatcatgcatgaaaatagtgtgtgaaatggaggtagatgttcagtttaaagaccaatagtagagcaaacgtctatataccaactcctcaggttaagaaatcctcttgtgatatatttatgcacgtggagtagctactttttccagaatttggggacatgtaatgatgactgagagatcatatagtctacataaaacagctcatcatcctagaatgagaaagagagaaaccagccaataaagaagggcagtgtgtataggtacttacaatgagaaatacaaacaagatgggattggagccgttctctatgtctgggagagttagaaaagtttccaagaggatgagacttttgaaaagtttccaagaggatgagactttttaagggatggtttgcctgaggaagatgagcgttccaggtaaagggaacagcatagcacgtgtagtgattcttctccctcctcattcccctctcaccattctgaccattcaccttcagtttcgtttccactctcctatcctccataaatgttggtgttcccataggtgttgcattaggatctcttctcacgtcattcaattttcatccattcacttgctcaatgtcaatgaagcaatgggtctccagaaactcctgcctgcagaactatctgtggagcttggtaaaatgcagatggtcccaccagctcaatcagaatctttggggtagggtccaggtatctttagtgcagatgactgggactccacatggagaaacacaggtgaacagggagggttggagagaccactcaggaatcagtcacaggtgaccttgtgcttcctgctaccatggctgcccctcccagcctgcctcacctgtgcctttctcccttctcccttcctgccttcagctcctctgttgcttcttcttccttaaacatcttcaccggttcctgtgctattacagagccccgtctgtgggtctcatgtctctgctccatgccacgccctcccttgggcatcatctgggctttggctgggtctgtggagggtcctgggctgcagtgccatgaacagtggagtggggcatgcgaagttgacagtcacactgaaagctcctgcctcgcctctctaccttcttctcttttgggggtttctttcctgaggcagggaaaaagaaacaggaacccagaccaaactgaggaaaacacgatcagagatgagatggggtcagaggcaaagggctgtttgttgggtttgcactttcattactgagagcattggaatagttttaaggcgtgcaaactgtgagactagacaatttcacttagaaaatgaaacgtgcatgcagatgttattctcatggggatatatatctgcatctgtttgtctacaagtgttcccttgcagagtcacagacatatacaaaacctgggttccatcagctttgtctgcacatacgtggctaaatgtgtacagggatgtacaattaaagattttaaacacttgattttgacagtatattttgcagctgctgtgccaagaaccctaagctactgtgggttaattggagttgtagcaagtatttctttctcggctgtctcttttagcagagcttctctctctctctctctctctctctctctctctctctcttcccctctctccctgtttcacccctccctgcctgcctgcctctgcccctccctccctccctccctctctctctctgagatagcagacaccagagtgaaactggtgcagcttcctttgagaagcgtgcttgcatgtgcggattggcaggattgtgtgagctcctctcccatccatgcactgttcttggagggaaatgcaatgttggagcaggggctgagctgcactgggaaggtggctgggagctcagtgaggccaggatcatggtttagccaaaggctggaatcacaagaatgtttcaccagggtctgctctgagagttctcagacccccatggattttagaattttccagcctttcctccttcaccttcgcacaattttactttctcctgagatggccccagatctgcaagagacatttgagagaagctatttattagcagacgtgaagaaatggattctgcacttgattatttagccatgacttatcaatgatgatggattggaaagcagtgtaagtaacgcagttatatatgttgctggagttaggtggtctgttttcttgctattttttttttactttaactttttcagtttccttttgagaaaagtaaaaataaaatgcataaaccatttcaaagaagttaggagggtccaggttgtgcaagctttcttcttgttcaatggacttgcagaatacctagttctatcagaagagacacacaaactaccgacatagaagctacaaacatcctccggaggatgggaatgaaatgggtaataaatgaagaaggtttctgaactgacagtcattgctataatcaggcttattcagagttgctaaaatatttgacattggctcatattagaatcaaagaactaaaatgtattctctttacaggatcataaaaatgaagttagcctgtggctttcagagcaggttctttctggctgcgtaaatgtgagggtttttgtttgtttgtttgtttgtttggttttgttttttaactaatgtcaaatgttgactatgtttcctgtccatttcaacttttcttgaggtcggacatctccctattctagagtacaatgtctggtcactcttgggttgcaggccactgtctagtggaaagctagtcattgctagtttataccagtcagagacttttccatctttctgtgtgagggcttcgtttaagcacttcaattcctaagtattcagggaggaaaaacaagtcacttgaagaccaaaatcagtttatttcacaagagaaaggaacggctatttaaaagatgaaaaattgaaatttaaaaatatgatctgccttttcttcaaaatctgaagtgaggttaattttgtgtaggaagagtaacataagctttcttgattaaaaagcagtatttagaggaggcttttaagatcataaatcacttaggtaaggtcatcaaaagagatggctgatattttttatggtcatttgcaactttttaaaaaaagtccatacggtaatgttaatgcagctatttctggcttcttaaaacttgcatagatttggaagtgggatttctaacaataagagtcgtgagtttttctgagctatcattgcctttctctgtctatcacattcatacctcaggcagagctactgtccctcccacctgtccaccctgcctgtttcccagcccccatccttctctctgagtcttggaacatcatgaaagactcttctgcagatttccttttaacataccctgcccagccttggacagagggagtactgtgaagcaacatgcagggctgccaattttggaaatgaatgagcttagttgattcctgaatattaaatcagttctgtgagcagtagaatgagatcatatcttacaaacctgacccaaagtgttcctaacaactttattaattggggtttaacatcatcaagggctgtagcactgggcacccgaggggatcagcctaaacccaaatgaaatccccaaactccactcggattcctgctggccaaatgcacctagggccacgccttctaaaatatgtcctttgttatcaagggaaatctgagacagaaaacacatgttggcagcatcatgtgagcgcctctctgcacataaagtggttgtatcacaaggggaaagctttcgatcttgtgccgttttgttttggtttcttgtttatgtggactctgttagactcctgcatctggaagaggcttgaagcagagtggaaaacctagagcaaaaatcatgccggggaaaggaaaatcattaaaaaacaatgactaaaaacagaataattttcttacccaaattccagttctcatccttgttttgggttccctgttaaagcagataccagttatagccttcctgggttaggggagacagacagtctttcatcatgcccctggattttgagcaaaggagaaagcttgctccagaaatagaaaagaaaaggcaaaaagaaaccatctttcgagtttctgctcactaacagaggaagcaaccccaccctcctccacaccctcctccacccccacagcttgtgcctctcaactgcccctggtggacagctccaacctgcacccccccccaaccccgccgccccctctagaatctcacgtgttttcgtggaggaccgagagtgctttttagcagtgaatgagcaaagagaccagatatgctgatacctgcacatggtctttgagagaggcagctgattgacatcgggaaaactgctgagcaattaaaaaaaaatactagagtcaaggtgaaagaaaggagagaaagagacagcgagagagacaggtgggttgtctctaaagtttcaagcaaagttctgtgaagcacctagcaggtcaaaactgataagggcagatggtgaagaaaagtcttaaactgatcagtgccttacacatggaacgaagctttcatttcggcccgatgttctgccagaaagctttgcttgagatccaccgccagtgttcttgctttgctcaacgatcccactatgctggtatgttctctctctggacagccgtctttctaacaacgggtgctgttctgaaaagctgggagcccaagaaatgttgtaaaaaccaagcgtggccttcagctgttggaccctgaggaacagcacctgcattagggccttgctcacgtttcttactagacaggttgccagctctcatttttgccctttgtctgagctaattggccttagtgttacatcggcccacatttttctccctgtaaactccattcctccctcatttcatctacactgcagagaactctcaagctcctggtgagttttgctgcaaagcctgtggcacgctgaaagaatgcaccccttccgaacctcatcttcccacttcttccactggagacactgcgggggagaaacatgtaaatatcgttaataacaatgcatcgcgtccttgaaaattgctgctaagagagtagattgtaagtgttctcaccataaaaaagtatgtaagataatacatatgttaattagctcagtctagctattccacaatgtgtacatattttaaaacaatgtgttgtacatgataaatatatacaacttccacttgtcagttaaaaaataaaaaataagtccaggcgcagtggctcacacctgtaatcccagcactttgggagtccgaggcgggcggatcacttgaggtcaggagttcaagactggcctagccaacatggcaaaaccccgtctctactaaaaatacaaaaatgttagccaggcatggtggcgggcgtctgtagtcccagctactcaggaggctgaggcaggagaatcgcttgaacccagaaggaagaagttgcagtgagccaagatcctccactgcattccagcctgggcgacagagtaagtgagactccatctcaaaaataataataataataataaaataaaaaatagacatttatataatgaaggtttttaaaaaagaaaattaaaataaatttggagaatgacctgtgaaaaatgcctctgcaagttttcctgaccagaggaaggacttggcttctctcctagacattttttctcgtatcttcctctaggagtcagtggaagagtggcgattaggtaacatctgaatgtagtagaacccagagctgttacctccatttgagctactgctggtcattgcttgacttctattctctccatcagtaaaatgcacgcgaagcttacctcattaggtttttcgagaattaaatgagataatgcatggtgcttagcttagcgtctggccatagccttgatgtcaatactgtcctcatgttctcctgtcagcggtaggtctgtctctcagacactttccaacagaggacccagatccttaatgacaggggacctgggaagacagggaggcaatgtcacagaatggaaagcgtgctcgagtagaagtcaagacctgggtgtttgagtcccagctctgtgcataaccatttgagtgatcttaagaaaatgatcaccccctcttccatgctacagccctagatgggttactccttactccaccactctcctcaccttgactcgtgccggtccctcagcacgacgggtcctcctcctggctggctcctttcttctctccttctatgagactcccctgatcccctgagcccgagggtcagggcttctcctctgccatcctatggcacctacatctctccacgcttaccgtgcagccatcactgtctgcctttcccactcgactgtcatctctgtcttaaagctctgccttcggtgtcaagaccgggcagcactcaatgaatgtttcccgaacggatacgtaaatgacagaaggaatggatgaagagtccctgccctgcctcaggtcttgagtgaagatgaaatgaaataatgtgtgtggaaggcttggatgagtagagtgctgtgcagttgccttcagttttaagttagtatgaggacaaagcattttttataccaatattttagttggtttctcagatactgagattcacacattttagtgaaacaaaacaatattctcttttataccatccttgcagtgtgggcccattatttgttgtagaagcaggccaggctttatgtgggctagaacctctgatggttgaaactgtgagcaacaaaacttttcattgcagaatgacaggtaagattctgaaagccagtggcatgggagggctcgctctgtaactcggcttgtcccagggtatgaatgagggagttcagatccctgcctgtgagggtggagaagggaaaatggtttctaaaagcagaggaggaaagagaaagaatcatcatggaggcagcatggtcagggaaggggcagagggtgttgcatctgacaaagctgggtttggacgatagcctcatacttgggtttctgttgtatctcatgagtcctctccctggaggagtatttggattctattctgcttctcccctgagtttgttttcacggtgggactatccaggactaaagagaatggcaccgtattgctctctctttctgaacccggacttgcaggccatatctggatttatcctttttatcagcagaatggtacatttcccatagcaatgcttgaactctggtccgtgatgaagcaagctcttccatggtgttagagtctgtttttccttcagaaaatgctatttgcagaacggcaacaacaaaacgtgtaacaggaattgtccgttcccatggccagtcctcatgtagagccacaagatggcgcagaggatgacatgaaatcatgtacgcgagcgtgatttgctactaggcagctctgtagggctgtatgtattgatatcacatgcgtctatatgaacgccccgctgcagctgcctttgctatacagtgaatacactgtgggtctattattcgcctcttcagatccagcccaggagttggtgcagactcatttttcactttcctttgaccctgggtgtctccacaaatgaaccacctgctgtgtcttggtgggggtggagatgtggggtgaagtaatgagcccgcaaggcctgtctgtgcctattggctgctctaaagggaagttgaggaatactgcaaagccacaaatctgagatgtcagctcataaatctgtaagctccttgcttaagtaatacgctccttgacggccaaaactgtcatttgcacattctcttcagctgaacacaaaagttccggttaccagactgtccctggatactggggactaaaagctggtgattggcggagtttgggggtggggagggggcgctgggctgattgccctggctgctccccacagctccacggctgctgctttcacccccacctgaccatggtcgcagtggggggctttctcttggtatttaattagtaagtgtaggcaaacatttgcattgtggcactgggataggaaaagagttgaacatgaatataaaaatggggatggggccgggtgtggtggctcacacctttaatcccagccgccaaggcgggcagatcacttgaggtcaggagttcgagaccagcctggtcaacatggcgaaaaccctacctctactaaaatacaaaaacattagccgggcgtggtgacacgtgccccagctagaggcagggaggctgaggcaggagaatcacttgaacccagaaggcggaggttgcagtgagccaagattacagcactgcactctagcctgggtgagagagtgagactctgtctcaaaaaaaaaaaaaaggaaatgggagaaatagtttccagcatttagcttttggcgacaatgactaaatcaatacaaatgttaatctctgttgcattatgcttttgaaactgtattggcagtttaggaaaaatccagtcaacagtttaatatgaaaatagagacctgtagaccaaatggagggcaggaagcagatatttgccacacaaacatttattgagcgcttgatgtattataggtgctgtgtaaagttttggagattcagaaatgaatcaaagagaggagtgaacatacaaattatcccaactataataccggtgataagccacaaggtagctctgctagcacggaacatatggaagagatgaataattctgcttcggagggaaggagtcatattagagttgggtctagaagaatgagcaggaggtggctgggaagggagggcgtttgggcagaggaattggcatgattctctgtgtatgcacaggaccatgaaagtgaatggtgtcatgtaatttttttttttttttttttttgagaatgagtctcactctatcgcgcaggccggagtgcagtggcacgatctcggctcactgcaacctccacctcctgggttcaagcaatcctctgcctcagtctcccaagtagctgggattacagacgcctgccacaacaatcggctaatttttgtatttttagtagagacgagggttcaccatcttggccaggctggtcttgaactcctgaccttgtgatccacctgcctcagcctcccaaaatgctgagattacaggcgtgagccaccgcacccagcaggtgtcatgtaattttattcatatttcctgatgactaagacaacgtatttttcagattctcaaaacaggcaatgattagtaatagatcaccttaaataggatgttataatggtgatgaagaccaatcacagctgcctggaaacagtagatcatgggtcaataatgggcccacacctgggttttgttactgagtcaacctacgctacttgttcatgttgtacctatttatcttgagctggtattagtatatccatttctaaaaatccttgcttgagaaggaaaaactattcaggagaaagaagaggagataaagtctaaacaacttgatttcacttgaaaagtcctaagtcgtcccttggaaactatctatagtaaaaagcatgggattttataccgtgttttaggcaactgaaaggcttttttacaattgtagtaaacactgactgccagcattctggtaccagttactttattaaggtaaattcccaaaactcacaatagtgggaaaaaatactgataagccttctaaaacaccaaagaagtgtagaacaacatcttggatgcttttagtcacgagtcagaacgccgcggtggttacagagcaatagcatttcagagctgggagagaccttagagatcatgtattttgtggattttcaaatctttgaagaatgatgttctgggtaaggaagctgctaagagtccatgagctagttagtgaggactgctacactcttacacactcactcccggatccctttgtgcatgatttctgtcattcaaccagtgttcataaagcccttgtaacatggaggataaatatttgaataagatactggctttaccccgcagaagcttagagctttgaaaggaggtaagacatataggtaaataatacacataggaagttattttaaaaatataatgagagttattagagttcagaagatggaaacttatttcctagtgaaatggatgactgtgtcctgtaatagaatatttactatatttagtaacagatttatacagtctcatttgttttagttaagaagtttgagtatccaacagagaaaaaaggttaggtaaaaattaagtacagtgaggccaggcacagtggctcacacctgtaatctcagcactttgggaggctgaggcaggcggatcacttgaggttagaagttcaagaccagcctggccaacatggtgaaaccccatctctactaaaaatacaaaaattagccaggtgtgatggtgggtgcctgtaattccagctattctggaggctgaggcaagagaattgctttaactcaggaggcagaggctgcagtgagtcgaggtggtaccactgcactccagcctgggtgacagagtagaaccccatctcaaaaaaaaaaaagaaaagaaaaaattaagtatagtcatgtgtcactgaatgatggggatgtgttctgagaaatgaatcattaggtgattttgttgttgtttgaacatcatggagtgtacttccacaaatctagatggtatagcctcctacacacctaggctagagggtaggactgttgctgtactgaatagtgtagccatttgtaacacaatggtaagtatttgtgtccctaaacatatctaaacacagaaaaggtacagtaaaaataagattatcttatgggaccaccagtatatatgtggttcgtccttgactgaaacgttatacggtgcatgactgtatttggtttagcccatgtttttattttgaagaaatgcagaacaagtttaaaattgaattgttgaattgttgtcattagttgatagcctaataagaacatattgttcaagtacaagaatatcattgatttaattaccctgaaaatataattttgaaaaatatctacattttttaaaaattaaattttcgtagtgtaaactaaaattaaatactcaactaactgagagagagagagagagagagagagagagagagcccttccccagctagtctggcagcaagtgatttctaaaggccagaaataggaaaaaaaaaataatcgaatcaaattgacttttggaattgtccttatgaagcacaagtctacaacctttaactcatagagaacacagtgagcatatctgctttgactggcaacttcaaaaaacccctctcccagaggcttgggaaaacacatgttggacacagactaatgataatgtggaacaattattacaatgaacacaataattgtatttgttttatgaacatgatagcctgaagaaacccataccaagaaatattttacgtgttgtcatcattaagaagtcagcaaaccttaaagacaaacacaatctattcatccatccatccatccatccatccatccacccattcatccatccatccacccattcatccatccatccatccatccatccatccatccacccacccacccatccatccatccatccatccatccatccatccatccatccatccatccattctgtaagtgtttattgagtatccactgcatagcatgcaccattcctggcagttaagaaaataaaaggcctcactctcatggaacttacatcagaaagggcaatattaatgatcagccctgaccacatgcctttccctattaatgatcagcccggaccacatgcctttcccttagggaacattgtaggatgaatgttccctgtggtctgaatgtttgtgtctccctctaaattcataagctgaaatcctaacccataagatgatgtcattgtaacattgtagggtgtattttagttggtgtggatatggaggcagaaaagcaaggatactggtgaacctggggaatgcttaagaggttggactgtgctgtacccgttaaaaagcaataaacaggctgggcgtggtggctcacgcctgtaatcccagcattttgggaggccgaggcgggcggatcacgaggtcaggagatcaagaccatcctggctaacacggtgaaaccccgtctttactaaaaatacaaaaaattagccaggtgtggtggcgagcacctgtagtcccagctactccgaaggctgaggcaggagaatggcgtgaacccgggaggcggagcttgcagtgagccgagatcgcaccactgcactccatccagcctgagtgacagagcgagactccgtcttaaaaaaaaaaaaaaagcaataaacagaatctcatgcttctatacaataaaaataaccatcttccctatagatgatgaagagtctgttaatataatctgacaggcttgttttggaaaatatttagatacttatacatccagatatattccaaaccatagccttgtaaaacctctgagctagcgcaatccttgagtataagtctacctccacctagaccaatgtttccaaaccattctgtggctgggaagactggaaggacccccaggctgaccctgttgggaagacatgcaacaaggcttacttcttcagtggtgtcagtgattttgagccagttctgaccatccactcatccgtctgtatttgtgtagtgctcactatagacaaggcaattttggggaatgcagttgtaggaaagatagacatggctcctgaccttatgaaatgttcagtcttgtgaggaagacacaaataattacagcccattgtaagaagcggtaaggtgcttttgtacccttttggtccatttttctttttttttgttttgagatggagtcttgctctgtcacccaggctggatggagtgcagtggtgcgatctcggctcactgcaagctctgcctcccgtgttcacgccattctcctgcctcagcctcccaagtagctgggactacaggcacccgccaccatgcccggctaattttttgtatttttagtagagacggggtttcaccgtgttagccaggatggtctcgatctcctgacctcatgatctgcccgccttggcctcccaaagtgctgggattacaggtgtgagccaccgcgcccggcctggtccatttttcatcttgaccatggaccacgctggtagatgcctgggggcatgagggacatagcaatcaggctctgtcagcctttgtgaccagcacaacttatttccagtgcattaaagaaaatgatactgcctatgcccaatttagatgtgggccagctgtgttagttagcttaacacagcattttgttttgcatatgtattgattttgcgcacatgctctctaagtgcctcagaacactgcctacagcatcctggtgaggttgacaatcagttgtcctgtccctgttcatctggcatggggacacactgtcagaggaggaactaccaagtaagtaattgcctccagcacacaaaaactgcagacacatggttgacataagaatctagtttcagctggtggttttcagggcaaagcaactgcactaacaggagatttccctgacagctgatttaaggctgtggaagaccccagtttatcagctcaaattgagaatgtccttttttgactagaaacgagaccctcccagccaactgcacaaccaaaacttatattcaggatgtccaggacctgaaactgacatgggagtcaatattctacagccagttgtggtgtcgacagggtctgggggaaatcttcagagctgacttgtgatgtagcagggcttacagcaaaggcatccctttcaccttgctctttaggattcatattctaagaagctgctaagaaaaaatgtctaaacggagacacttaggatatagttttcatattaatgttttattttaacaataatgggagcaaacacctaccaggtgtttactctgcgtcaggaactgttctgataatcttatttgaactttgcaacaattccatgaggctagctactcttaccatcctgttttacagctggggaaactgtggcacaggaaagttaaggaacttgaccatggccacagagctctgagtgtcagaaagaagatttgaaaccacacagttggcttcgcatcctgtacgcttgactatttctcttttctgcctctcttgggagaactctgaaatactaaagtactatattactaaataaatgcttgctaaagcatttatttggtcccatattctcaatttacacaattcttttctccaatcacatttcattttagactttatgagccctgttgaagtcatcagcttaaaagtgcccttgagcaattctctactctagattgagttaaacagagtatctgtagataatctagaatcacagacaatacctgtcttagttcctttgggtcgttataacaaaaataccatagtctaaatttataaacaacggaagtttattttgtacagttctagaggccgagaagttaaagatcaagagaccatcaggttcagtgtctggtaagggcccactctggttcacagatggtgccttctcgctgtgtcttcacatggcagaaggggcaaacaagctccctgggctccttttttaagggcactaatcccattcaccagggctccaccctcatgacctaatcaccttctaaatgccccatctccaaataccatcatcttgtgggttaggatttcaacttatgaatttaaagagggacataaacattcagaccacagcaacatctaattttgagccacctaactttgaaagaacaaggattgattaatccaatgtcagcatacagtataccattagatgtgagcccctcttggcaaacttgataaaagtgtgagaaaaaaattacctagaagactaataaatacagaatagtcacatataatttctgtttaaagatttataccttaccaatttccccaaaatgatttaacacaactcattaaatatttgtaaaataatttaaatcttaaaatatatattgggaaccagttaggaggagagagaaaaagacaccggttcctagaccagcttggttattgtacttggacatttcttaggctctgaattttatggacgctaaggcaaatggatcacaaaggagtaaaagataggggaagggaacaaaagcatttagtgtgctcccactgtgtgcagatcattctgttggccactttcccataccttacgccctttattctcacaacagacccttgaggtagttaccgttattttcatccacatcaaagtatgtggcagaggcaggatttgaaccaagcctatttgactccaaagcctgtatgtatttttttactaggtttaggttttattattcttacccaataaagtgacatatgatttgtctggagatacctagtcttcctttgaggattttttaaaaaatggatccctatgtagagaacattgggtaaaatcatagtaacctatgaaaagtaggtattcaatcaatgtttatggaataacatgagtaaataaatgcatggataataagatgaaggatatcttctttaattttataagctaagtaactgttttttgtaaatgcttctatgttaactattaacctctataaaaaacaaagccatatcttagcttcataattcagtctaaggcagttaggtaaatacttaacaatttaatattttatgtttttttctttcatagtttaatttctcaaaagaatagccgaggccccccttatctttacttcttccacccctatttacttctcaacccactgaaatgtgctccgtgtttcctctgattctgttcaaggtcaataatgaactcattaattctaatccaagggacactttgcattctctgtcttttttggtctctcaggggcatttaacattcttagccacttgttccgtcttcctctttacctctctggctgctcctttgtaatcttctcttttatattcactcatgaagtattgaggattttcatggatctgtcacgggttgtgttctgcttgccttctactctgcacctccctgggtcatctcatccactctcataactccagctgccagcttcatgcagaagactctcaaatctgaaaactgggatcaactattttttatatccaaatactctaaatgaagatctaagccaagactgtctatcttgaaagtaagttatttctgtctatggaggcaaaggctcacgtaggaagtgaagaatcttatatatttctaagccatttcttggcagtcagtcacgtattaggagtcagttctgtgtgtttttaaatacagcattgaacgactcagtgtttgttgttattagtgatttgttggacaggatagagagaaagcacagttatttaaagataaagtgtttgtagcccttctcaattgaatagcatacatacagataagatgtctgtgaaattttaatagaaatcaatgtgaaataagattcaatttataaaatctcaaattacaggcaacttgtcaaagcctagctgttgtgtaaacgtgggaattcacacaaggaaaagatgattgattggttgattgattatataacatgagttacattctatccaattgcacctgaatatattcacagacgcagctggatggctctgatttagagaacaagtattttcttcttttcacacaatctgttcctagaagcgccatcaaaacataaatattattttctcataataatataaggcatagtgattttattcttagccaaggatttagtgttgtagaattagttataattaacaatgtgttagtaaagttgagatagtattttaaacctatctgagtacttaaaataatgtaattttgctccagattctgccaaaaaaaatggaaattatttaacctaggattctaataactaacagtatccatagcattaaaaattacctttacatattgtaaatgtcacctgcctacaaataacatgtccattaaagtaaacattacttaaatatgcagctcaacagggcctggtttctttacaattaactagaaaatttgaactaaatcttcctgaagatttcttctctattaaaaacaaaagctgcctcctttccttgcttcacagctttttggacctgcctgtgatgagtgtcctttattgcccagtgtaattttgccatggtttttagcaatctgcaaacactccagcccaggtaacctgacggtagcatagacaggaaaggaggggatgtgaatttctgcctctctgcctctagtggggctgctaaggtaccagccatctaaacatctgcccaggtcttggtgcagtccagcttttcagcagagtcaagggcagaaattctgcccgacttctgtgtctggtacctatttgtacaatgcagaggtcccatgcaaattgttttcctttgaaataaccttaatgatttcttcaggtttcaactacagtaaataatttgttaaataaaaatattagaatgaaaggggggaaaagaaattacttcctctagcaaatgagactcttaaattcaaatttaattaaccaagacgcccccaaaccacagagcatgtcacccagcgttgacaattaattagctttgctctgaaagagctacaggtacccagcaaagagttacggattaaaggctttactcgctctgcgaaggctgcccatttctagctatcacaccttgatagtggtttgttgcttcaggcaacaaattacatctgaagtgtgtgatttcatgtccgtttttaatttcacacaattgaaatatgggaaaagtgaaaataaagctctacttcttttcaaaataaagctctatttctttcaaaataaagacattaaaagtgaacaacactacttcttttcggtttctcatgctgttcaagataattttctatcaaacggtgaaggaagataaatactaaggaaaactctaaaggaatgagtggtcactcttggcttttaggcgggctctctgtttatggtagaccattcagcttcttccttttagcattaaattagcatatgtataaatgatttaactagaaacttggagctagcatctaaaaggcagcatggtgtaatgaaaagaacattagattccttcgattcttgaaatcagattatctgggatatgcttatcccttgaaggaatcttaattttagttggatagtccttaaactagaaaagatatacgtacatattttatagacaattgcttctcagccgaaaaatcaggcactgacattccatgaggaatggactttaattagccggtgattgtctttctctgtctatatttataggcaaccgaaatagctgggttgtaggtacatggtttcatcaattccatttaataagaccagccagttcactatcattcatgttcatgaaagataggaataacgtcagttaactaaaatcatttatatctggctttgggatggctttttttttttttttttttttttttttgagatggagtctggctatgtcgcccaggctggagcgcagtggcgtgatctcggctcactgcaagctccacctcccgggttcatgccattctcctgcctcagcctcccgagtagctgggactacaggcgcctgcaaccacgcccggctaattttttgtatttttagtagagacggggtttcaccgcattagccaggatggtctcgatctcctgacctcgtgatccacctgcctcggcctccgaaagtgatgggattacagacgtgagccaccgcgcccggcccgggatggctttttaatgcatgtttaaatggatctggtgtcttaggtgtttacagttcttttaatttatgtattaagcccagtttccataattgcatactaggtggaacttaggaaaaggcaagaagctattaagtttccctggtactaagcaggcctgggggtgggcagatcaggccaggaacataaagacctgcagtcagggagcatccgataagaacggattgatggtcaaaaggtcagctggcacagggaaaagtacgtgtgcacctaagtgcagatgaaaaagaaagatccacccacactggcgccgaggcttgcaagtggatgtctggcaagcaagcagaagccgagatgcagatcaggaagctaaaataaagaagctggggcatctgggaagaccgagacccagggctccgcacaggctaaacagcaggaagaagagcgagtagaattggggtataggcgtggccaggtcatcagttacccaggtgcacggcggctgtcaggaggtcaggcagcaggcaaaactctgttcacaggtaggatagtgtgagggatcctgcccgctgtgctttctcaagtagggactttttacctctcattgtccaacgtacttctgcttttctcctccctgatgaagatcttgtgactgtgtactggcaggttggagcccacccctccaggacagcagggagcaaaggaagggtagctttgtaggtgtgggtggagataaatattcatgcatgggcaatgaagcagctctaagctatggaatcacatgtcaacccatatgtcacgtggcatcaaaggcagtttatacattggtaaaatgttcctttgaacttttctattccacaggaattgggaataagttttgggttatttcatcttccagtgtccttaaaaatgtggagcatgctctctcttaaaaatatgaatggttgctgtggcttagagcaagtcgccaccttcccgaggtcatccaactctcagaaacagaacttctctgttttaatgagtgtttttctctagatcttgacctagaacttgttgtctaggcagtatctgggtctgacttactaggtttgctggacagacagaaatagaaaagtgcaatgagacaatcgatatgttcttaggtgcccacagagtgtggcaccaacttgtcaagttctggacaaaattagattcattagtgcagaagtcctcaaccttctcttgggtcctgaagcccagcttttgcagatggcgtcttagtcattagtaaggccgctccatcggagtccccgtcatacaaaatattaaaggaagctgtgaagatcggttgcagtgtctgctatcctgctgtcgtctggccagaggtgagccgagactgtggggcagcggggtactgagcagctgctgtataatgagccgagaggggttaacccctggcaaggcaagcagaagagtcattcttaacatgcttagaatcccaatattcattgcagcagcttcaccaaccctgaaaaaccacagcatcagatggtttcttagtaaatacacttatcagaaacagaggcagagggtgcttccctttgaacttctgagacaaaagcccccagcaaggcatggattctgccaccgacggagtatttatttggtctttctaaaatccagatctctgcagccaggaaataacaaactcttgctttgtacttctgtttagccttccatgccaatgactatttttttaattaaatattttctgctttatttttgtgtacaaaagtgtctattttcacacagggaacttggctcagcaaacattcgtagttacttggctttaaacaaaggagaaggttttacattgaatagcttttatttaaaaattggtttatactatcgaaaggaaacattgaggaaaccccccagggcatttggactgggcacagatttcttgaggaacaccccacaagcacaggtaaccaaagcaaaaacggacaaatgggatcacatcaggttaaaaagctgccgcacagcacaggaaacaatcaacaaggtgaagagacaacccacagaatgggagaaaatatttgcaaactatccatctgacaagggattaatacccagaatatataaggagctcaaacaactctatggaaaaaaaaatctaataatccaatttaaaaatgggcaaaagatctgaatagacatttctcgaaagaagacatacaagtggcagacaggtacatgaaaaggtgctcaacatcattcattgatcatcatagaaatgcaaatcaaaactacaatgagattatcatctcaccacagttaaaatggcttttatccaaaaatcaggcaataacaaatgctggtgaggatgtggagaaaagggaaccctcatacactgtggatgggaatgtaaattagtacaaccactgtagagaacagtttggagcttcctcaaaaaactaacaattgaactaccacgcaatctagcaatggtagtactgggtatttatccaaaggataggaggtcagtatatcaaagagatagccaagctcccatgtttattgcagcactattcacaatagtcaagagttggaagcaatctaagcatccatcaatagacaaatgaataaagaaaaggtggtacatatacagaatggagtactcttcagccataaagaagaatgagatcctgccatttgcaacaacatggatggaactggaggtcattatgttaagtgaaattagcgaggcccagaaaaacagacttcacatgtttttatgtgtgctgcccagatgacacaattcaggaaaatctttcagctcctaccagagagtaaagctcttcagctgtagtgggtttacctgctgtgtgtcttcaggcttctcccagttctttatctctgctgtggagccaatataaagttatcaataacatttggtggtgtagatgcttctcatctgtgcaatttaggagtagactctaatacagagcagctgctgggtgaaccaaagatggctttagtgatatttatagcttattgattgcatagttctttgtctgtgattatcattcaataaatactgatggactgagtttcccggaacactgagattcgttttaagcagcttccagcattctttctgtgtatgtggggggaggttcaggaggcagtagaaggtggccataataatgttgtcttgtggtggtagtagttgttataatttcccttttatatcctaattctggccacgacctaactcactgtactgagacattttccccctataatatggagatatgttgctaagcaaccagatcagtaattggtaagtgcttatgtataatatgatttgatttgagttacatacaaaaatatgtaaatggttttttatcttcattattagataaatgattatcatttggttttattttgcccaaataaaataactgctttcatttaccaaaattaacatgatgtagtagaaaggccttggatttagaggatggaaacacgaatgcaagtcccaggtctgagagtcagcagccctgtggccatggctaaagtcagggaacttgccaggcctcgttcttttttttcaacccgtaatgtgtggtacaaataccttctctgctggcctcccagggccaggttaaggatggatgtgatgatgtatagaaaatgttttaagaaaaaaaaaatccaaggtctaagcattgtctagaattccaggctacttaatcttggaactctgagtctgttagtataattccaaaggctggattgactaagaagtactgtcctccagcagggcacagagccatagggcaggtctgcgcctatagaagaaagtaaacacatggcatggaccctgaataagtgaacagtgcagtgatggtggcgaggcagaagcaaaaggccacatggtcaagcaccctgtcattaagcattaaaacataagatagatcatctcaagaccaactgctggccaggtgcagtggctcacacctgttattcctgcactttgggaggctgagatgagaggatcactcgaggcgaggagttcaagaccatcctgggcaacaaagtgagtccctgtctctacacaaaaaacctttttcaattagccaggcatgatggggcacacctgtagtcctcgctactctctaggatcacttcagcccagaagtttgaggctgcagtgggctatgatcatgccacagcactccagcatggtgacagagccagaccctgtccttaagaaaaaaacaaagcaaacaacaaaaagacaactgctataagacttcaaggggaaggacaatgatccacgggggctgaagtcactgatgagggcaacttctacaagtccttgaagcataggaaaattcttttttcttttcttttcttttcttttcttttctttttttttttttttgagacagagtcttgctctgtcgcccaggctggagtgcagtggcgcgatctcggctcactgcaagctctgcctcccgggttcacgccattctcctgcctcagcctcccgagtagctgggactacaggcgcccgccaccatgcccagctaattttttgtatttttggtagagacggggtttcatcgtgttagccaggatggtctcgatctcccgacctcgtgatccgcctgcctcggcctcccaaagtgctgggattacaggcgtgaggggaaatttttaagggtaaattcacagcgatgatttccattggttaactctgtgcattaacatgcaaatgtcaatccatttccaaatgataacagtgcctggctgtagtattttaacatgatattgtttgaggctaatggccaccatgtttgcctcctagcagtaaacatgttatttgaagtcatgtcatgaattaccttcctgcactaatgaaatagataatttacataaaaatcaggaaaaaaaaaaccccagccccatatgcttttcaatctctagagccatggaaatgacctccctgacagccaattagaaaatacaaaggtgaaggtggatgctcttattcccgatacggagaagttccagaatgactagcgtgcttcttggctatgcccaaatacttttaagtaggtgttatttcataataaagcattaatggtgtttgttacatgtggatgaatatcttcactgtgtctgggagctctgcctcagaacgtaggatcttgttccctatccctgctgtttataatctgttttattaccttctcccactgtgtcatggaccggatggtttttctaggggctgctgtgatctgtcttgtcattgcttattatcagatagccttaatcctcagaacattgaaatagttctataatggcacgtgagccatggcagcccacagcagcactggccattttcacatgaaatggcagcctggattgtcctttacatgctgacaggggagactgtccatctgccacccctgtcctgggtcgggaccctttctgttcagcaggtgcagtggctctgagagtctcacagtttttcagttgatatctcacccatcaattacctgggttggatttgtagagctcgaatgacctcttaaattttataaacactttacccacctatttgagcatcccacacttgagcacccctcagacaagatgaaatattcttaggatagggttaggaacacacagtattcctgaaacttttaaagatatagaggtccttaaaaattaccatattgcctgattttcctgtctgtgccccaaggaaagttctattcttcatgaagctaataatttttaaaagattgctaggtcaatattttagtaatctttagacactaaggataggagatttcaatttaattctcatgagatgcacttagaatgacgggttttccatttgaacaccctgcagttctcacaatccagggtaatagtctgacaaatagtctattatacaattacaaaaaaaaaaaagtcaaaatcaagttccccctctaatctacataattgagacctaagactttccctgcacttaaagccattgaatccaccagatgagtgtggacctcatttttttaggtttgggtagatctggccaatgagagcaagtaaccatcctatgtgaagttcatttcagttctaaactgatccttgaattcagatattgtcatattgatgcattaggagaattgtcttgggtgtgagatgagtgaggctatggagagaaaggactggcactcagagggaagactgagcttactgggacattctagccaaggacaggctactgctcttctcctcactgcctgataatgctcagtgtggcaccactttttttttttttatttctgagacagagtctcgtgctgtcccccaggctggtgtgcagtggcgtgatcttggctcactgcaacctctgcctcccaggttcaagcaattctcctgcctcaacctcctaaatagctaggattacaggtgtgcgccaccatgcccagctaatttttgtattttcaatagagatggggtttcaccatgttagccaggctggtcttgaactcctgacctcgtgatctgcctgcctcggcctcccagagtgctgggattacaggtgtgagccatcgcacctggcccactttttgtttttttataggtgttcaggaaatattaatttcatcctgctagagagactttttccttgaaataaggcacagataattatatgaagctaatggatgtttaaagatgtatgctgggataaatagctttaggaaatatattgtactatccttggtaagaataagacaagtagtttttaagttatggtagtttttaagttaatttttctgctactggaaatcttataaaacaacccattcattttttcctatgaaagaaagaacttatcaggcattaattacataaaatatacttctaatcaaaatgtctttaccttttcttttttttttttttgagatggagtgttgctctgtcacccaggctggagtgcagcagcacgatctcggctcactgcaacctctacctcccaggttcaagcgattctcccacctcagccacccgagtagctggcattacaggcatgtgccaccatgctcgactagtttttggattttagctgagatgggggtctcaccatgttggtcaggctggtctcgatctcctgaccttaagtgatccacccacctcggcctcccaaagtgctgggattacaggcgtgagccactgcacctggccgtctttaccttttcaattctctcatgactgcctctcctttatgtccctaaataatacaattatacgtgaatgatttctcaaccttaaccttctcttctctgtgtcattgaagtgctatatgaaaagaactgaagctgctgacctctaagacattggaatatataaaaaaagatcaaacagctgcttataatgatgtcaaagataaaatgctattatagaatctatggctgtaaaaatgtgatttatattaatttttagtattctgaaaatttcctgatatatttattttatacacacattttaagaaaataattttatatgcattctcaagatgacttcctctatcactgtttttctgcattgaagccaacggaggctttcctaaatggagtagagtccaggagtcattgcagaatctctatactggaaatcattctggttccccactgcacgcatccctctccctcgtattcctggtaagcagttttctacccaccatttggatattttcagtgacaaaacacactcactattttatgaagccaacacatcactagtgggttattccaattttgagagaaatgtcgcttatacttatcaagctaaagatgcttttatgtttcacctgctgctttggtacctgtattacataggtttaacccctattcagatacaatacggtacaatacaggacacataggcctagattcagccttggctctactacttattatttattatattctttcaaaggatcattgattagtgtactaaatgctttacatgtactgtcattaaattctcataaaaagtctaaaaaagtaggtattatttttgcttcatcttcctatgtggaaactgaggcttgataataatatttataatagtgatgatgatgatgatagcattgtcatgtgccaactgtgttccaggcactgtgcttgggcctttataaacattatcagaatttaggtaacttccctaagattatctacctagcatctaggaagctggatgttcaaactaagtcagaaaggcctcaggatttaactgccttgagcttcacttgtttgtctgttaaatgggggtaatattgttctcctcacgagggcttctgagattcaaaaaaatggcttatgaaagtatctggcatccttgcttgaaagatacttccacatgtcatttattcatttctttaaagagagctttcttgaaagactctttccttcctctttctccaggtttcttttctccaggctaaatatccccagctcctgtagtcttcgttcattcattcaaaacataccgtgagctctcttccctggtaaaatttacattctagaggggaaacagacagtaaagcaataaacatggtaaccaagtaaagcatctgctatgttacaagataataggtgtcatggttgtgaacaaccaagataatggaaattaggagtctgggagtgagtggtgttttattgactgtggctgtgtgacaaattacccccaaaacttagtggctaaaagcagcaatgatcatttatcatctctcgaggtttctgggggtctaaaattcagataagacttagtgggtgtgatttatctctgttccatgatgtctgggacctcaggcagaagacttgaaggatggcatctggaatcctctaaaggctcattccttcatatgtctggcagttgatactggctgtcttctggggtcctcagttcttttccacttgaccctctccatgtgacctgggcttcctcacagcatggaagctgcgttcccacggtgagtgtctcaagaaaggaagccagggagaggccattattgccttttgtatccaaagctcagaagctctacagcatcacttccattacattctgttggccagggcaatttcagagttttgcttgggttcaagaaggaacatagacgcccacctctcaaggggagagtatcagtgtcaggttgtaagaagtgcctgtgggagacacatggatgcagccatctttggaaaggactgtctgccatgatgggcaaggtaggttcacggataaggtaacatttgagcgaagatttaaaggagatgagggagtgagccatatgcccatctccatctcggcagagcattccaggctgactcaagagcctgtgcaaaggccctgagatggggattggaccaagaatatttggaggctaggatgactggagcagaatcatcaaagaagagagtagtaggaaaagtggtctgagggatatggggggaagggacagaccacgtaggctttataggccactgcaagtactttggcttttactctgagtgatatggagagccaaagggagggccttgagcagacttaaatcttaaaagagttactctggctcctttgtgaataggcaggtggagagcgagtacagaagatggcagacaagttaggagactgtggcagcaattcagcaagagaagtctgtggctctgaccaagatggtagtaaaggtggtgagaggtgatgggatcacagatctactttgaagttttagccaacaaaacttcctgatggattatgtgtgagaagaagacaggtcagcatcgaagaagtcattggaaggatggaattgccattttctgatacaggaaatgctgaatgtgtaacagctttgcaggaaaaacatcaggacttcagttttagggttggcaagcttgagatgtttattagatatccaagtggaattgttgaagaggtaattagatacataaataaggatttccagagagggatctaagctggaaataaaaattgattaatcataggcattaaggatgttatttaaatcatgatcctggaagaaaacaccaagggattgagtgaagcagtaaagaggacaaggactgagccctgaggcctccatcgttaagaagctgggcagaagagaaggaaccagcaaaggaaactggaaaggaatggccagggtgtcctagaaaccgagcagaaagggtatcaaggaggaaggacctactcactgctctgagaggtcaagatggggctgagaaccattaacttgagcaatcatggtggtcattgggaacccagacaagagcagtttcagatgagtcatgggacacatgcctgaatggaatgagcttatagataatggaaggagagggcctgcagaaggccagcacagacaacactttccctgagttttgcggccaagatgggcaaggaagtagaacagtagctggctggggaagaatcaggagaaggatttgtgttttatgttttaagatgagagaaataacaacatgtctatgtgctgttgggaatgatctagtagcgtgaaagtttgtaggagggagagggaggagggaaaccttggagggatatcctggggtgtgctttactttcagggatcctcgcttttctcctcagcaggggatgtgtggggtgggcctgggtggcagagataagaaaaaggaaaaagccatgaggctactgcccgttctaagctgcctttcagtatcactcccttcccctgtctgtctctccatgtggactgggaaccccagcaggtaggggagtgggaaccatagccattgcctggtcctttttacactgtgaaaaggaaccttgaatgtagatggataaacaccatcttttagttcctggcagatcactgtcttccttcttgttctagtcctctgagacataggcaggctggcttgagagcagggagggatcgctgagcagaggtgtgtgcgggtgttagaaggtgccatgatgccttgtgccaatgactgacctgggatgagtcactgttcatttagggagagaatttcaaaaggaatgactggtcattgaataattccatttcacccttgattttagaaggaaagtgccaggaagggtagcaatgagatgaaaaaaaaagtattcctaggtttttcttttcactgattgaaaagaaagtgtcccgtgccttccctttctcatcatcctacaatagggtgacttagggtatcttcccatcaaaatcagtaattcctcacatatctcttccccctgtatttcactcttgtgaaacagattttcagttttacagatgagaacaattaagctttgaaatggtaacaccatttgctatatttgtgcagtggcaattttttagctcagaatttatcaaaagcatgacacttaatgatacagaattaaaaccagctatcccagaccattgaaggagaccggggtcggggagggagaggcggtgcaaacggtgttgcttttgtctttctgacctgcttctctcgtgatgtgttctgcaactggtaagaacattggatgaattataagattttaatcagtagaataaagtcagggcggtcctttcattttaagcagcagctcaaacatttgatgaggaaattagaatccttagaataagagtttagtgtgtaaacatcaagaattcatccagaaatgagtatattagagtctgtgaaatgccttcgcctcacactgccccttcccctgttttcttcttcttttctgtgataagatgatcatggatttgttttgtttttcttttgagacggagtctcactctgtcacccagcctggagagcagtggcgctatctgggctcactgcaacctccgcctcctgggttcaagcgatcctcctgcctcagcctcccgaatagctgggattacaggcatgcaccaccacacccggctaatttttgtatttttagtagagatggggtttctccatgttggccaggctggtctcgaactcctgacctcaggtgagctgcctgcctcggcctcccaaagtgctgggattacaggtgtgagccaccgtgcctggccaagattatcatgttttaagtgttacaggacacttgaatgatggacgatgtcattggaacagcctatgttattaatgatgccggcagcctcccctcccacctttccctgccttcacactctgtgcccccttcagtgctttgaccccttactcctcgcacttgaccatgaattgcattttgtatttaaagacctccctgcacaatatcctcttatctacgtaagcagcccatagcctcagcgccctgcaccctggttggagttcaccttctgatttggtggtatatttctaaaaccagtttgatttttcctgttgcactggggcttgtgtttttcttccagtgccctgtacatagcatgccttgactggtctccacatcgttcttcatcagactggtttggattttacaaggtgttagagtttttaaattagctcatgaggtctctcgcacctgagtttatgccagagaagttgtggagtgatgaacttaatgggtgcccttatccccaaagatgcccagctttgttcctgcttaagctgaatgttggtggataacacatcattctttgtaaatcgtgattgcagaatcctgctattttatggctttgtttttccttttgtcgtataaatgattgggtagctcgttaacttcactctgttatagtaagggactgctacagaggacactgagcaggaggagagaaggaatgattaggcctcagaaagaacgaggggttgtttaagagaaaacgaagtaagcctagcagatctgatcgtacaatcattttccccttattgttcctttttccactccagagctgcccagaagttaaatctgtcttctaaaaagaagaaacatcggccttccacttcttccgctgccgaaccaccgctctttgcaaccagcttcagtgggattctgcagacctcccctcccccagccccaccctgcctgctgagggctgtcaacaaggtgaaggacaccccggggctgggcaaggtaggaccatccgccgtccctgccatttgcccagtgtgcgaggttctggatcaagtttcaggaggaagaaaatgaggcctccaatgtattaaaataagacgttgccagggagaaaaggaggcaagatgaaattcatttgaaagtcctgaaaattgtcatggttgcatacactaagtggtaaactaagaccttcagattgtaagagatctgatttgcttttggtgggaaaaatcagctttgcattgtttgacagaatcgtagccatttaaagaaaagacacaaaggcacaaaatatcgaggcaggggcaggagaccgagggaggccacagcacaaggtacagaaatgagacgtaatgaggcctcataatttccctgtgacactttcgagtttttgcctcctcttcagagaaatcctgacttctgctttgaagcagcccactgaggggattgtgaggaacgctgcagtcttgcctttctagccaacaagtgcgatttcgaattgttacaaatgctcaggaagagatgtaggatcgtgcttacaagctgttgctcagctacacttgggatcactttatttttaaatgtcatttctaaattctttctcccttccgaggaaagcgtttgggtgaagtaacttacggtttactcatcattggtgaataagccagggctcatacaaacatgtagtgaaagaaagacgtggcggtttaattttttatttttatcaaaagtaggagtggtgcacacgacctcactggtcctttacagacttatcgtgactccggccctgggcttcatttggccgccgttgctagtcttgctgaagctccggagcaactactaaactgtggggatttagattttacttgttcagttcgcagactgccagtcccctgggtacccaaacacggtcatggctgggtttctgggcctcagaaggcctctgtctctctggagtctccccttgcaccctctaccctctcttcttttcacctttcccagtttctcccgtgtccttccatgctctcccaccctcaatctcaccacctcgttgggaaggtattaacttcatgtggtacttttcccaagaagagtttaaattttaagattacatggaataggtcaggcactgtggctcacacctgtaatcccagagctttgggaggccacagcaagagaagcacttgaggctaggagttcaagaccagcctgggtaacatagcaagaccctgtctctacaaaaaatttaaaagtcagctgggcacagtggcagatgcctgtagtcccagctactcaggaggctaaggagggaggatcacttgagcccaggagttagaggctgcagtgagcaatgatcgtgccactgcactctagcctgggccacagagtgtctctattttttgaaaacttacattgaacagagcagtgcctcctctgaggggaagcatccagtcctggagctttccttggtggtgggcagggcagacagttttcagctgagggctttcccaggcccagcagcaaagtaagacccaaggaggcagggaagtggcctgggctgtctacagggcctgccccagcatcactggacatggaagcaggtggaaaaaacagtgtggaccaggactcctgtccaggagaggactcagtgggtgggagcccccgaggaggggccgtggtacgccacaggggcacacgggtgtgatcgtggatggttgattcgctgccttctaaggagggtgggtccaagtaactgctgggatcttctattcttttttacattttttatttttaattgtggtaagatacaggtaacataaaatgtaccatctgaactgcttttaagtgtacatgggctcttgttttgcaaagagggatttggaacttcagtgccggagctgaactgctctggacacagtgaaatcaagctgtcagtgcagtgaccttcccctcctgtactctaagccagttctcttctgaataagtgtgagcaaatgtttaagtggtatctccttgaaaaggtgccagatgatcagccagcctggggtgctcatgtaccccaataccgccctgtccagggcacctcaaaatgaagcacatcagaaaccgtcctcctgcacctacagtactggccttgtctgtggttcctacaagggttgatgtggatgcatcttcaggtggctccgacctctccccctctatccctaatgacctccctggaattctgagacaaggacatcagggtgccaaggccagggaccaaaacagcagaaagagtgtcccagccagcaggatgacccagcactgacacaaaaatagtttagagggcaaaggacactggtccaatcttgatttcatgatgtaccatatgtagtgaccacagataaggggccttacaatgaggagttatgcttgttagtaaactaaagtttgcatttcacacttttttaaaaaaattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggccaccctcctgatctgctcaggcttctggggcatgggtaacagtgagggggaggaagtgacagttggagagaatgtgtaccatgattggaacaagaagttggctgggcgcggtggctcacgcctgtaatccaagcactttgggaggccgaggcgggcggatcacgaggtcaggggttcgagaccagcctgaccaacatggtgaaaccccgtctctactaaaaatacaaaaattagccaagcttggcggcacgtacctgtaatcccagctactcaggaggctgaggcaggagaatcgcttgaacctgggaggcagaggttgcagtgagcagagatcgcgccactgtactccagccttgacgacagagcgagactccatctcaataaaaaagaaaaagaaaaagaaaaacgagaagttgccaagaccctgcctcttcctgcacagagcatctggttcttccatttcagcaggctcttactctgccctaccatatggtgccaaactgcctgacctcagcgaaggcccatcctcccagactcctgctctctccacctccacggatatctcaccatcattaggaacagcagttctttatacccatgtggaaaaatttccatcaatttatctgttgcataatttatattttaatatcaccaagaaatacagtggagtttaatatagaacataaataattggcgctatatataaatcggcaggtttgaggtagacaagtttgatggaattcccaaaagcaagttgattgattatttaaacctgacctggagtctcctagagtggaggaggggagcaggaatctccaacgcttgagatggccctgaaggtgagagtgttgtcacccagccggaccactgcccctcagcctcagccacccaccacctccctctggaaacctgggaggccttcctccataggaacagatttcatgggtttatgtagagcaacttcttatttagtagacaagaaaactgaggcccagtgaaggtaacaggttttccagtgactccagaagcagggcaagaagtcaggacctttcggccattttatttcctactgtatcactggctgtcactagataaacatgacccttgacaatttggggtggagacaagagtgtcatggaactgcagtggtagcaaaataacgttgggaaccaattgcctttgtccagtggggaaagacatacttttcagagtcaggattgggagaggaaggggaataacagccaagaatagatacacagaatgagggagaagggaggcgtgctatcccatcccttccctccttcccactccctgctgtttccagcaacaatcccactccccagccaccaccagggagtcatttctggccactgagcacctcttgaggcaaaagcttttctggaggccatggtgatggaagaaatggaggtaatttccatgtacttggagttgaggcatgcacacgcacatgcgcgcacacacacaaaccatctcaggatcctctgcccctagagcatttcctgatacacagcaatttttttttttttttttgagacagagtctcactctgtcccccaggctggagtacagtggtacaatcttggctcactgcaacctccacctccggggttcaagtgattctcttgcctcagcctcccaagtagctgggattacaggcatgcgccaccacacccagttaatttttgtatttttagtagagacggggtttctccatcttggcgaggctggtctcaaactcctgacctccagtgatctgcccacctcggcctcccaaagtgctaggattacaggcatgagccaccatgcccagcccacagcaaatatttattaagcacctactaggtgttaggtactgtgctgagcggtaggcttaggtttgaaataatggacaaggcagagcacctgtccttaaggtacttataacttagtgctttattccagtcagtcttagaaagctcaccaatttgggccaatatgaaggacaatctgatttaaggaaaaatcaggattgtaggcttaaaatgattctgtctcactttgaagttacataaacaaattatgctactaagtagtcttatagagatattcttaataagcagataaagatgattagtggatcaaagcagcttagtccccattcatatttcactgatttggcttatatgtaaatgatgattctaatctgtttgaaaacggttgcttctcctaagtcagttcttcatgaaatttgtttgcacaattaattaacatccatgtttaaggttcatttgttagtatgtcacagcttaatgtcagagctttctgtcttggattagaagcttccagagcaaagcatgttatctgtttgacttgctaagtatatggctctgcagccacaccatggtgcatcaacatttttaaaagtgagaatggtaatggtgacagtcatattggattgatgacaatcaaccttttacccttttagggtagaagtcattcagttactaactccttgtgacactgtatggaagagaaagacaagatttctgttcagtttacattcttcttagaggaagaggagaacaagatttttaaaattagattaaaatactgtggttttttgtttgtttggttttggttttgttttttttgttttttgttttttgagtcagagtttcactcttgttgcccaggctggagtgcaatggcacgatcttggctcactgcaacctccacctcctgggctcaagtgattctcctgcctcagcctccctaaaatactgtttttaaaaaaggtactcggtagctgttattcactcagtcaacaagtagaaacagtggggatagctctctgttgttcaggaggtgatgccggggaaaatctcatgcctttcagcccaccaaggtgcagtttatttacacacagattgtccaattcctcattattattgctgtccttcctcatcctgaagcatgaccaaagagaaaagctctgagccagaattaacatctttacttcaagtattcataaagaattcaaatgtgatggacaattctggatcccactggatcccagtagattctggatcccgctagatcccactacactcacaacttcattcttaaacactaaagttgggaaaagcaaattgtgagttctcttttattttggttcactgttggagggggcgggaacggcataaataatacctattcatcactatagctagcctgatagctttgtaaattaaattgttagctcttctgggaaattaactcatgtgacgttaaactccatagttaagcttacgtagagttgggggtggtggttgttttccctttcttcctttatttcttattttgagccttccttcaaccgatacctccagagaaaggcgacttggggaaaatgttctgactcttaatcttcgcggtttcttttttcccacggatgtagatttcgccagcctctggacagcacatgcgcagtatgctgctagcgccgccccaggcgcccggagctcaggaagcgcaggtggcgctgccagaagggccatgctatttctggggcaaacctgaaagacctcagacacaggggctttcttctatgccatgccactgttgaacttagcactccccgttcttgcaaagagtgggaactgttaggagaatattctccgttagaggttactgggcaggaaagtcatcccaaggacgtgtataaagaaagtgtgagccaggcatggtggctcacgtctgtaatcccagcactttgggagattgaggcgggtggatcacttgaggtcagaagttcgagaccagcctggccaagatggtgaaaaccctgcctctactaaaaatacaaaaattagccaggcatggtggcaggcacctgtaatcccagctactcaggaggctgaggcaggaggatcacttgaacccgggaggcggagttgcagtaagccaagatcgccaccactgcactccaggctgggcgacagagcgagactccatctcaaaaaaaaaaaaaaaaaaaaagtgtgaagccattttcattcattattaatatgatcacctttaattctgctgatgagggtgtgtggatatcattttctgttgtcttcattatcaaatggagaactagaaggggtaagcagcacattttggtttaattagatcagatttatgataggatggcatatcgctacatataaaatactcattttctggcgttcctggccagagatgtctacacagagcaaaatggatgaaaggacccacagtgagcagggaggactggtttggtcctgtagcccagagtctcctatcttatataccaggtctgttcttgagctttcagagtgcaagtagagaaacagaatttagcatccactttctccgtggagatcctgcatttcctacttctctgaacttcccctgcctgcttcatatgagtagacaggctcttctgaacacatttttgtttaagtttcagggacctgacgccttccaggcactgatatgtgtacatatactccacaagacgtatctatgggcaagctagaattcagccccttatgtttctagtggaatgttcatttcagtttccgtcactaggttgttagcttcttgggaggaggaaacatgttcttttcatctttgtaccctttcagtgccagctcagtgctagaaaggatacacaatgtggttgaacttaaaaaaaaaaattctatacagtccgtgtgaagtcttgatggggcgctgagcactgtgtagggtccgtcctgaaagaggcagctgcaaaaatgaggcagaaacagtgaaaacatggacgtgaccagaacccagtggtccttggctccacctgctcttcccagggtgcgagttgtcccagggttttacatcaggaagaaggtgacgcttcatgccacacgctggcaaagaggaaacagtgtccacattcctcactgaggaattttctcgaagaccttcttgtcctgtcctctcattttgcatgtaaggaaactgagggccagcaagaggcactaacttgtcatcccactttgtgggagaagacaaaagtttaaacttctgaatgtaaaagatgatttgttgtggaaaactgttaatcagaatttgaataagagattcgtaatcttttcctcccattttgcaacttttttttttttttaaaaacagggtttcactcttgttgcccaggctagagtgcaatggcacaatctcagctcactgcaacctccgcctcccggtttcaagcaattctcctgcctcagcctcccgagtagctgagattacaggcacccgccaccatgcctggctaactttttgtatttttagtagaggtggggtttcaccatgttggccaggctggtcaactcctgacgtcaggtgatccacccgccttggcttcccaaagtgcttggattacaggtgtgagtcacagcgccctgccccattttgcaacttttgatctcaattctgctggctctattttaaggtattaaatggagatggtaggcttgtgtatgtgtgtgcacgtgtgtgtgtgtaagtgtgtaggaggaggagaagaaagataatttttataaggggactttttaaaagctagcaacctttatcataattggtggacagccttggggcctcctggaatacctgtaattcctaattagcatcctgatttatggaataaaaacatgagataaaatgagggaattctctctggaataaatgccactgtctcaattaaccaaagggcaataagatggattataatgccagaatagggcttttgatcagtctttgtccaaaaaccacattttagttaagctcagcacaattagaccattactgatatcaggagaatggaaacagtaggtatattttaagctaacattcccagcatcttatctttctatagtctttctcttgttaatggatgaaaggaaagttaagcatgatttgttataattatcccattaaaatgggatcgatagaaatattttatgttaaaaaaatggtgagtccaaactgctgagttaattagaaagttttcctttgtgcctcaaacagaataggaaatgctgttcttgcctactgaattgttcgtatcaaatagaaaatatttgaatccctttctaatgcctcattgaaccaaaatgtattattatggagggggagaataattccgatacattctttttttttttgagacagaatcttgctctgtcgcccaggctggaatgcaatggcacgatcttggctcactgcaaactctgcttcccagattcaagcgattctcctgcctcagcctcccaagtagctgggattacaggcatatgccaccacgctcagctaattttgttttttagtagagagggggtttcaccatgttggccaggctggtcttgaactcctgacctcaggtgatccgcccgcctcggcttctcaaagtgctgggattacaggaaaaacaaccaaaaatagaacaattacagtagcaccgagtgctagagacaaatttcctgccaaatctcttttccagttccctcagtctgcgtctgtgttctgtgccacaaccaaagattcagatatcaattttgtccacttgtagctcatttgagatctgttaagcaacaacagtgaatgctgggtggattcgttagtggagctctgttccagctgtagctaataaagttattttctcgctgaaatcggtgatggtaaaattggtctgttttccaatgctagcttcttcagtttccgctgagttcttttctcctggagtgtgagatcacaatggcatgccttacaaaagagtgctcttgcctgctccgtcctggctgctcccaggccgaccctggctcctcaccagcaccctgctgtaaacgctcagctgccccttcccctagcagcagcgtcggcactacatttaggaccctttctgtatgtaccctgaaaacccaccggcgcagtggttaggctggagcagctcaggccagcctggggcaaaaggcagaggactgagaccatgcagtgagattggtgcagtcagtattggtggaggagctgctgggggccaggcacatgctggaaaagtggcgtgttatgtcccggggtctgaagcaagaatgggatcaggcagtgtggaaccaatttgtaaactcctcactcactgactgtcattagtaactaagttgctacaagctctttttttgtgagcctcaaaacaggaagcccagaagagtttacaacaatggaaactctcaggtttctacaggaaaaaggagaatgttgttttccccaaaggttatttccttctgcagcctggccatgtgcccctttccctcaagtttgggaagcaggacaaagggccctggggaatgccttagcccatgatgagctgagggacagtcatttttgtcccgtcatcatgcatttgatttgctccttgttttatgtaaatatataattttagacagcgtcttccttcgtcagccaggctggagtgcagtggccctgacacggttcactgcagcctcaacttcctgagctcaggggatcctcccacctcagcctctcaggtagctgggaccacattagccaccatgccctgctaattttttgtattttttgtagagacaggatttctccatgttggccaggctggtctcaaacacttgggctcaagcgatccacccgccttgacctcccaaagtgttgggattacaaacatgagccactgcgcatggcctgttttaaacattttaagaaaatattttatcatatttgcacaagaagattttcagtgaaggacaatgttttgaaaatccaatcagtaagatactcgctgggaggtatttttatagaaatccatggaaagctaatcataggaaatcggaaaaacagagagcagggtttgtagcttggcctttcccctaccttgttccgcattctataaaaagtgaaaaagtagcaaagtagcaccctacagggggctcagaggtgctggaggactaataacgcaccatttgcatgtccacgccacgcgaccctgcagtcacgctctgttacaagtacagatggtgaaagtgtggccaggaatggatgccggaagcccagaaggaagttggctcttgtctggaggctcccagggtggatctgcacagccttcccttggctgattcctgtccatcctgtggatatcagtgaaatgccaattccttggggaggctttccctgccaacctccccaaccccaggttatccaggctgggtgccccctcgtgtgcttccgtaaccccccaaagtttctcctcattgcattcatcactctttagatgactgatctgcgtaattccatgttcagtgggtctccttaacgaatgtaagctccatgagggcagggccatgtccttcttgttcccctttgaatccagagcactacacggtgcccaactgtcataggtgtcataggtgctcagtaaatactaggtgtattagccagagttctccagagaaacagaaccagcagggtgtgtgtgtgtgtgtgtgtgtgtgtgtgtgtgtgtgtgtgtgtgtgtggagtgggggtgggggattgactgattttcaggactggactcctgtgactgtggaggttggcgggcaggctggagacgcagggaagaggtgcagctggagtccaaaggcgggcagccgacaagcagaattccttcttgctcagggaaagtcagctttggttctattcaggccttcaactggttggatggagcccaccacattatggaaggtcgtctgatttactcaaactcagctgatttaaatgttaatctcatctaaaaaaatacctccacagaaatatgaccaaatatctgaataccggggcccagccaaattgacacattaccatcgcactaggggaatgaatggaatgatgacactggtttccattctgttgcgatgatccttcccatccgtataaggcctgacaatttccatgcccttgcacctatgtcatcttcctggattttttttttttttttgagacagtctcactctgtcgcccaggctggagtgcagtggggcgatcttggctccctgcaacctctgcctgctgggttcaagcgattctcctgcgtagctgggattacaggcacatgccaccactcccggctaatttttgtattttttatggagatggggttttaccacgttggccaggctagtctcaaactcctggcctcaagtgatccacctgccttggcctcccaaagtgttgggattccgggtgtgagccaccgcacacagcctccctggattcttaatacagccctgagaggtaggcagtggggcagtgcggggaggcaggggcttgttagatgctgcccatagatgagaacactgagattcagagagggcaaaataattcctagaggtgacaccgcttttcagagtggatggggtgacaccatatgtttgtttctactgttcttttccaaatcatacaacatatgagccattcatcttgtgccaagcactgttcagaaggctccatcctcatgacacccctgtgggaagcttccaccatcaccactcctcttttacactggaggaagctggaccggatctaaggaatctgcccagcatcacatgcctggtctgtggtggagctggcctatgaacgccaactctggaacctgtcctctggatggctgcatgagactgtctctctataggcaccttatgtggtcattttggtttcagaagaggtacagtaagcaaatgttcctggctggcgtgctgcagctgccttggcggggtggcaggcagggggctgtggcggaggctgaggctggtcgtcctcctctgccgctgacagtcccaagctctcttccctcatcatctcagatagctttgtggttgtcactgtgttgttttatatatgaatattttttatggatttttatatatggattgccgtgtgacttatgtttccctgccctaagcacaccgatgaaagtacattaatactcaaaatgactttgaaaagaccaaaagaaacaaaaaaagtcctaaattccgtgggaggaaaaaccatgatcctttagccctactccggaatagtaagaactgagagccaaagccaaggcggggacagcaccctgggagctgatgggctggttagtcccatcccagattatatggaggcacccgggtgattccatttcattgagaattctgtgtctagagcaccagacagtgaccacagaaatgtttaaacttcagcttttgtttaaagagatgtgctgtgagtatttatcgagccatggtctgtggggacactgctgggagagggagcatttctggaacccatcgtggctttcttccttgtctggcctcggcttttactttccttttttcatggacccctctatctcttgtgtccaaacccacctacttttccaggtctggctaagtgccttcttcctcccatgtcccacccctgtcccctactgagcccccttttctccgtgttttgtatcatgtaccatcccttgcccagatttctctgattaaccattcaccactctgttgctgtcaccgctttatgggtctaggttttctcctccactgagtctttaggctacttgagggtgggaatctttgttcctattgcgttcatatccctgaaaatgcttagccatatgtcagacagacagaactccctgaactgaaaaacacaaagatgtggagaatagcacagtccttatatgactttttccctgcttgtccctatcatttacccatcacctcttagtccatctggtcatccattgattcattcagaagacaggtattacgtatcttctatgtgctagttactttggggatacccagatgagttaaacatggtctctatccttaaggattccagaagttgctatcagaaagagttaaaaatcattcttcaggtagatagctcaaactaaaaatacctgttattatggccatcactccggcttaccatggcagataaggctgaaatttgtcccagataattggcttcctggtgagctttctccctccttctttttcactgagtatacgctaatattcctccagtattcatactgcatggtgaggacagctgacggtatagcagccagggaaggctgcacctgtgtttccattttagcgctttgatgtgctgcatgcggttgccctgcaattagttcatatgcgtgaatcacaatggcatatgtaaaacgtgtgctcatacagacccctctccaaagacctcacgcatcctttgcttctggagagaattcccctgaatgtatgtgatgaggaagttgggcttttcctctctgtgccaggctgaagcgaggggctttgctcaaggtcgtatagaaagtcgtctgcccttccaggccgtgctcttccattggaggcaacacctgggcgttctttgttttgcctttgccgcagagggagaaatgtcatatctttcaaaattccagtgtttcctagtcttctttgagaatgcccctgttaagataggtgagaagcaccaggggtaggcgagattcttggataatgtgtgtcctggaaggtggtgtattctggaatggggatgggaggaggggaaaaggataaagaagggaattcttttcgtttcaagcaatagaaattcaaactgtgatgcctcatggaaccagaccatgagaaggtcatgagcgcctggaactaagatctctcgagtgctccgggacgcttctcgcctcgtctcttacgtgtgcttcttctcacattttggcttaattcttcatttcaggccagctttctctcttacagctgccaccagcagactggacagactcctgtcctctctggccctaaactcaaaacttccaggagggagctcagatgagcgggcggttgggggtcaggaagcggctgctcagatgaagggggtgctggggttggggtgctcaggagcatctgcctgtgtggaagacgctatcctacaagaaggctggaaagacagacaaacgtcaccccctgcattttttgatggtttgtaggaagtgtcagtgagcatttaggagaaaaacccaagaccaggttacacagagcatgtcaggtctcaaatcccgacatgactcctgtcaaacccagtgccagggaggaggggagcccttcacccaatccgtatttaccgagcattgactgggtgcctgtgaaatgaggacttgggggggttcattttgtggaccactgatttcacaatcatttagcagtttccagggggagaaaagtggcctgcgtattcaacagagcttagagaagagactgtgtagggatttgcccagggagtgcagtagggagaggtgcatcaccaagaatatcggagacttctccttagcaggctcatcgtttccaaagagatggagatgcagtcccgagatagcgctccggcttgctggggacactggctccaggtggacagtcttacgtctgcctggcaatgctggctatgctggctatgctatgacctgcttcctctgtgaaacagctgctgaacaaaaatgcccaaattttagcacatcaatctcttcttcttcctcctcctcctcttcttcttcttcttcctccttcttcctccttcctccctcctcctcctcttcttcttcttcctcctccttcctccctcctcctcctccttcttcttcttcctccttcttcctccttcctccctcctcctcctcctccttcttcttcttcctccttcttcttcttccttctttcttctttcttcttctttaagaaagggtctgcttttgtcacccaggctggagtggagtggcgtgaacgaacacagctcactgcaggctcaacctccaaattcaagcgatcctctcaccttaggcccccaagtagctgggactaccagcatgcaccaccacgcctgggtaatttttgtatttttttggtagagatggggttttgccatgttgcccaggctggtctcaaactcctgagttcggatgatttgccggccttggcctcccaaagtgctgggattacaggcatgagccactgcatctggtgtttttgttgttgttgttgttttgagatggaggtctctgtatcatcaagaatggtctcaaactcctgggcttaagtgatcctcccacctcagcctctcaagtagctgagtttacaggtgcaagccaccatccccagccaagcacattaatctttatgaaaatgttttgtttctgcctttccccactcttgcaatggctcaccacagtcatcccattttcccagcagcgtggaactcacagtcagaagggcccattctccaaaattaaccccacctgagagttacattatgtaacacactgggagtgggggacaaggaacatctgtctccatctgtgccaggtgctaacttcctgtgtcgcccaggaacactcacctaacacctccgagtgcctccacaaaagtgccaggccatgtatgtgggacacttgctctgcagtgtaagcaaaaatgggtgcagttttaaaaatattgtagaattctagaactttccaaataagttggataatatcagcagttggtattcatataggttgaccttcacttggcagaacagtctgaacaggtgcgtagattttaagtagacttgaatttgaaggctaaggtcatccagatctctttgcggatgtggagctggaatgaagccctcctggctttgcctcctctgccgtcgtcgcagccggcaggtcccagctctcctctttcaattgctgtgtgaccctacggaagatattcagtttttctgggcctgaacttctttatctgcaaaacaggaaaacgaatcatacttcctcagagggtaattgtgaggctccaataactgtgctggagaaagtggggtatgaggcccggtttggggctgtgggagcacctcttccttctgttggtcctaggagctcagcgcttggtgggatgttccagaccaggagaggctgggactaaaattccagagtgatctatgggtgcagaagcttcagacgcctgttcaagagatgggtatcaggtgaggtgagtccatatttaggtctccagctaggatttaaacctataaggggaagaagcacaggtgagctacagtaattttggctaaaggtccaaactgaggccaatctcagggcatgtccctctaactagaggtaaggcatttagtcaacagccctccaagctcaaataggcagagggtagaactgagggggaatagcagctgttactaggaggctggtcactggcaaccttgggtttcaggagcgagaaatccatcctggatactgcgaacgcccttgattcttagaaaagtagggtcctggcatcaaagctggagcagtatggaacggatgactgcttagacacagggccagtgggtgatcaactacagcctcgtagatttctctttggaggactggagtgactcccaggctcagtaggggactctgtaggggactgagcttggagaagcccacggccaccctgcctccattccaaacaagattattcactccactcctgtttagctggtcacatggctcccccattccttgctctccattgcccttagtccaaagtccaaattccccagcccaaggctgcagggggctggctccctggcctctagttcctgcttctctcgcctgcccccttgactccagtgagtagtttttggtgctgcaaagaggacacactttctctcaccttcgggcctttgacctgcccgggcagggccctccccatcttcctcctttgctctgaattcatccttcttcttcaagctttaatttggatgttatcccttcaccccgcttccccaaggaagttccctcctgcccctgaggcctcttgccatgctgggctctaagtgggcatttatttctctgtgcagagtttgtccttctttgaaccaggtccctcctggacaaggaaggtgctagatacatgtttgtctagccacagggatcagagctcagaaggttgcggggacagggcatcctgcctgccctctctgaatgttcactttgagttacttcagttactctttacctggacaacataacgtcggggaaaactcatttatttgcaaaaggcaaaatacatgacactgtttcactcagaagcccctcagacccagcatctcgccaacctttgggcttaagaagtggtgaaaagatggggagagagtgactgaatgcatttttctgtctaggcaatttagtattacaggagatgctctcaaatccttgaccggagtgaaggcagagttcttgtcagttatgtaagaaaaacagctcattgttatatgatgcacactgaacaccatcgtgtgttttctcagtctttgtgtgtgcggacacgtggcatttaaattaaaatttggccaggcacagtagctcatgtctgtaatcccagcactttaggaggccaaggcagaaggatcgcttgagcccaaagttgagaccagcctgggcaacgtagggagaccccatctctacagaaatttaaaaagtagccagccatggtggcacacacctgtaatcctagctaaggctgagacaggagaatcacttgagcccgggaagtctaagctccggtgagcctgtgattgtaccactgcactccagcttcggccacagagtgagaccctgtctcaaaaatagaatattaattaattaaaatttaaggaattctgtttttactacggtgagtaacaaggttttttttttggtttttgggtttttgtcgagacggagtcttgctctgtcgcccacgttggtgtgcagtggtgcgatctcagctcactgcaacccccacctcccgggttcaagcgattctcctgcctcagccttccaagtagctgggagacaggcgcacgcccccacacctgcctaattttttgtatattttattagaggcagggtttcaccatgttggtcaggctggtcttgaattcctgagctcatgatccacccaccttggccttccaaagtgctgggactacaggcgtgagccaccgtgcccagcctatttttgtttttgtagagatggggggtcttactatgttgcccaggctggttttgaactcctggactcaagtgatcctcccacctcagcctcccaaaatgctgggattacaggcgtgagccaccacacccagcctaacaaggttttttgttttgctcctgtaggtctattttttttttttttccaatcagtattttcaatgttttggctccagacagatttcagtggtgcatcacatgttaccgacgtgcctcccgtgcctccctgtctgttcatctgctgtcgtctctgccagggatgctcgtctctcattcgtttttttggcgtggaaacacgctgctcagtcctcaggcccagctcccgtgtcacctgccacctgcaggccttcctcttgtcccttctccaggcactgtgcctgtgtcccctactccagaccgtgagttgtggatgaaaggggctgtatcttacttgcccctttttgcatttattcatgtggatacatagatgctcattcgcttcaattcattgaacatctgctactggccagggactttttcccttttggaaggagacccagataccctccagacataggtccggcctctcaggagttttcattctcctgagagaggagagagacttgttgagctatgcgtggagtgctgcctgacagcttgctattttctttctttcctgtgagataaaaatgtaccttatggtattactttattttaattctgccatgacatttgtggcggttgttttaagattcagagattactgggtgttgatctccttatgatactctcggttcctaattatgttagaaaaaaaagcaaagcgggaacttggcttttgtgttgccttcacagagtgtggaggttgaaaacatctcagcgcacttcacggaggttctcagagaccccataagtttctggaaaagtgggaaacgcaaacctgtcaacctgtcagtctctcccctctcacggaagcctgacatgtaaatctcaagttgttaaacctgctgtcaaatgagctgcctccactgaagactcccctccgctcctcgcactctcatcactgcccctcactctctgtccccacagcacagggacagcctccgcagactcccgtgtgtgtgctctggagagaaaagattctggatttgggcggtctcacctccaaaattgcagcccctaaggggagccgtgctaaggtgtgatacaggccatgccccttctagccccatgggacacctgactgatagcagcctgtgcagatgtgaggaacagaaggtggccccagaccccttaggagaaaccaaagtgcctcagagacaggacaagtgctaccccggaggccagtcaccaggtgacctgggagctgggaaccttttcagcctatgggtggctgtttatcacgaggggcattagacagacaggaggcagtgctgaaattcaacagcacaaagcaatttccagcttcatcttggcttattaataatgaaacagcaatagcgcaggcacaaatcaacagtaagtaggtgggtgggtgagacaagttggacatttggggaacagcctgggcagctaccgatacagagggaagccatttggtgtgtgtacctcccctcttccctgggataggagcaaacctgaaatgagaacggcagtcatctgcacacaaaaactaggttaggaaactgttttctaaggggccaggttgggtcactctttgtgacaagaaccgtgtgaaccacttcttacctgtaattctgactcagcattgatatttgaaaattcttccctagggctgggtactgagtactgttctgagtgcattacatacaacagctcatttacatacgtaatacattcacatacatcaatcatttgcatgtatcaactcatttatgtacatcaactcatttgcatacctcatttcatttgtacataactcatttgcatataccaactcattaaagttgtctcttttactagtgaggaaactgaggcctagagagtcatgtgcatgctgcatctctgcatgcttcctctgatggtttgatgtgggtcaatcctacgtctgtgcacatcttaacaactatcgtaggtgtagggtgcctttggtttactagaggtttcatcagtccacctgattctcactactgacgtaaatgtcagaggtggtcctgcctcttctcagtctccatcccaaggctctttacagctttctgtggcctgattttcttgctgtggatgctgaagggcactcttcagtggtttctcccagggccgttgcggattgcagctgtttcatacccagatgacctggggggcatcttcagtgtgtgcagatcagactcagcactgatactcgtcctccagccgtactttgtctccgcggtggtgctcagacttaaagcacttctcagctgtgctagtggtcccttcagagaacgaattatgctgaggcagagagggacctggggagggtagggaaggtcacaaattaaacagcagattagaggacagaaattcggtttgtggctttaatattttatactcagtatgacaggcagactcttcaaaaaaacataacctagtggcccaaatcgcaattttacgttatactttcaatataggaggaccctcacattgcttaaaaggggtcttcagggagaaatttacccaaaatttcatgcttggctccgtggtgacggcacatcctcactctgagaaccaggaccggcctcgggagtccaggttctgttcccagtttgtatgcacaccgatttccccactgtctgtcacaaccagtcaacttcccatgtgttaacagttactgaatctacctgtccgcacgtggccaagccccgccccccccttcccccatgctcttctctctgcctggccaactcctcaatcttggcaaagtccttcagaacccttgggtagtgtgagttaccttcctttgtatagaatctgaaaaatcattgccctttttttattagagtcaggatctcattgctctgtcacccaggctggagggcagtggtgcagtcatagcttactgcagcctcaaactccggcaggtctcaagtgatcctcctgcctcagcctcccgagtagctgggactataggcatgcgtcaccatgcctgactaattgtgttattctttgtaagagatgggctctcactgtgttgctgaggctggtctcgaactcctggctttaagggaatcctcctgcctcagcctcccaaagtgatagaattacaagtgtaagccaccacacttgtccatcattgccttttaatctttgcatcctgccacctccccagcacagccagcataggagccggcacttagtacatgtttgtttggggaatgaatgtgaggtcactagtcaatgattctgaaatgagtctattgaaggtggaaaccagcacaattcaaatgctttgcgttaaatgccagtcagtgtctcttcccaaagacccccactgaacccatcagatgtaaaatcccccattttatcaccgaacaacctgtttccacccatttcccttattcactaaacaacccgtttccacccatttctcttgttccttcttattgcagtgggggacgtgtctttgccttctttcaagggttaatgtttccaagtgggttctatcttctcaaggatcactggtctttcgcatataccctcttgctcccgaatcattaagaactcctgcccattggatgatgttgctgtatctccaattatattttgaaactttctccctctcacttactcctccacgtgtcccatttctctgccttcttaatggccacttctcaaacacatggctgacagattccggaggccttcaactcccacctatgaagcagccagtggcctcgggagtggggctgcttgagactgtgggaacgatgttttcgttaagaatggactgcctgtataatggtggtcccataagattataatactgtgtttttactacaccttttctatgtttaggtatgttgtttagatttagaatatgtaacgcaattaccgctgcgttaccagcaatcccaagaggaccccagaccctctgaaggaagcgggctcctgcaggacccgggagacagtgttgaacttgaccttgctctcctcctcgggtcaggcctgccgaccctgcactacaggttcctttttctctccctgtccgtgcatccatctgtttctgcactctcttcggtgcatcctctgaaccaccagaattaggttcctccacaccaaatgtgatcatttcatttcgcagctagattgctcgtgaacagctaagcaggtcacgctgagctcgacacagtccaatcccaagtaccagtcaggctcccaccgtcccttcctatcccaaaatgtcacctcccctgtgttgcagccacactgaagcctcaatgtcccctaaacattccagaccctcttgtgactctgagtctctgcccctgggttcacgccacttagaatgagcttccccccattttctgcgatacacactgtcactttccctgggaacagattcgacctgggcagaatgctcttcagtttgttcctatctctgccgggatctatatgttctggactctcttctacgacacggagacctttcccggagcaggaacggggccacggccgtgtttgcattttctgaacccaggatggtgccactgtggtttgttctccccgttcaagtgttgctgactggtggggagggacagcatcgcctcagtgaaagttttgggttaaacactgtctgcagtaattcaaaaggataagaaggactcctttcactgtgcatctttagacgaagcatcaacaaaggctttttcactgaaatccaaactcaaggtgtatacatgtcacctcccagcacagcaaatggcacagactcgagggaatgttttccttccggaacaacattataaagcagcagcccccagcctgtaggcaccagggactggtttcacggaagacagttttcccacggaccaagggtggtggtgggggatgatgatttcaggaagattccagtgcattccatttatcattagattctctcaaggagcgtgcaacctagacccccacatgcacagctcacaatagggtttgtgcttccatgagaatctaatgctgctgctgatctgacgggaggcagagttcaagtggtaacgcttaccttctgctgtgtggcctgcttcttaacaggacaccgactagcactggtccgtggcctgggggttagggagccctgctctgttacagagaacaaaatttgttacgtagggatcacttgagcccaggagttcaaggctgcaatgagctatgattgtgccactgcttttcagcctggctgagcgagaccctctctataaaaaatttttttaaagagtaaaatttgtatagtttttgggaatttactatggtgatattttatagcgctgtcaggaatgctctagctattggtgggccctcagagcacagtgaattcgagggctctgatgtattctgttgttttttttgggtttttttgttttttttattttgagacagagtctcactctgttgcccaggctggagtgcagtggcaccatctcagctcactgcaacctccacctcccgggttcaagcaattctcctgcctcagcctcctgagtagctgggactacaggcgtgcaccaccacgcccagctaatttttcctatttttagtagagacggggtctcactacgttggccaggctgctctcaaacttctggcctcaagcaagttgccctcccgggcctcccaaagtgctgggattacaggcatgagccactgcgccgagcctctgatgcgttcttgccggtcatttgtacagtgttgcttgcatgtgagttcttcttcaggtcgagattaagggtatgacattagtactaaccattattcaacctctgaaatatacgcacatgggacaaaggagataatttcatttacttatgtggccttactttgaagatattcatatgttagtccattttgcattactataaaaaatacctaaggctgggtaatttataaagaggtttaattggctcatggttctgcagctgtacaggaagcatggtgctagcatctccttggcttctagtgaggcctcaggaagcttccgatcatggcagaaggtgcaaagggagcaggcatgtcacatggcaagagtgggagcaatagagagaagggggaggccccagactctttaaaacaaccatttctcacatgaactaactgagcgagagctcactgatcaccaaaggatggtgctaagccattcataagggatctgcggccatgatccagtcacctcccagcaggccccacctccagcactggggattacatttcaacatgagatttggaggggcaaacctctgagccatatcaccatagttagtgcatgccagatgatttttgcgtttcccacaggatgtcagtgagcctttttctcagtcatggccagccccaacagagaggcaagatgagttcctcttggttgtgatgcctcttttcttttcagttcacactttatgccctttggcttgctgccaggtgctacctttcacccaaaagaaccacaggctcctcacggattttgcattccttcagggtcctgccagttactggcaaattcaatgataattgtgctcactgtataaaatactttctggaataaggtaaaatatgaatgaaaaaatgcacaaatgccaaacaaatacagttgcttgtgctgagattttgttttaaagaagaaagagaaaaacaaagaaattaaggacagcattgcgatcacttttcttcctccaaacaaaagctttcaagcgcaacatgttgatttttaaaattcctttctgggctgggcgtggtggctcacacttgtaatcccagcactttgggaggccaaggcaggcggatcagaagatcaggagttcgagaccagcctggccaacatggtgaaaccccatctctactaaaatacaaaaattatccaggcatggtggtgtgtgcctctaatcccagctactcaggaggctgagagagaagaatcacttgaatccgggagatggaggttgcagaaagccgagattgcaccactgcactccagcctgggtgacagagtgagactccaactaaaataaattaataaatacatgaataaataaaaaaataaaattcctttctgtagccactgtgagccaaaagcacgggcttaaactgcagagtgctgtgtgtgcactcacaaatcccaggttcccagagtggagagccctgcaccccagccgcggccaagggtcagaagtagcaactggtgattaatcaagtggctcctgtcttaggacagtcagcgtttattgtctctgcaggccagactatagaaataagcagacccacaaaagccagcaattaatatttccccggagagattccagatgctgccgggtggactgtgacatgctagcattcttcctgctcctgatttattccattgtgtggaagagcttccacagaaatgactctttggatttttcaggaaatgtttcaagccttcttattcagacaccctttcagcgtccagtgatggacgaagctgtgccctagagtcccaccttcccaaacagtgggcaacttgctttctccagcctcctgtccccttccgagcacccttcacccctcccatccccaggagtcgctgaataggtcccatgggagagaaatgacagcttgaagtgatgacccatcccaccccatcaaatgttggcattttactctggcctccaaaggcatggggggatgacccatggcaggaatacaggccttacagagaggttcactccaaccaaaccatgctgctcccccagtggcccaccatgaaaacctctggaaaaccaacttatttgccaaatgactcccatgagcaggcctttgcaaaatttcagagtgttgtacagctgcatcccaggacaaaactctttcttttcagtactaacagtgcaagtagaatagggtcgtggtggagcatcccattgtcttcattcctggtccactaattttcatctgagttaagagttttgggtttgaattcaagggaaatgaaaagttcttaaaggggccgggcacggtggctcacacctgtaatcccagcactttggaaggtggaggcaggcagatcacctgcggtctggagttcaggaccagcctggccagcatggcaaaaccccgtctctactaaaaattaaaaaaaatagccggggttaatcccagctactcaggaggctgaggcaggagaattgcttgaacttgggaggttcagtggaggttgcagtgaggttgcagtgagccgagatcatgtccctgcactccagcctgggcaacagagtgaaactccatctcaaaaaaaaaaaaaaaaaaaaaaaaaaaaaagaagctctcaaagggcctgagccaggcaccgtggctcatacatgtaatcccaacactttgggaagccaaggcagcaggatcacttgagctcaggagttcagcctgggcaacagagtgagactctatctccacaaaaaatgttttttaaaaattagccaggtgtggtggtgcatgcctgtagtcctggtgggtggccaagtcaggaggatcgcttgagcgtaggaggttgaggctgcagtgagctatgatcatatccctgcccttcagcctgggcaacagagtgagaccttgtctcaaaaaggaaaaagaaaatggcttgaaaggcatgtgagacattacatagtttgaggtatttcctttgctatatgcaaaggcataaaaatgaacagggagctagcggtttattgctggtccgaaccagcaacatcacagctggccctgggcgtcacagggtctcatgggggtaccttaagaggattcttaaatgaaactcagaacacagagaagtagttgattttgtgtcttgcatgttctgactcttcatttagtgtcacagcaagggtcaaggatatgggaaatcataaacaatcccaagagtttcatgatctttgagaatcttaaagcttcatctaagctatgcttttgaattgggcagaaccagaatggatacaagatgaatacagttcaaatgattctaaaactagagattaaatcctgtgaatttcctactctcagcaggaggagattacaactatttccaggtttaagatgatgaacatgattggttttgccccgtgctcactgggctcagatgagaaatagctttaaggtgcatccagggtttggttggttgtgaagaagaatattccttgtcgtcaatgaataaatgttgtgataggtcattagaggaggatctagagccctttgctggaaattgtttgaatttgaagccagagaagtaagcaagtaaccactttgttctccttctttctctttgtttactccattgtacattgactgtctcccaaagtatcccaccgagccttaagaaaaagttccccttaaagataacagaactggaggattcagctaggggctttttgattagtcaagaagcctttgattggatggacatgtaatcccagcactttgggaggctgagacgggaggattatttgagtttaggagttcaagacaagcctgggcaacatggcagaaacttgtctctacaaaaagtacaaaaaaattagccgggcatcgtggcaggcacctgtaatcccagctactcgggaggctgaggcagaattgcttgaacctgggaggcagaggttgcagtgagccaagatcctgtcactgcactccagcctgggcgacacagcgagactccatctcaaagaaacaaataaacaaacaaacaaaaaacaaaaattagctggatgtggtggtgcatgcctgtagttccagctactcgggaggctgaggtgggaagatcacttgagtccaggaggtggaggtttcagtgagccatgattgcaccactgcactacagcctgggtgacagagtgagaccctgtctcaaacaaaacaaacaaacaaacaccttgattgatgatccaatatagttcttttgttgttctttgggccttcttttttttttttttttaatgatcacttatctttcccttgagggaaacctacgttgtaaatagagaattttttttttttttttttttttttttgagacggagtcttgctctgtcgcccaggctggagtgcagtggcatgatctcagctcactgcaagctccgcctcctgggttcacgccattctcctgcctcagcctccggagtagctgggactacaggcgcccgccaccacacccggctaatttttttgtatttttagtagagacggggtttcatcgtgttagccaggatggtcttgatctcctgacctcgtgatccacccgtcttggcctcccaaagtgctgggattacaggcgtgagccaccatgcctggcctgagaaaaatatttttgatttccactttatagatgagagaattgaaattcaggttaatgatgccactcaggcttgaaacttcagcatcatttttgtgtttcttctgcacatcccacattcggtccatcaccaaattctgttaattttttcctcgtgatgttactggcatctgtctttttctcatcacatccactgataccaactggggctttctggatgattatactggatttttccattaccttccacatgctggtcttacctccttgatgcctcccgtaagtattttggatcttgggaatatgaattcatgtctgttcccttcgtttggcacccccatgggttgtgggcacagaggcagggaggctctgagaggcatgggccaggaaaggcttttcagagatttctgagcatacctgtgtcccttacaccttattctaattcacaccagctcttggtgtttgctcttcgactgtggacctctgtggatggtagacaatttgtgtgagtccacgagcccttcagtgttaaacatcattaaacataaggtcgcaaaagtcagctgatgctcaaactgaaattgttgtattttgttttgttttatgttattttgtttcccagaatgaggatatattggtcttattgtgctatgtgttagagccacatattctttcttctgattctgtgttcacattgccttccagatatcatcaaatctaacatgttaaaatctaacataatgagtgaaaatatatcagcgagaatgataatagtatctgctttctaatccatgtgttcatcatgggaaataacaaagctgcatcatatcctgtcttgtttctatcatgtcctcttctccagttagatcctaagtccctccatgacaaagacctggattcgttcacacatttagtgattcagcaaaacacctagtaagtaccccttgtgtggaaagccctgtacttgcctttggtcctatgggagttgcgttgcttgatgttagtgatgtacctaagggtggtgttaggactgaccggggctcccctcccaagccccacctatgtttttaatcacaataccatgcaacttccaaatcaacgctgttgatagaaagacacctacccagctctgaagagttatttggtccctagatcaaggggcagataagtcagatttccagaaagatagagcctgcctctttgtcattccatctccactattccttcactgatgagaaagtgatcagatcagaactgatgttgtataaactgctctgtaattcctgcctgattggcttttcttgagaggtgcctgtccattagcttttgccttccttttgtcaggctctctaaacactttaagtaacagaatcaattaagccttcctcacgattttagaaaactaagtggtagctcaggaggggagtcatcctaacaagctgtctgtgtagacagtggattctgtattgtcgcttttgtttctcaaaggtttgggtttggtcagaggttaccaaggaaccttcgctatatttccacagattcttttgtgagcctctagttcacgccctgtaaggacattcatccttctctgtccttgggagacgtaggaaaattatttcctggagaaatcaggcgcttgtaagagccagcctttcaaagaggtatctaccatcaaaggggctaatcgtccgagtgacagacacgcatggctggcttccctctttactctgccttgattgagacaagatgagcgtgctgctggccttagcaatgggggattctgttagaacaatatcctcagggaatagcttttatctgctaagtatgacaagtgtggcaactgtgcacagagtccagatctcacgacctcgctttgcaaaggctacaagaccaagggcttgtgtacctgccccaacagagacaggctgactcttactacgtggccgtaggaatggtttgcccttgctcaggacttatttacctaatgtcgtttggcctggaatgtttcagagcaccctttcatgcctggtcagggttgtgatcccttttggagacagaaggaggtagacgtgcttttgtgtttccgacactgaggacattgaggttctgggggattcatcacttagctcccaactcttattgggagcagaagtgccactggagtagggtggctggtttgagggtgtggccccgggaaaggtggcaggacacacttctcttgttctccagcccattttcaggcacggtatcctgcgctgctagcaccgtagccatcactgacctcaggaccctcccggtgaacactcagttaaaattcctactcgctgcagtgggaaattttatgttatgtgaattttatctcatgattaaaattaaaaatgaaattttaaaaatgaaatattcagttgcctttcctagaaggaatcatcccgatgatactattccttacttctcacattcatcccattctaatgcccacatttacttcataatgtattacctacgtatagtgtatgttgttcgcttcatttagcatgaccctatgaaatgcctgtgtgaccaaaagcagatcaactgataaggccttttgtggctcagatgtgtctttgcggggaaatggtcaggcgtcctctgttggcaagggcacctgtcccaagcagaaatggagaaacacgtcctcacctcctcctgccacctgctctgaacagattctgtagcgtaaaattctttataaatacacatatcaatggagttcttgacattttgcccagaacctgaggaagaataaaacctttcttgtccaactaaaacacacacggaataacaagcaaaagcaaaagagaaatcccaagaaaacagaccagaaacaaagggttatgctccgtcattgtccccaagagggttacacatgagactcacagggcaaattttatctaaattaaaatgctgatttttcacattacaggcccaaagtttaccgaggtcacagtgcttttaaaattaatgaggccgggagcagcggctcacgcctgtaatcccagcacttttggaggccaacgcgggtggatcacgaggtcaggagtttgagaccagcttgcccaacatgacgaaaccccgtctctactaaaaatacaaaaaattagccgggcgtggtggtgggtgcctatagtcccagctactcaggaggctgaggcagaagaatcgcttgaacccaggaggtggaggttgcagtgacccaagatcgagccactgcaatccagcctgggtgacagagctagactttgtctcacaaaaaaattaaaaaagaataataataatgagtgaagattagcttcctctgaagtcagttccttgtggatcatcttattgcttattttttaacttatttgatatctcactgacccctcccgaggcagaaatttgcttttgctcattgcaaactggccaaggaaaaaaaaagaacaatttcctctatagagtagttcccccttatcctcagatagccttccaagactcccagtgaatgcctgagacctcagaaagtaccgagccctgtatgtgctgtttttctgatctggtaaccagggcggctactgagtggttaacaggcaggcagtgtagacagcaggaggtgctgggcaaaaggaagactcacatcccaggcaggacgaaatgagatggggtgaaatttcatcacactactcagaatggtgtgcagtttacaacttatgaattatttatttctggaattttccacttaatattttcagactaaggttgactgtgggtaactcaaaccttggaaaacaaaaccgtgggtaagggaagactgctttaagatctgagaatgaggactgacatgttttggtttggctggtggtttcagatccaacctcagtagttcctagagaccatttaatttgtttttgagatggagtctcgctctgttgtccaggctggagtgagtggcgtgatctcggctcactgcaaactccacctcccgggttcaagcgattcttgagcctcagcctcccgagtagctgggattacaggcatgtgccaccatgccaggctaatttttgtatttttggtagagatggggtttcaccttgttggccagactggtctcgaactcctgacctcaggtggtctgcccgcctcgacctcccaaagtgctgggattacaggtgtgagccaccatgcctgaccgagaccatttaatttgaataagtgcccaagaagcaaaggactgagccaggcaagatgatctgagagcaggaaggtgtggccaggctggctgagccatgaacaggctggttgctccagggccggtgtctcccctggaaggttctggagttcaggctgtgttggagtccaccttctgcccctcaagtccatggcagggccgttgactgctgctcttgcctgagtctcctggttgcaaaggccaggcaaggcactgcctaacgttgtgactaacatcgtgggtgtgacggggagtcagggtggcttctctgttgccccaagtatgccctgcacatcaccatcttccttttcaaagaatggtgaaaataggaattgtgctctttagggaagattgtcttttttatatctttttcttttttttttctttttttttttttttttgagacagagtcttgctctgttgcccaggctggagcgccagtggcgcgatctcggctcactgcaagctccacctcccgggttcacgccattctcctgcctcagcctcccgagtagctgggactacaggcgcccgccaccacacccggctaatttttttgtatttttagtagagacggggtttcaccatgttagccaagatggtctccatctcctgaccttgtgatccacccgcctcggcctcccaaagtactgggattacaggctcaagccaccgcgcctggccttttatatctttttcaaagaaaaaggtaggctgggggcggtggctcacgcctgtaatcccagcactttgggaggcagaggcgagtggatcacctgatgtcaggagttcgagaccagcctggtcaacatggtgaaacctcatctctactaaaaatacaaaaattagccaggcatagtggtgcacacctgtagtctcagctactcgggaggctgaggcaggagaattgtttgaacccgggaggcagaggttgcagtaagctgagatcgtgccactatactccagcctgggcaacagtgtgggactccatctcaaaaaaaaaatgtagaaaaataaaaacaatcatctattcatggctaggtagaggtcagatttcactcactgacctgtttttagattttccttcgatattccaactcttagatatgtcaggttgctggagttgctgactgcactaacttctgcattctccaactttcccctcagagagtggcttgtctaaatcacccaaattaccatgtgggtgagaatgttggggaaatgaagatttaaaatccacaatattattagtgctgtcaatatcataatatcataaatgtccatacgaggaaaggagaccttggcagaggctaccttttctatctgttttgtgtgtgtgtgtgacattcttcatgaatgacttcttgaactatgaaaatgaggcaactgtggcctgaactctctcatttgcctcctccccttcctggcatttacttaagacatttcctgatgcttcccgggggtgtttcatgctggtgtctaagccagagatcacacctcccacccaccatgcctgcacctccactcctgcaaaggtttttagagtcagggtccctatcagtgtctaagcatcaggctcttcagaccctgacctttgaaaagtccaaatggctcttgagtgccccattttctcccaatctgaaaactgtaagaatgaaatataacaattaagcctcagaggatcacaagcgcaggtgatcctcatgagcccagactgatatttctaaattatctagatcttccttgaacatagactccagagttaccgggacgcagcgttcccattccactgggcagccatctatacgtgaagtgtcattgttggtggtttgggagttttattttccctttcataacacgtctcctgtctcctcagctcccccagaactccctgtaatcatatttgctatcagttgtgtttgtggaggtgtagtgaatttttcagggatgaataccaatgctgagaccctccaagaagacctgtgaggtcagcctctgtcagcgtgacagcccagtgggagggggccccaagctacacagcaggagatgattgtcacacgtcctggtgagagagcctgctcaccagctctggacctgcactccgtgtgcctggccagtagataggtttccctggtgttccccaggccttttctgcttcatgacattgattatatagctagcatttcatttcagtagggcttgggaaagggggttctttattgcagctcctgtaaaaacccatttccacacgaatcacctctggcctttttctgtctggcacattgtttagacaggaggggtttgtgtgtatcacttccctccagcctctcctaagtggaagcctgggatttggaaattgggatttttttccttctctctaaatgaatgccttgttggataccttgttgataaaatgccatttctcacatctttatagcttaaggggctaccttagccacaaggcacagtcccttattactgataagagctactgtcatttcacttatatactttgggagattcatttttgcttctcagcatcatttatgttatgattcatatctaaatttaaggtaaaattttatgcttcaccatcgacttttcaaagtttgtctttgaaaatgatttttaaaatgatctaatccaaacctctcagtttacaggtgagaaaacaaatctagggcagagtttttccacaggggcacgagtgatgtcatggaccagatgtttgtgtcgtagggggatgcctggtgcactgtagggcatttcctgggatctcaagcttctatcctctggatgccagtagcaccctccaagttgtgaccaacaaaaatgtcccctgtcacacagctaagtcataacagagtcaggcataagacacgggtgtcccgactcccccatctgccctttccaggttgggcaacagaattaagctctcaacccacacagagctcagagaattagtcaagagcacttccacaatctccagggagagaagagggtttaggagacaaaagagccaacagcatggaagagctttgtggaactctgggcgatgcatcccctacatggaagagctttgttgaactccaggcgatgcttcccctatacggaagagctttgtggaactcggcagtgcatcccctacacggaagagctttgtggaactccaggcgatgcatctcctcaccggaagagctttgtggaactccgggcgatgcatctcctcaccggaagagctttgtggaactccgggcgatgcatctcctcaccggaagagctttgtggagctccgggcgatgcatcccctcaccggaagagctttgtggaactccgggcgatgcatctcctcaccggaagagctttgtggaactccgggcgatgcatcccctcaccggaagagctttgtggaactccgggcgatgcttcccctacaaggaagagctttctggaactcggcaatgcatcccctcaccggaagagccttgtggcactcctggcagtgcatcccctacacggaagagctttgtggaactctgggcaatgcatcccctaaccggaagagctttgtggaactgcggcaatgagtccactctccccagtctccctgtctacgaatagaacttggcccagtgagtcactgactcaacttctgtgatcttctactagacgatatggtttagaaattcataagatgtgtgtcaggagttaacaggtttaggggaaagaacagaagaggcggaggaatgtctccccatgaatgctgaccctccacatacccagaacctgggactagccccttggcaaagactccatgagcctcatacagtgaatgggactcgttctcagccaggtagacatcagcttgggtctgacccccatccttgtgtgcaagtcctgattcacagagtttctttggcacttttgcttaagctgtaacaaacagccagtctgcacagggctcccttctgtctttccctttaagtcggctcacatttctctcctggtcacagctgtagaggacacacacagcacgaaacatgaggagtgtggcaagtaatgaatgcccccagggtattgccactttctgacagatgaggacaaatgtaatttccagggatttcatagctgagagattagaagctttcctgctgggcctaattctggagccaggtatgaacctgtgtttcccttgtataaaggtaaaagaattctgttactggggctgtggatggagccgattttaacatttgttttttgagctccatctatagctcgtaaggtccaccaggctggtccaaggtgcctttcctctagacacaggatttcatttagtggctgtgcctacatgcaaagcagcaacttcattcaactctctgggtctttgtcttagtgatgccagaaataacaaaatagaaactgaactattacatgaaatgacttttgggttggaaaaacaggctctaagaacagagttaatgaactgagagaaaatagtttctggttatgctactagaaactgtggtttttatcctcataaatcattgctttagggaaaaaaagtcctttctaaacttttcctgtcctgtttccttttcattttttgaatgaatgaacagtagggtattctctgtctttgagttattttcttcctagccacctggtcataatccagagggaaaaacaaattagatggattctgtgagctatatttcattgctattggtgtgtggatcacaatgctttattttccaccagttaaacgaagaacattctggaaactttgcacaaagaaaaattagtgtttatccctacagttgaaattttctaggaaaaaaaaatagcaacaaattaagttttgaaaaaggagagccaggtgcagtagggtgcatctgtagtcccagctactcaggaggctgaggcgggaggaccactgcagcccaggagttcaaggctgcagtgagctatgattgtaccactgcactccagcctgagcgacagagctagactctgtctctaaaaaaagaaaatttaaaaaggaggcttggctgggtgcagtggctcaacgcctgtaatcccagcactttgggaggctgaggcgggtggatcacctgaggtcgggagttccagaccagcctaaccaacatggagaaaccccatctctactaaaaatacaaaaaacaaacaaacaaacaaacaaacaaacaaacaaaccaaattagcccggtgtggtggcacatgcctgtaatcccagctgcttgggaggctgaggcaggagaatcacttgaacctggaaggtggaggttgcggtgagccgagattgcgccattgcactccagcctgggcaacaagagtgaaacttcatctcaaagaaaaaaaaaaaaaaagagctttgattttcatgaataccagtctatttctgaaggtttcccccttggaggaacagtggtggcgggctggccctctcagtcaaggagacgtgagcattccatgagacacgggtttcctctagggtctgcccctgaggtacctgaggtttggatacctctgcccactcccctctgccatgtttttccagctgtaccgtgccgataatcactgtgtcagctgtcattaccataatgctctgagcataactgctgtaacagctgggaaagaactctgcctttgcaaaacaatgctgcgtcataacacgctaaaacccccaatgtgcccacccaatatttcctatccatttgccccttctgcactccacaggcatgatcttccctttgccagtgggacatcagaatgagactctcttctgtcctccctctccttccccaagaacagtccttgcttgcaaatgcaaacagagaaaaagatactacccgagtgagcaggtgtttccgttggggtctgacaggagaaagacaccacacttagatcgggactatttagaaaagtatggatggagtgtagaaaatgaaaagggctaattagatagaccagggctagtcatagcagagtgccaggatggcctaggtccgaagggtcaaaaggagggaaccatgttggggggacagaggaaaggaaggtgtggcggagcctccggactcgcctcctccctccagagggcaagggggttctgctgatgcagtccaggcaggcccactccctggacaccaggagagtggaaaagggtggagactgagtctggagggcacggaggaaaattggctcagcatggattagaacagtctttcgcttcctggagcttaaaagccctccttacttacccttagctcctgccacctctctttgtccttggatggatacagcgcatgcctcctgcctgccacctcatctgtggtttctcatcctgtttgctgtcctccttcctcgttctgcccatgctgtcataatggatggaaaagctaaaggtgatttccagtcatctcttttgctgctgacagcatgaagtttgttctgctattagaatgacgcagacccgagacaagggttttgtcctgagttcattccattaatttctctctgcatagagcatctttccagcagctcctgcatgattaaattctggctgtgtgggacacaatggcacaggaagagcgttggccactcatcagccaggtcactaaaaggcaagttccacacatgaggagaaatcaaatgctcaccctttggacatccatccttttggtcctttgagtaacatttaaacaattgtttcttcagatacatggtccacactcaagagacctacaacagttggtatcacctggataagtattcaccaggctctctatgcccagttttttcccaagttccaaccaagagctattgatggctttgctcttgatcagaatagcattgggttttgctgcaaatatattcttgagcattatagtgatgaagaaagaaagaaagatagatagatagataatagagaaatagaagataggtagatagatagagaaagaagcttgcgtgtgtttgtttcaaagaatggggtcagttttcttacagccacctattctctcgcctggacatatattcagtgaatgcttctgtttgtaagatggctaactgggatatgggtcttacaggtcttcagttcctataagagtctacaaccacagcctcattaacacatgctctctggtgaaaagacattaaatggggagggaggaggtgtggatgctacgctggcttcaccacatgtaattattgaactttgtatatcactttacctttctgggtctcagggaccttgtctagaaacccaacaaggcaggctgtggtagctcatgcctgtaatcccagcactttgggaggctgaggtgggaggatttcttgagcccagaaggccgaggccacagtgagctgagattgggccactgcactccagcttctgcaacagagagagaccctgtcaaagagagaaagaggaaggaaggaaggaaggaaggaaggaaggaaggaaataaataagcaataagcatgaagtggcagttattctccaagtgaacagtgtggagtaactgccattttactggtactcaagtacttggtgtaactgctacatccaggcaactgctgagacttgagcaaggacctttacagcctttggaagtcccatccgtcagacacaccagggagcccgatgctgaacttcatgtctgtgtttgctgaatgatgagcaggtcctcttcagcgagagctacacgagctgtgaatttaccacgtgcccgtcaagggggtcattgtgttcctcactctgtcaataaaccacacagtaaagatctggataataggagcagaacagtttcaaaggacttgttacaatgtatcaagtcaataacttataattttagaaaatccctgaatacaaatttgcacaattttgagttgttttacaacttaccaggccgttaatctaagttttaaaagtctcttaatatacttaatcatagcctgtgcttttttttttaagtgctgaaatatgtttcagcattactgaaccacagcagcacaaggaaaaaacgactttaactcgttccataaaacttgcaaagcaaccataaatatatacagtgtggggtctgttttgtgcacaatttatatgcaataggctgggcttgatcgagaggatttatgcttatcgtctgtctccccaggcagacaattgtggtagaaaagaaaatgcacaggacctagagtcagggctgggtttcaatcccatttctgccacctgctttttgtgagaccctagggaagccttttgctcctttgaacctgtctcctacttaacaataatatgcccaccttagagggcagctgtcaggattgccacagagcaaggcagaggtgagccatctgcagatgcgtgctgaatttaaaccaatgcatgagtgacacggagcatgagagtggccagcatccttcctctctccctgcaccccgcaaaacaactccatcccccactctctctcagaggtggcagcggccataattcagacacatgcaacccagccagcgtaaccaccccctactcaccccctgaaaatagaagaagaaaggatttagagtctgggcagattgcttttaaaacatttccaaccttcgatctaatttgtcattattatttgtagagctttctttctcttccttcgtatctcctttcatatccggagcattcccagggaagatcccgttgctgaatactcgtgtctccagttttctacccggacttaaagatctactggtcctgcagagctgagctccagtggtgtgaaaggcacgtgagcgatgctgggcttgtggagatgagtaacacacaggcttgctttcaaggcactcacagccttacacatttgaaaatgagtttttcactggagcctgaaacttccagatttgaaaccatctccggggccaagcctggctgagactctctctctctgcatgagctgcctgccaccatcagttccccacccagatacccaagcctgaccttgacctgctgggggaaattcattatattctcgtttactccattttatagacgaatgtttcttatcatgaatgagagttcgttaaatcagctggttctaggtggagttcactagagccctctccaatgctgccggaggacctgttgccgtctgggctgtattgtaggtgggtggtatcataataagatccgtggtacacgaatgggcttcagggcaggcctgggttacatcaccacctcactttcggtgtgtcaaagctggaaaaaacagctggaaggtggccagtgttcgcttacccaacgaagcatgactttgcatctcctctaccctgcccagtgagggctccctgttttgaaggactggcatattctggaatgcttccaccaaatccaaacatcattctggatgaactgtggagcagttcaccgttcacagttcacaaaaggaccctctgtagaagcagaggatctttccctggggaaattatcctaagtcttctgattttaataactgatatagttcaagtatttgtccccgcccaaatctcatgttcactgttaatccccagtgctggaggtggggcctggcgggaggtgactgcatcatggatccctcgtgactcggtgccatcctcatgatagtgagttctcccaagatccggtcatttaaaagtgtgtgtttcctgccccgtctcatgctcccattctcatcacgtgatgtgcctgctcccacttcaccttccaacttgagtcagagctccctgaggcttccctagaggctgagcagatgccagtgtcatgcatacacagcctgcagaaccatgagccaattaaacctcttttctttataaatacccagacttgggtatttctttatagcaatgcaagaacggcctaatacaataattgttttccacatgaaataaacattgaccgtcttatccaactatacatgcttcttgactctagaaattgttgaatggaagtgctaaagattatcctcaaacacactcatgtgcacacagtttcagtgccagaacagtgtcctctaggaggaaagatggtcccagagcaattactggtttcctttaattttggcttcctaatgagtatcattttggtacgattccaatgaattgtttatttgaggaaagagaaaaagaaaagaacctataggaagagttggtttggattctatcgcgggcagtttatgcttctacgatagtaataaaagcaatgagagaaaaaagctacagaaccaaataaatatagatccaggagttgtacaacttttaaaagaaaaattctttagcctattgatccttcctaaggtaaacatttattttatttcagtttagaactcaagaatttttttcaagtacaactgaggaatagagtcagaagccacttcgattttgacaccatagaaacattctttctttagttactagaatcttttaaattgataagattggcattttcccaggatataacattcacctccactgtgtttttaatttgcaatagattttgagggaaagattccacaaggatttggccaacatgcctcctgagcagtgggtctcaagtgtggtccccagaccagcatgatccccatcagctggaaactgttagaaatgcaaattgtcaggccctaccccagacccactgaatcagaaactctgggaggggaaaccaacaatctgtgtttcaacatgaagtctgagaacttaaactatgcaccgttcttggtaagaaaataagagttttcctttgtgtgcgtatgtgaaaccaattccctgcaacccacagttgtttaaacaaaaacgtgtctagggagttcaaattaggtggccaattgccttataaaagtttacaaagtaaagagtctgtgctgtttccgttaggagacagaaacccaatcactaacttggagtatgagtcagaggcaggacagagaaatgtctgtctagtcggtgagctaattaatacgtgatcctgaggatggaggagccagggctgccgttccttctccactagggaaaaaaaaaaaagatgtttctctgtcaggcagctccctagctacctccagtatgttctattccatggctagaggagtgcagcctacatcctgtggatttatgtatattactgtaaaacaagctttctcttctcgagagttccgaagcagatctgtctctgattctttccatgaattcaaatacattgtcatccttaggtttcctaggtaaaggagactgcattactcatcagcatttaataaatattcatttgttggttgactgattcattatccttcatgccaatcacatggctgctactagcatgcatacagccgactcttaactacagttgtgtcatctacacaatccctgcagaaaactcattgaacacgtagtcgacacatttaaaaatgctgtgctgtggaagtgcaagttgcacaaacattttcatctttagcttcacttagaatacatttttttagttttttaatgtttttagagacagggtctgcctctgtgacccaggctggaatgcagtgctgtgtgatcatagctcactataacctcaaacttctaggttcaagtgctcctcctgcctcagcctcccaagtagctggcactataggcacacaccaccatgaccagtgtgtgtgtgtgtgtgtgtgtgtgtgtgtgtgtgtgtgtttgttttaatagagacggggtcttgctatgttgctgatttcaaactcctggcctaaagcaattatcctaccctggcctcccaaagtgctgggattgcaggcatgagccacctggcccatctataactaacttcataacactccaaattggaagaaagttggtggtgttattagcattattttacagatggagaaattaacacctggagttttgtgattacagagcagtggtaatcacccagttattttccttctctgtccctccagtggccctctgttgtctgggttaagtacagactttttagtttgaggaaaggagtccctccacaatttgtcattcctctattcttccagccaaatttcttacttctcctccaccctcaactacagtcaaacatcaaacaggccgggcgcggtggctcacgcctgtaatcccagcactttgggaggccgaggcgggtggatcatgaggtcaggagatcgagaccatcctggctaacaaggtgaaaccccgtctctactaaaaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggtgacagagcgagactccgtctcaaaaaaaaaaaaaaaaacatcaaacaatactcactgagcccttcccacgtgccgggctatttgccgagaacttctcatgcattatctcatttaatcctcatcacaacttctctcaggtggaggcatgattgccatcccatcatacgggtgaggaaactgaggctcatagaagtaccttgccccaagccccatggctacttgcaggttccaagacaccggtcagcctgcccccctgcaccttggccatgctgcccactcacctagagcgcacagctgacactgagtcctcttctgaacctcatccatgaacatatttatgaaatctttcctggccccaagtggaaatgccccctcatttgggtcctcactgaaccccagtacacaactcttttgtactactctattatgctggggtgtttttttattgtctcacctgataaaccgtaagccccttgaagacagcaactcgtttttaagctctttataaccccagagcctcgcacagtacctggaccagattaaggggtacttaacagatgcttagtgaaggaaggaatggatttctcacctggttgcttatcttctagactcatttggggagtggccaggagtccgggagagctgccggccattgttccgtcccgtctgtatcccttgggctagtttcttctagactgaggtttctaagtccaaacaagatgaactgtgcacagtgcctcaattagggaacagcagcttgagtgctttggaaatacaaaagtgtagtttgtaggttcaccttgaaggcaagatcagacagctctacgtaagccagagctctgaaacaaagcttcaggctgggaccactttgcagtctcagtgcctggtagtggggactgttctacagagccgtgatcaaacctccaactgcattctggtcttggaggaaagctgattccgtatgaagagaaaaggcctggtgagagtatttgcagggctgaagaaaagttaacatctatagtttggcaagcagcagctgcaaagcatccgtcccagcacatgataaatgcttctgacgtttccttcagacacagtgtgctaggaaggcttttaagttctcaaatgcaggagtctgccttattgatcaggtgcctttcattaaaggtttccaagcccctcggctacagaggaaacgctcccctcagcctcctccacagccccagcctttcatgcagaggggattatcattgttggaatacggcatatactttaatttggtgaggctttttgtttaatgcttatgatatgcacactggaacagactgggattaggtaattttcacattgagttggtacttccctccctaacccccatctgatcttccatatacacattttaagaagaaaataaagagaagacacgtcctcctaatgatcctccgtattagaacttaccattctgctttgaactcctgctgctttgagtctcccactgccagcaagcacttctctgccaggcggaggggcggtgaagggaattaaaggggcagtcagtggcttgcctctggcgggaggtggcggagcgtctcattagcgtttgctcctttcctccagctgggcttcactgggcccctcttcttatcaacccgtccttcacttcacccaggctgtcccctgcactcagaccccctccagtccttccaacaagatggcagcaggatgactgggactcattggagctaagcagagaattaaagttgcttttgttccaaacctaaaacttgaaaatgaaggaactcttacgtggaaatgccaccatctcccttttgttttatgcgtaaacccaactggttccccatcctctgggtctccttcctgcccctcgctggctcagggcattgtacatactgtgtgttcaacacatgctgagtggaattgaacagatgcagtcctgggaaagggggccttttggaagaactgatggggaaagaattggggtaactgtgggcagttactggacgttcttgctcttacttattggttgaatgagaatgaaagtatctaagatgtaccaagtcccagggatagtggcataatttctctgttcctccttctgactccctcttctcccctcttttagtgtggggaagttacgagaacgtagcgtttggtgcagtgatccattcagtatacgtcgggctcttaagaaagttaaatttacctaacatcctacattttagataagaccgttccagatttccacctcttgacccaaaagatcccttcggtggttttccttactagggcaattcccttagtttcttggattcttccttcctctccttcctggaactaagctgcagagtcccaggctggagaaatagcccactgcccaggggtattttagaaagggcttcccaccttccgcagtgggcctggagaaggacgccttcttttcaccaccaggctgtgatctcgcaggctggcaaggcctttatgatgaactgaatgcggtctgtatttacgtgcctgccatctgtccccaggcggcactgagaagggggctgatgctgtcacccctagctccttctgcaggtctcctccgtacgtgccactgccaggaacaaaattatcatctcatgggagctgcacacatttaatggaacttgggagccagcacagaccgttttcctcaaagacagttttataaagaaaatggactttggggaacaacgccagaaagacatccagtatacctaattattaggcgagtgtggtcattgcctctttgtcttagataactaggttgttgattacggtgctttgccaaactccacggtggatctggtagctggtatttctgggcagacaccagactgagttacttcttttcagagttctggacgttactgatctaggtgaaaggccagaagcagtgggatattgaaattctcagaagtggagagactgtggcaaggaggtacagaagacactaaatcgggtgccatgttagcaagctcaagttttcatattgatcatgcagtgagctgcagagaagaaaagcagctttgcctgggtcctgttgttctccaagccaaatagcatctctgtgctgacagacgagtctgcgtctgcagacgcagcatctcttgactgtttgctatttaacgacagtcgtaacacatgagtgagctttactcatgtgggccctttattaacaataagccgcctctgtggcggctgggccccgcggggtcggggggtgggggtgcccaacgtggcagggaggcctgcaaggggaggccgaggcgccggtggaagcacaaaccacccggcgagtcagagcaggggtcggggcccctggccgcaccgtgccgcgcatgcgcagggtcccggggtccctggggtcccgggtttgtgcccccggggcggctgggccccgcgggaggggacggccaacgcggaaatgggccctttattcacaataagtgccaaaatccaaactgaacacatctaaaaaaattctaattaaggagcgtccactgctgctttctcaaaaattccttctgtgctattaaatattttctctttccaatggatatttaccatttctactcacagtagtttttctaccaagtattcagaaaaacctccagttgtcacttacccagtgtttaccaaaaatcaggcagaagagcgtggtggaagttggaagaccttagtgtaacccgcgtctataaaaactgggcgtccaggccgggcacggtggctcacgcctgtattcccagcacgttgggagtccaaggcaggaggatcacttgagtccaggagttcaagaccagcccggacaacatagaaaaaccctgtctgtacaagaaatttaaaaattagctgggtgtggttgtatgtgtgcgtcatcctagctacttgggaggctgaagtgggaggatcacttgagcctgggaggcagcggttgcagtgagcagagctcacaccagtgcactccagcctgggtgacagtgagatcctgtctcaaaaaaaagaaaaaaaaaaaaaaaaattggatgacgttgggcaagtgtggtgtctgtctcagctctgtgagtgtaggatgattcagaatctaatgattaggtctcctgaactcctaggtcaaacgtggttaaagggagatccagggaagcagtgaggaatgggctcttacaacactgtcatggacatgggttcaatatgttggcaattattatttattgaggacgtactttgttttaagtgcttaggataattatttgcttaatagtcacgtaagtccttcaagataggcattattatcgccattttactaatgaggaaactatgttaaaataatatattcctggtcacacagcgaccaagagtcaggatctgtctgccttcagagttcatagtctttccagtagcctcagtaaaaagtaataatagctaatatttactgagcacttactatgtcactgacattgtggaaagggatgttatgggcatttgctcttttaatgatcacagtaactctgctaggccagtactgttattatggccgatttatagatgtggacagaggaggttaaacactcgtgcatggacacatactgatcaacgtacagccagcactcaaacccaggccgcctgtctccagagcctgtgcccccaagctctaggccatgtgccctgtaagtcgcagatgggacgctctgacagcgagtgtcactgaggtcggagtgggtcatcaggcatgcctcagaatcccattccccacttcattcacacctgagaacgcctgtctctggatgcatctttacaccagctcatccatttaaaatcagttccctaatacaacaagctgaggatgaggccccttctaactaggccaccgtcagagtcccaatcctttctgacagaccagcccccgacatgtgtctgtctccatccttgcagcctggccagccctgtcccacgcctgctaattggtggggggacctggccccccaagcctgccggccattagcagtgcctcacggggaagggctttcttccttggtttcaactccctccctccagcgcgcagtcccttgccgggcttgcctggtgacagactcgtgttgatgaagacctttagggaatttccttccccctccgctccccgaagcgcttcttagagcacatctcattaccgggctccattctcccgtcctgcacatgctccctcacacttagctttattgtgccaccacttgtcacctttcccggcccggtttttaataatgcaaatcttccctctctgatggcatcgctgctcattatttgctgtctggcaccacgggagctcacccagcggcacctcggagaagccagccgcccagggtgcaggcgcaggccccactgcccgccccagtctcctgagagatggctccgctctggctatgacccaagatgctcatggagggaagagcagtccagggccagggcccttccaccttcgccaggcaggtgcctttgagcaagtcaatctctgcagcctcaaaataggaaagatggtaataattattataataatatccccttaacaaagcagttatggggcaaccaaatggaagtaagatacgagaaaagtctgtataaactgtaagatttgtaaaacttgtaaagaagttgtggtggtgttgctgatggatgattgattgatttggtcaacacggagcagtcgctgccccaaagtaggcctggagggcaccccagccccctcatctgccctcccacccccaaactcagcatggaatcatatggctttggactttctccaggtggataaagccccctgatctttgaacatgtcatgcaggattattattgtgtgttttgtttgggcaaagaaatttaagccaatttacttttgttctgtaactcataactgaactgtgctcagagtctctggggtcctttcaggcatgggtctgtggttctgtaatggtaactatgggttgatggagcaatggctttgtaaaatatgtttaaaagctccctctgaattgagggatcacagcctccttagttgtcccctggatttcctggcattggagttatgtaagacctccatgatcattgccatctggaatatgactctttggtaccccaaaaaacttctggagtctttcagtcatatggaatcaaaaagatcttcctttggaagaagcaattttagatcactgatggaaattttaccagaaaagtattcaaatcttttccttttataaaacctgggtttgttttttgttttttaattatactttcagttctgggatacatgtatagaatgtgcaggtttgttacataggtatacacatgccatggtggtttgctgcacccatcaacccgtcatctacattaggtatttctcctaatgctatccctcccctagctccccagcccccaacaggccccggtgtatgatgttcccctccctgtgtccatgtattctcattgttcaactcccacttatgagtgagaacatgcagtgtttggttttctattcctgtattagtttgctgagaatgatggtttcctgcttcatccatgtccctgcaaaggacatgaactcatccttttttatggctgcatagtattccatggtgtatatgtgccacattttctttattctgtctatcattgatgggcatttgggttggttccaagtctttgctattgtgaacagtgccacaataaacatacgtgtgcatgtgtctttatagtagaatgatttataatcctttgggtatatacccagtaatgggattgctgggtcaaatggtatttctggttctagatccttgaggaatcaccacactgtcttccacaatggttgaactaatttacactcccaccaaaagtgtaaaagcattgctatttctccacatcctctccagcatctgttgtttcctcactttttaatgatcgccattctaactggtgtgagatggtatctcattgtggtgttgctttgcatttccctaatgaccagtgatgatgagctttttttcatatgtttgttggccacataaatgttttcttttgagaagtgtctgttcatatccttctcccgctttttgatgggtttgtttttttcttgtaaatttgtttaagttctttgtagattctggatattagccctatgtcagatgaatagattgcaaaaattttcttccattctgtaggttgcctgttcactctgatgatagtttcttttgctgtgcagaagctcttagtttaattagatcccatttgtcaattttggcttttgttgccattgcttttggtgttttagacatgaagtctttgcccatgcctatgtcctgaatggtattgcctagatttttgtctagggtgttttatggttttaggtcttacatttaagtctttaatccaacttgagttactttttgtataaggtataaggaaggggtccggtttcagttttctgcatatggctagccagttttcccaacaccatttattaaatagggaatcctttccccattgcttgttttgtcaggtttgtcaaagaccagattattgtagatgtgtggtgttatttctgaggcctctgttctgttacatttgtctatatctctgttttggtaccagtaccatgctgttttggttagtgtagccttgtagtataatttgaggtcaggtagcgtgatgcctccagctttgttctttttgcttaggattgtcttggctatatgggctcttttttggttccaaatgaaatttaaagtagttttttctaattctatgaagaaagtcaatggtagcttggtgggaatagcattgaatctataaattattttgggcagtgtggccatattcacgatattgtttcttcctttccataagcatagaatgtttttccatttgtttgtgtcctctcttattttcttgagcagtggtttgtatttccccttgaagaggtccttcacatcccttgtaagttgtattcctaggtattttattctctttgtagcaattgtgaatgggagttcactcatgatttggctctctgtctattactggtgtataggaaggcttgtgatttttgcacaatgattttgtatcctgtgactttcctgaatttgcttatcagcttaaggagattttgggctgagacgacggggttttctaaatatagaatcatgttatctgcaaacaggcaatttgacttactctcttcctatttggataccctttatttctttctcttgcctgatcgccctggccagaacttccaataccatattgaataggagtggtgagagagggcattcttgtattgtgctggttttcaaagggaatgcttccagcttttgcctattcagtatgatattggctgtgggtttgtcataaatagctcttattattttgagaaacgtttcatcgatacctaatttactgagagtttttagcatgaaggggtgttgaattttgttgaaggccttttctgcatctattgagataatcgtggtttttgtcattcgttctgtttatgtgatggcttacatttattgatttgcgtatgttgaaccagccttgcatcccaaagatgaagccgacctgatcgtggtggataagctttttgatgtgctgctggattcagtttgccagtattttattgaggattttcacatcgatgttcatcagggatattggcctgaaattttctttttttgttgtgtctctgccaggttttggtatcaggatgattctggcctcataaaatgggttagggaggagtccctctttttctatagtttggaatagtttcagaaggaatggtatcagctcttctttgtacctctggtagaattcagctgtgaatctgtctggtcctgggctttttttggttggtaggctgcgaaattactgcctcaatttcagaactagatattgatctattcagggattcgacttcttcttggtttaggcttgggagggtgtatgtgtccaggaatttatccatttcttctagattttgtagtttatttgcatagaggtgttcatagtattctctgacggtagtttgtatttctgtgggatcagtggtgatatcccctttatcattttttattgtgtctatttgattcttctctcttttcttctttgttagtctggctagcggtctattttgataatcttttcaaaaaaccagctcctggattcattgattttttgaaggattttttgtgtctctatttccttcagttctgctctgatcttagttatttcttgccttctgctagcttttgaatctgtttgctcttgcttctctagttcttttaattgtgatgttagggtgtcgattttagatctttcctgctttctcctgtggacattgagtgctataaatttccctctaaacattgctttaaatgtgtcccagagattctggtatgttgtgtctttgtgctcattggtttcaaagaaattatttatttctgccttcatttcattatttacccaatagtcattcagaagcaggttgttcagtttccatgtagttgtgcagttttgagtgagtttcttaaccctgagttctaatttgattgcagtgtggtctgagagactgtttgttatgattttcatttttttgcatttacttccaattatgtggtcgatttcagaatatgtggtgctgagaagaatgtatattctgttgatttgggttggagagttctgtagatgtcttttaggttcactcagtcctgagctgagttcaagccctgaatatccttattaattttctgtctcgttgctctaatattgacagtgggatgttaaagtctcccactattattgtgtgggagtctaaatctctttgtaggtctctgagaatttgctttgcgaatctgggtgctcctgtattgggtgcatatatatttaggatcattagctctgcttgttgcattgacccctttaccattatgtaacgccttaattgtctttttttaatctttgttggtttaaagtctgttttatcagacactacgaccgcaacccttgctttttttgtttgttttccatttgcttggtaaatcttcctccatccctttattttgaggctatgtgtgactcagatgggtctcctgaatacagcaccctgatgggtcttgactctttatccaatttgccagtctatatcttttaattggggcatttagcccatttacatttaaggttaatattgttatgtgtgaatttgatcctgtcattatgatgctagctggttatttttcccattagtcgatgcagttttttcatagcatgaatggtctttacaatttggtatctttgtgcagtgggctggtaccagttgatcctttccatgtttagtgcttccttcaggagctcttgtaaggcaggcctggtggtgacaaaatctctcagcatttgcctgtctgtaagggattttatttctcctttgcttatgaagcttagtttggctggatatgaaattctgggttgaaaattctttaagagtgttgactattggcccccaccctcttctggcttgtagggtttctgcagagagatctgctgttagtctagggaagatgggcttccctttgtgggtaacctgacctttctctctagtgcccataacatttttccatcatttcaaccttggtgaatctgacgattttgtgtcttggggttgctcttctcgaggagtatctttttggtgttctctatatattctgaatttaaatgttggcctgtcctgctagtttgaggaaattctcctggataatatcctgaagagtggtttccaacttggttccattctccctatcactttcaggtacaccaatcaaacataggtttggtcttttcacatagttccatatttcttggaggctttgttcattccttttcattcttttttctctaatcttgtcttcacgctttatttcactaagttgatcttcaatctctgctatcctttcttccgcttgatcgattcagctattgatactgtgtgtgcttcatgaagttctcatgctgtgtttttcaactccatcaggtcatttgtgttcttctctaaactggctattctagttagcaattcctctaaccttttttcaaggttcttagcttccttgtattgggttagagcatgctcctttagttcagatagagagatgataagggatcagaagaggccagtggtgaattaactctgtagcctagaaccttgtaggggtaaaaactatttatcatcacctacacactcttactgggcatttattgtggccaagactcgggttcctgtgtgtctgtagagggccttcattgtgggtatccacaaagtgagttgaaacaaagctcatgcatgagaagcgctgatggagttctcccttgctcctgccaccttcttatcatctgtagtctttttcttactgctgagggatccttccagtggtcacatttgcccatagccctcctgaacgcttgagtctgcagaaaacctctagctggacagcttctgggtagagaaacaggccatgaagagcctcctacatgtgcaccatgtggctacgctccgtgacgagggaaaaacaggaatatctgtctgctgtgatcacgtgtagtggtcacggtgagagatgacggggctgctcctcctcagcctccagtcaggctgtgtggcagcgatcacctccatgtcgatggagtgtctgtgcagtttgggagcgaggctctgcctctctcggtgagtgtctcacagttcctttctccctcagccccatgatgccgtccagaacaaggtgctgaactgattaatgagcaggacataaagacaactgctgtccagagcaacagctgtcccaatccatccgtggaataaacaaacagggcagagcgaggtcccgaccagtggggacttgggtgcaggaaatgccagtctcttcttgcttgaatcagggtgtcagggggccttcctggccaccactcaggctgttcctttagctttctggatcccattccctgcaggtctacccttgggagtgaaatagtgaccgtccctttgagcccgagagctggggagaaggccgtgcctgttaacagctgcctggaccctctctggagagcagcagggagaggcggggctggaggagatgttgccaagaacctaagggtgttagtgacaaaagcaagaactcctggcaacaagtccgagggactttcttgatcacaagtggtatctcctaagcactttaattatagcagattaagcaggaagtggagtgccggactaaaggaataatgatacaaaggaggtgaagcagaaaaacttaatttccttcctttaagggaaaaaaaagtccatttatttagacgcattgcaaagaaaagaatggagtgtggcctttcccccagctcggagctcagtgggtttttaaagaactgtgtgtatctctttggccagaccagcgactgggatcttcagcctctctgcagaaaatgagccgcaggctcgggatttcgttaagatgcaggagcattccttctggaccaatgactcactcattcagccccttctttcccgcttctccttgtcagccctcgcctggctgagctcatattttacattcagcacctctggttacccagaaattgcatgcaaaattgtgaaatagaaaagcagtgggctgtgggctccatcagctctgcctggcgttgcatcatccttgacttgcaatgctcagaggctgggctaggagatttgcttacagaaagcctgaaggtcccagggaccttcccaaagttgcgacttgaatgcatgctcttagcacacatgctgtgtaactggggcagatctgtaggaatgagtggaactgaaatcagaccttagaaagtcacagtgaataagaaaattgccagaatggaatgcagatatacctactggttactgtcctgtatgtagcggctgtgtgggatttgactgtgttttactaataggagccttgttgggcccagtgcttcataactagctctgtctgtcgggaatcccccacagtatcctgcttgtgattcacgctatccagagtccagggcaaggagttctaaaaccttatcatgttttgttttgttttgatacagagtttcactcttgttgcccaggctggagtgtaatggcgtgatcttggctcaccacaacctccgcttcccgggttcacgccattcttctgcctcagcctcccgagtagctgggactacaggcgcccgccaccatgcccggctaattttttgtatttttagtagagacggggtttcaccgtgttagccaggatggtctctatctcctgaccttgtgatccgcccgcctcggcctcccaaagtgctgggattacaggcgtgagccaccacgcctggccgttttgtttttgagagacaaggtctcgctctgtcacccaggctggagtgcagtggcatgatcatagctcactgtaaccttgaactcctgagctcaagtgaccctgctacctcaacctcccaagtagctggcacctgtaggtgtgcaccatcacacctggctatttttttttaattaactttttgtagagatgggctctcaccatgttgcccaggcttgtcttgaactcccacctctgcccacatgctgggcattcaattcctagatctcttcctccctcctctcttgacttgcctcctcctggatcatgatatcttatcattttccaatcacagcgttaatggtaaggcttgaggctgggcgtggcacccatgcctgtaaacccagtgctttgggaggcagaggtgggagttcaagacaagcctgggccatgttcagcactttacatgcccattcactgagtttgcacagccgcccatatgacgggcattgttattcctactgtacaggtgaggaaatgggggctctgagaagtgtgactgtttgtgggaggcagcagctggcatgatggaaaaagtgtaggcattggaggtgggatccaagtccagtcttccacccacaggttcagtgatgtggggcaagttatataacacagttttctcatctgtaaaatctggacaggcatacctacaccctggagcattgggaggattaaatgagatcgtgtagataacagcatagtcctggcatatgagagaaaatggcagggatctttctatgacctcagtgtgagaagcaagatctaaaccctcagaggtagagtgcgtcccacactcgggctccttctactgggacactggcttccggatctccacggagaactgttcttaagttagaaggcaagcacagcggggacacggtgcaggacacctgcggacccagtgcccttgggattctttaccttcagctttgctcactgcagattagtcctcatcgctcagcagagagagtcgagattggcaggaggatctccgtcttgaacaacattatgattctctgagcatttctatatgttgaaaatattttatttaaaaattacaaccacccctcctcctcaaaattgcatgacagagatttcaccaaacctgacaactgatgagacaaagagaacaagacacagagaggaatttagaaataatccttgtgcataccttccgaagttgccacatattactaaaattacctgtatctgtgtctatcctgctactctatgcattacatatctttgcatcccccatgcctagcacagtgcccagcacatagtaggtgctcaaaaaaagtgcccatcatttgttggactgaactcacaacacagtaacaaagagccagttagagcaaatgctgtcccttttcccaggactgtagcttccagacccgtgtgaggcctcagcctgatttctgttcaccttagaaccccaaggctgactgtgcatttccataagcacctcgctcgcctgcaggacggggctgggttggtggtgggtaccagaggtgctcagtgttcaatcacgcagaaagtgggctaaagggcagcgcctcctgctccctccagagatgcacttccattctctgaaacgacaacttctctgcactcgcttaatgggatcccaaataacacgtcgcagaccagtcttttatcactgttgccccttggaacacatttcgaatgctggccattaaaagcaggccatttcacggttctttaatgatgacactaataactgtggatttttgtctcccagagtcctgatgagctgagccaaggagtaaattacggagctaacttttatgtgcatggtttattgatctgtgagcttcaaggaaactgcaccagcccctatagtttggcagtccagactaccttttcatctgtgtaattgggccacgagggcgcagttaatattcaatttatattaataggaagacaaagaacatgatgtgccagctccatattgaagtaatgggcatatcaaaatattctacctggtaattataaataaatcagttttcccgtgacccaccaaggatgatgttgctaattcactgtgcatttcatcataatttatcctgagaaagttcagtgctgccatgtgcatgtatatcgcagagtatacaagggtgctccatcgtaaaacacccagctgtcttcatccatgctgtcgcccatcttttcttaacaggtgaaagtcatgcttcgcatctgttccaccttggctcgagatacttcagaatccagctctttcttaaaggtggacccacggaagaagcagatcaccttgtacgatcccctgacttgtggaggtcaaaatgccttccaaaagagaggcaaccaggttcctccaaagatgtttgccttcgatgcagtttttccacaagacgcttctcaggtgggtatcagccccctctcaggctcaggcaacgttgatgaaagggcaacgtttactcattcacaagggcccttgagctgggagggtgtcttctggagcattctgatggaccagttccttcaggagtcaatctgagctccaccgaatggtccagtgcttttgaattactggtgtcagaccttgggcaggatcagtgtgcacagatttcaataaaatctgtccttggggagaaggaagtgtgagccagtcagtggatcacacacagaagcaggaagataacagaaagggacaaggacaatgcgtcaaggtgctggtgacagatctagtaggaccctactcctgcctgggcattgtacgaagggaaaaaaaaaagtgtttcagggagctgattagaattaggccatctcctaggccctgtataagcacactggggttgagggcaagcctgtagccctagtaaggaaccagagtgcaaggcagggaaaccgaggctgacatgcatcctgtggcctggctcagtggagtgaaggggaagaagagaggctcagggacaggtgttgtattcgctgaattgctgccttacaaatcaccctaaaattcagtgcttaatacagtaagcatttatcattgctcatcggtcagctgagcagctcttctggtcctagctcagctcatttttatgtctgtgatcagctgtgggttgggcaggcagctctgtggatcttggctggatatcagccaggcgaaataagatcatcctatatcacaccataggcacatgtctttgggggttggctggccttacactggtgtagaatagccttgaccaggtcagctggtctctcttccacattgtcggtcgtcatccagcaggctagcttgggctagttctcaaggcagtttccaggacccatgcatgcaggtctctggaggcctaagctcagaattgacccaatatcacttctgctggattctactggcccagcttcatgagatggagaagagattgcttctaatgattggacgagctccaagtcacattgcaagggagttgcacccaggctggggtggagaattggggccatttttattaatctactatgagcataattgggaggctacttgggggcccagggtaccaagattactgagccatgggcagccaatgaactgcagacctcaccagatgctgcaactaaagctgctagtagatatctgttctcctttggattcaccctggagctttggtgaagatgggcctctaagtggcacgaaacagcacctgttccttcaggggagggagcagggacagacgtgtagaactgattgcagaaatgaataacccaggttatagaatatagcctactttgcctggagtttgcatctttctggtaagtttctagtgcttatcaagatttacattaaacagtgtataggataataactaataatctatagcagaacctgacgacaacagtgcgaatagttaccatttgcagcctctgtgaatttcctccaggctgcatctgagtagaggaggtggcgatgttctcacgggctcctatattacaccgtgggcacacagcacatgttacaggctccattcattaagaagttgagcatgcggtttccccaaagagttttacccaagaagacaaagtactttatgaataagttctatggtttctctccttattacattttttgtgtggcatatcacccaatgggctcagtaatttaaacctgacgtttggtctaacaaatggcctacaaataatttcattaacacagttaaaacttttcagaagcaaatctccacaagttgtaagaattccaaagcaaaccctaaatcaagcatggactatgaatgcgttttagatttattccagaaaaagggtccattttaattgctagtctttgtttacatttcacactcggctgcagagctcagtatgctcaatactggagtttcgctcatttcagaatgccttactttcattcacatttccaatgttataataaattacatgtctgtataaatttgcagttttcaagacatttcgtagacattaacacatttgactcttcctagaattcagtggggtaggaagagaggcactgatgttctcatgtgacacacaaggaaaccgagactcaaagatgaagtcacttgttcaaagtccctttcccgagcagacgtccttcctggattccccccgttaacctctctgtatcctgctcggtatggtggtgtatctttgacctcctgccattttatccaatatttcctagcagtgtggcctcaggcgagtcactcaacctctctggacctcagtgtccttcctcatctgtcaggtgaggacatgaccacaatgttcctcatcaggccgtgtgattcctcgagttgacacacaggaagtgctcacagcagagccaggaacacagcaagtgctcaacaaatgcggctatttttaccgttatcactgccaatattagcagcatgctgctggccagggcaaactcagccccacagggtgggcacccctggagcccccaagcctgaaaggagggagtgtgcggagtgggcctgtgctctccagtcctcattttcagcctgtgaagccgcagccactgtggtgacccgggcagttagaaattgtgctttctcttcgtttctaaggaaatcagcttcctgaagctaaacagtgattagaacagtcctgtttcatggttgcctttgagagccatatgacccttcagtggcttcggcagtcgctggctgcccctgttgggacacgtctctgctgggacacacccctgctggagaacctggacttgtgggcaggcagagccttcctgcagacctggcccttcccatgggggctgtgctcgagaaggctgcatgcctctccaggtcccaggggaagcagcaaggggcctccggggcccctgccagctcttaacacacaccagatggacagcccgctgaccacgctcttctcagtggagagccgggtgggaactgtgccaggggatgccgccccaactctgcacagcaggtctcctctcgcccccggcctctgcacgggtgactcagtgtggtccacacacagccaacattctcccaggtggctcaagaatcaaatacagcttattttatgtatagctcaaggtgatttctcagcctcctgcctcccatcccactttatgtccaaagaaggcttagtccattgggcagccttctgcctgctctgcagacacgcctctggcaaattccatcaagacgctactgcttctgtctcagggttagcactgggctctccttgcctaagtcctggggggtttgaaagatcctgtgtgccctacagcagccctgtcctgccaccccctctggcccaggaggagccccccgccccccgcagagttgctggggaccaccctggaacaagtgacagctgttggaagtgtggtttttcaattttagtttaggagagaaaactgatttccaaatacttgggttcactgtgctgctgaataacaacattcacggcccaggtgcccaccgggaggcacgctgccccgagggctgcaaagccccatgttagcactgcctcccggagctcccacgagccctgactccggccccgagacagaaatgaaagcaacagggcacagcgaataatgctatctttctgcttctgtgacaagtctcaggtgctaaacaaagagaaggacatttcccagatctccaagttagtccacaaaaccgacagctctgatggctcgcagagctctgtattagcgggtgttcaggggaaatacaaaacatcatcgagagcctggtccctgtctaggatttaataatcaaattggagaccagacacacacacccggccaaagaacacctaataacataccatgtggtgactgatactctatatgttgaatgtatctgtagcaaaaggaagaaaaggcaggttttgaaaagaggagcatgggacgggcgcagtggctcacgcctgtaatcccagcactttgggaggccgaggcgggtggatcacctgaggtcaggagtttgagaccagcctgaccaacgtggtgaaaccccctctctactaaaaaaatgcaaaaaattagccaggcatggtggcacatgcctgtaatcccagctactcgggaggctgaggcaagagaatcacttgagcccaggaggcggaggttgcagtgagttgagatcgcaccattgcactccagcctgggcaacgagactgaaactccgtctcaaaaaaaaaaaaaaaaaaaaaaatgaggaaggtgtgaattgaaaatgaggaaagagatcaggagagaaagcagatatatatcacaaacctcttgcttacgtgagaactacggtgtttctcaaggtctcacttgtgaaatggtgggtcacctttttccctctcataagcctggcctgtttaataaactctatgtatacgtgtgtcagcagagggtgagtggagagtttaaagaccttatccgggaccccagaatggcagatgagggaagggaatgaggttcatgagcacactgtgcccccattccagcctgctcctgcctgctctacagacgcattcgctgaaacgtaccacggattagcagaagggtggtttgcagtgcatgtgcataatgctcaggcttgcaaagggcggaaggtcgccaggggttctgagcatctccaaaacttcacgacagaggccaacccacctgggaacacagtgacactgggacccgaagccccaggaaggtgggctcactttcgttgttagtggtgtctccgctgcgaggtccattcacggctcgtgtctcctcttgtgtctgacaggctgaagtgtgtgcaggcaccgtggcagaggtgatccagtctgtggtcaacggggcagatggctgcgtgttctgtttcggccacgccaaactgggttcgtgagagtttcactttctcatgcggctcgttgagctccctgtcatcccatgcattcctctgtctccctcccagagttctctgatgacaggaagggctgcgtttctcttaggtgttgagctgaataaccaataacaagttatacgacgaaaacctatgttgttcattgtaggtggacacccattcatgtaggaaagccttcaagtccaaatagatggaaagagaagtagcagagttgttcccacttggtccaggtcagagtcaagcccagaaggcaggcaggaaaatattcatttcctgagcagccgctgtttgggaagcagatagggccccttgcaccaccgcacccatgaggatgtgggttggtggttggacccctgtaaaagccagaggagcaacctccaagcaaagcccagagcccagggcgcgtctggagaaagcagtgcacaccgtcgggaacactccagcgctgaagcgtctgggaaaggaggcagcagagccccccaacaaggggttcataaatccccccacagtcccatcttacttctgacctgtggccatctgctccccaggccttgcccttacacgcttgatatgtttagtgaattgaggagcttcaaaaactgtcccttggcagagattccaacagaggccttgctggagctcacagaggccagttctcagccaggacagaaagccattgcctctctctgcacttccgtcctccccagccctttctcttgatcttgatgtaagcagtgatctgggttttaatagaatttgctcatgccataaaaatatacacagcatttaacttgagacaggatataaagtgtgaatatgtggacttaatctggggggtaactataaaaagaaccataatgatgatgaaaaagcccagccttcccactgtgtgtaaagcagtgcaggaactggatagcatgtgatatttggggtcctcctcaaggtacatggtgatttaatcttgtcacatgtctgggctcttgctttgtttcttttttttttaagagatggctctcagttgcctgggctggagtacagtggcatgctcatagattactgtaacctccaattcctgggctcaagtgatcctctcgcctcagcttcccaagtagctggggccacaggcatgccccaccacacccagataatttttaaaaatttttcatagaggcagggtctccgtatgttgcccagactggcctggaactcctggcctcaagcaatcctcccatcttggcccccacaaagtgctgaggttacaggcatgagccactgagcccaaccagcattctttattgtagccatttagttagtaataccagaaaatgccttctgttgttgtcaaatactatttctctcatctttttgttccttctcttcccttttccccccttccctgtgcctttcttctatatccttggcatctattttggagactccgtggaatgatgcctggacactgaacctgcttttcttccttccctggttctcccaggaaaatcctacaccatgatcggaaaggatgattccatgcagaacctgggcatcattccctgtgccatctcttggctcttcaagctcataaacgaacgcaaggaaaagaccggcgcccgtttctcagtccgggtttccgccgtggaagtgtgggggaaggaggagaacctgcgggacctgctgtcggaggtggccacgggcagcctgcaggacggccagtccccgggcgtgtacctctgtgaggaccccatctgcggcacgcaggtgattgcttctgaagcctggctcgccccaaggtggctccctccccacctcagaggctggggcagctccacccgtgaatcactgaacctgtaaactcagaggcttacgggtgtttactttaaagtggactggaactttatggcctgcagctgtggggccatcggcttgcccagtctaaatatttgtaccttgactctaattgacaatgagcagggaccacaattacagcatttgggggagaaatggaattcactttctttatgcccctttcaaaaaaaaaaagtaacaatctttcttttgtttaacaacaaaccggaatatttactgctctgcacaaatagctagagccattacggggctgttgatgactctataaactgtgcttctggcactggtttacagccggattagcagtgctgcaggaaaaactaataaccactttctaattagaaccgtgatataattgctagaactatggaagccaagagaagctccagttcaccatttcaggatgctaagcctgttgggagggtctctcctttgctgtttgacaacagatgtaggaatgacccgggagctgcaattcattcatatccagaataatcaatccttccagtctctaacagtaggctttattttcccgtgttgtcagatgcctccttttgtagataggtgttccgtttgataagtacctgcctcttcccaactgggattgtttgcacaggtgaggatacctcccgtggcctgttatactcattactcaaacctgaccatgctcttcccctgcttaaagcacctcagatccctccatttccctgagtcctctttcgtctgcatctgtcacctcgaggacttgtttaaacactgatcgctgggcacccccccagagtttccaattcagtaggtctagagtagagctccaaaatgtgcatttccaacaagttcccatgagatgctcatgctgccggtccagggatcacagttggaaatcactgttctgaggcatcaaatgtgcagagacagtatctacacagtgtctgtgatgcaatcagtaggactcgacccactgctcctgttccaggcattttctagacattcaaatatgctttcacccccattcatttttagaacttcattgatgaaattccactaaggggtgaaaagtctggttaaatgaaggctaagaaaaagaagaaaagaccaatattccctttaattcttgttgaaaaatcttttaaattctttggtttatttttccatagcgagacaaaattttgaacacaaaagaatctctctttgaagtctgaggattttgatggcctcaggttctaaatattggctcttacagttcaaaattatttgtatagttagagtagaaaattgtcagaatttgtaccaaccttaagacatgtactgcaaattagttctttgaacaaatcagaaacatgagttgccttttctccccaaaaagaggagtgctggttcaattctgttaatgtgatcgttgtgattcaggtttaaaataattgccaagtattttcataagattcagacgcattaccctgtgtgctttctttaatcaattaatgagtatgccgggagcatggattcaggaactaaaggtaaataggtatctcctaaatttagatgagacattcaagtatcgtgagtgtttgagggtgccctttacactggtttcttatttataactatgctagtaaatatggcctaaaattggctttaattaaataactgcaaaactaggagtcaaatgaaagctaaccaagtttttttacatctttgggacaccactgctatgaggcctcaaatcacattttgcaacctacctgtctccaaacaatctaatctttggactcaagatgcagtcacatcgctcctgttttcttaggtaaatggatagccaggggtgttggtttgccgccctctgcagagataaggatgagccatctgctcccagcttttcacacccactagttccagattctacttagactgtaaagtaggtaaaaataggtttcatccaataagtatgctcaatattaattttcagaaatgaattaattaagctgagaattgcacatgagcatagcaccttgtttcagaagggttttcagccttagaggggcacgtggctttactatacagaacacacagccagctgaatggtgctggggacacccaggcatgagtgacagcaagccctcctcagcctgcagcctcatctcttggcttctgtcttccagctgcagaaccagagcgagctgcgggcccccaccgcagagaaggctgcctttttcctggatgccgccattgcctcccgcaggagccaccaacaggactgtgatgaggacgaccaccgcaactcacacgtgttcttcacactgcacatctaccagtaccggatggagaagagcgggaaagggggaagtaagtcggccactccaccctcctgcctccttagcggctctggccccagccagaaatcccttgggcaaccatgacctttgtgtgtgtgtgtgtgtgtgtgtgtgtgtgtgtgtgtgtgtgtgtgtgtgtgagagagagagagagagagagagagacagggtcttgctctgtcacccaggctgcagtgcagtggcacgatcacagctcactgcagcctcaaactcctgggctcaagtgatcctcctgcctcagtctcccaagtagcttgggactacaggctcatgccaccacacctagctatttatttggttatctttgtagagatgggaccttgctatgttgcccaggctggtctagaactcccggtcttgagatcctcttgccttgatctcccaaagtgttgggatgaaaggtatgagccaccatgcctagccaaacttttcttaatagactacaatatgcagttcagtgactcgtaattcaagataattatagtatctgggctgaagttcacttttgaactgtccagggaaaggagtttgctttggtaaaggtaatttacaaatgtcattgccatgagaatgtgagaggtcaaagttacaaaaagaaaacaactgcctgacagtatctttttgttcacagacctcaaaaatgctcctcaagaaagaccaacatttatccaccaaagcactccggcagtgtgttatcatcattagctcgaggccactgtatggaccatgttttttaaaatagcatagaaatcagacttttgaataactacccagaccctggctgcctccctcaaatcgtcagtgaaggtttactgtcaaaacccaggtacggtgcctgctcttcgagtgagctgccctgccaggaacccaacactgtgcccctacagacccctcttggctgtgtttccaaagtcagcccgggctggggtgcaattctctgccttctgtgaagtagtgtttactctatgcccaaaagagttgagcaccagatcagctgaatgtctccagtggggatcttggaccaggggcaaagtggtctgttgatttcactgggttcctaaggcaggttgtgggtaacggggctgctgggctggccgggcagtggcttccgtggttcctccatgtcccgctctgccgggctttcaatacacaggcaactggctcccagcgctttctgcatgattgtctcaaagacactggatgccagaaaaacaatcagaaaactgagttaagagtctaaccctggactggaaattgtaaagctcattgagtaaagcagagatggtccgcaaagctgttgtagatgaagcctagaatgaagacatccaagtaggaccaggcgtggtggctcacacctgtaatcccagcactttggaaggccaaggtggttagatcacttgaggtcagcagtttgagaccagcctggccaacatggagaaaccccgtctctactaaaaataaaaaaattagctgggcgtggtggcacacacctcccagctagttgggggtctgaggcaggagaattgcttgaacccaggaggcggaggttgcagtgagcccagatcgtgccactgcactccagcctgggtgacagagcaaggctctgtctcagaaaataaaaataaaaagacttccagctgggatctatggacaggctccccctgatttcccctaagcctcctcgtggctcaaaagacctggacaacagtactcctggggagagagctctttgcgggcttctgctgtccccaggcaaaagcgcctcccttcccccacctcggtgcctctcttcctactctttagttactgttgttaaaatccaggtttattgcagtataaggtacattcaccaaaacatcactttgatgtgtctttagatgagttttggccaatctatacagtcatgtagccaccaccattatcaaaatagagcataaggctaaagttccctcttgccgtttgtcccttcccctgacctctagcccctggcaaccacggatctgattgttgtcctggttttgcgtttatccaggatatcgtgggaatggactcgtgtggcccagatgtggccttttgtgtctggcttctttcacgtagtgtcctaatgcatttgagactcccccatgctgcagcacgcgtctcttgtttcttctggttcctgctgcctgttctgcctgctcctttagtttttttgtttgtttgagatgaagtctcactcactctgttgcccaggctggagtacagtggcgtgatctcggctcactgcaacctccgcctcccgagttcaagcgattctcctgcctcagcctcctgagtagctgggaatacaggtgcccaccaccatgtctggctaatttttgtacgttaagtagagacggagtttcaccatattggccaggatggtcttgaactcctgacctcgtgatccacccgcctcagcctcccaaagtgttgggattacaggcgtgagccaccgcacctggcctctccttcagttttgactgggcctggaggcttggttcctaccctaccaccaggacagaatgaaaatatccacagctggggctggagttcctctaactggggctgctttttatggctctgaaaatcagccctgagctgcctccagtggctgctgtgaagaaccgagaggttctggtcctcacttacagcgggcgaggcgccccagggaagtggcccattagcttgagggcagctctctcgacagcccatgatggtgagcaaagtctcactggagaggagccgaggatagtgaacgggaatctctcgggagatgtattcttggtaacaggctcacaccatgtagagcgcttccgtttagaatcacgttcttaaagaaggaaacgcattcggatagggatgaggagatgcagacctttaaaatcggatagggatgaggagatgcagacctttaaaatcggatagggatgaggagatgcagacctttaaaatcggatagggatgaggagatgcagacctttaaaatcggatagggatgaggagatgcagacctttaaaatcgacagcacaattgcatccacatttctcctgactgtgtgggagttggccttgaaccctgccctcactgttttctcctgggtagtgtcttcaccctgtcaatgtaagagtctgacaaatgtttagtttattcttttaagcagctgtcagtaatcatcatcatcagagcctgcaggactttcttgtactttcagtaaagagtgactcgcaaaacatctaacccttgagccaaatgactcccaaatggcactgatcagaaaaacttgggagatgggattatctctcctccttccaggtttcaaaccaaactgaggacaactctgttttcggttttgtactttttttcttttttgcagttctgctttcgatttggaatctgaaagtagggagaaatcttgaaaacaaggaaacagttcattaaatgacttcaaatataagaacttgaaattcagattccacaaaagtttaggccaagacattccctaaacccagtgatccaccccaaatcagtacctaaggaatcctgcacccttattaaatatttaatagccagctcatcttcttcctatttttaagttgtgaaagagaattgcttttaaataatgcattcaggttaaaagaaagggcaaataccacgaatggtttccaaaacctcggttaggtccttcctaatgtttcagtggatgagaacaaagaaggggaaggagtccaggggtcgtgcgatcggcagacctgggggacatctcttccctcccgaggggaaaggatcccggccagaatgcacacggcctccccgcctgggactcacttgacttcagtgaatttataactgtttaaaatataatgaggagatttggagggttgtttaaaatggaaattttgtttacttacatataagtaataatccctgcggacctggcagccagaactcaattaggggaaagtttattaattagtcaccctgcagggaagccattagaagagatctctgccgcaagaactaaatagactctgtgtgcgcctctgaatctcatatgcacacatgcattttatacattttacacacaaatgcatcttacatttataattttacacacaaatgcattttacacatataagtagacagacaaaaaaaagttttaaacatttccagtcaaaatagaaaagtctttgttgatgtatccctgttttgcagatagcactaggttaagcttaaaatatctccctgtttaaaagctcattggaattagtgggactgatccttcagcctcatggaggccttcctctgctttgcgaagctaaatctgtaatagcttgagagcctcctcgggaatcccagcactgggaaacagaccctgaagccctactgatcagagagctgcttctcataacgacgcgtgtactgggcacctaaaacaaggtggtgcttgggaccagaagtgtttcagatttcagattgttttccgattttggaatatttgcatatgtaatgatcccttgggaatgggacccaaatctaaatacagatttcatgtatgtttcatatatgccttatagacatagcctgaaggtaactttatacaatatcttcaataattttgtgcatgaaacaaagtttttactgcattttgactgcaacccctcacgaggtcaggtgtggaattttccccttgtggcatcatattggccttcaaaaagtttgagattcttggagtattttggatttcagattttttgggttagggatgctcagcgtggactagtgatacttcagggtaatgcgctaatgatacggagatcgcacctgtcctgttgacaaagataatttcaaaagccccacttttatgagtaatctaagcatgcaagcaactgttgctcaaggtccacaatgacaccgggtctctgatttgttcattctctttattgcctctgtggggaggattagagggctttgtaggctgggctgctgtgtgcgcacacaaatgtatgtgcacatgggcacacatctgtgctacactcatctgtctacacatctcatcagactctttaatctgtttttttgtttgtttgtttgtttgtttgtttttaacactgagtctcgcactgtcacccaggctggagtgcagtggcgcaatctcaactcacttcaacttccacctcctgggttccccgcgattctcctgcctcagcctcctgagtagctgagatgacaggcgtccaccacaacacctggctaatttttgtgttttttagtagagacggggtttcaccatgttggccacgctggtctcgaactcctgacctcaagtgatccacccacctcggcctccccaaagtgctgggattaccatacctagcctaatctgctttcttttgacaatgcaaatgttttctttacatgtcatggaatggcttaaatcaactaatgctgtatttagggctgtgtggtggatatgactctggagatccattctttgggtggcagatgtgggaaaagaggcttaggaaagaaccttgcttctaatggagccacagccagtcccctgctgtccccagcagcgaagccctgtgcagcaaggatgtccacacactacagggctctcatctcccgcttggtcaataatgaagtggcagtttcatctttttaggtttttgtaatctatatgtttttaaatgttggccaggagacactattctgaagagtgcagcctggaattcccatcaccgcctccgtttctaatcttctcaagcctcctggccactctcagcaggtaactagcatcttagtcaatgagaagacagagctgacctggtgcattcctcaacttctcttcttttggtttcatagtctcctggtccctttacctcagtttcccccctgctccttcccacaggcctgctgctcccgtctcctggcattcttcctcctgccccttctgcctcttctgggacctcaccaattgggaccccctcagtggtcttttcatgcttatgttttcagcctttcctcccaccaaagtcagggttacagaaggaagagaaggaggcagggagggagggaaaaggaaaggaaaggaaccacaatggcaccttgcctctgccacgctcctctccgatcgcctcctcaacaaagacgtcagattcccctctttgtaatgtcttctttgaatttcagcagtgtgggggatgttatgcttttgccttactccgccttatattttggctgtttgtgagctagtccaagccctattggactataggtgccttgagaaagagtgccacagtgccagggctgtgtctgctgcatgctgtttgtgagcttgtccaagccctattagactataggttccttgagacagagtgccaccgtcctggggctatgtccgcagcgtcagtatccaaggcctattagactataggttccttgagacagagtgccacagtgctggggctgtgtccgctgcgtcagtgtccaagccctattagactatagggtccttgagacagagtgccacagtgctggggctgtgtctgctgtgtgctgtttgtgagcttgtccaagccctattagactataggttccttgagacagagtgccacactcctggggctgtgtccactgcatcagtgtccaagccctattagactataggttccttgagacagagtgccacagtgctggggctgtgtctgctacgtgctgttggtgagcttgtccaagccctattaaactatgggttccttgagacagactgccacagtgctggtgctgtgtccgctgcatgctgttggtgagcttgtccaagccctattagactataggttccttgagacagagtgccacagtgctggggctgtgtctgctgcgtgctgttggtgagcttgtccaagccctattagactataggttccttgagacagagtgccacagtcctggggctgtgtccactgcatcagtgtccaagccctattagactataggttccttgagacagagtgccacagtgctggggctgtgtccactgcatcagtgtccaagccctattagactataggttccttgagacagagtgccacagtgctggggctgtgtctgctgcgtgctgttggtgagcttgtccaagccctattaaactatgggttccttgagacagactgccacagtgctggggctgtgtctgctgcgtgctgttggtgagcttgtccaagccctattagactatgggttccttgagacagagtgccacagtgctggggctgtgtccgctgcgtcagtgctcaggtctcctttgtccaaatgaaatgtgtgctgtggttttaaaaatgattctctgctctcgaactcctgacctcaggtgatccacccacctcggccagcctggccaacatggtgaaaccccctctttactaaaattacaaaaattagtcaggtgtggtggcaggtgcctataatcccagctacttgggaggctgaggcaggagaattgcttgaactcaggagtcagaggttacagggttgcagtgagccgagatggcgccactgcactccagcctgggcaatagagggaaactgtttcaaaaaaaaaaaaaaaaaaagaatctctgggctgggcgtggtggctcacactgtaatcccagcactttgggaggctgaggccggaggatcacttgaggtcaggagttcaagaccagcgtggccaacgtagtgaaacctcgtctctactaaaaatacaaaaattagccaggcatggtggcgggcgcctgtagtcccagctactcgggaggctgaggcaggagaatcacttgaacctgggaggcggagcttgcagtgagctgagatcacgccactgcactccagcctgggtgacagggcaagactccatctcaaaaacaaaaaatgaaaaataaaataaaaattaatctctgtgttatctagtagagctgtgattcgggaagagtaagaccacccaattacctttcacgtaagcagatggtattaggtcagagaagcctcacaacgcaacagagtcaggaggcagtcagctgactgggcaagtatgttagagggggaattatagaaaatgatgtattcataaaggtgttatctgaaattaaataatacaaatgtatttttattcattgatcttacgaaccacaaagggccaaggctctctctttgagttttcaattcaattaatttgacttccacgaaccacattcgtattaacagttcagtttttgctttgaatttcttcaaagagatttaagagcttaaaaaaacactttacaaccaactgggtatagactttttctagattcttacagtattttccactctataattcctcattcacacaaaattcaacatcgttaaaaaaaatttttttttttgagacagggtctcactctgtcacccaggctgaagtgcagtggcgctatcttggctcactgcaacctctgcctcccaggctcaagtgatcctcccacttcagcctcccacgtagctggggcaacaggtgcgcaccaccatgcctggctaatagtttatatttttttgtagagatggggtttcaccattttgcccaggctgctctcaaactcctgagctcaggcgatccacctgccttggcctcccaaagtgctgggattacaggtgtgagccatggtacccgtccaaaaaatcctcattttttatcacatcttttcaaagcattgagttgagtttttataaaaacattaactctctttacaaaatcatttcattggcttatacagtattttatgtttttatttaaaataacaaggggcagaaaccaatttaggaggaaacacagctgacctattaagaactatgcagctgattctttttggagcaaaagtgcacaaactagaccacagcctccactaaccacgagccctcagcgtgctgtgggcgtcaggcagaacttcttatgcaggtgacccagagcattgctgaacctggccaggtggtaaggcagtggctcccaaacttagctacacattagactcacctggagggcttttaaacgcatcccagagtgcgtgctgccctccagcccaattaaattagaaaggctgggagtgggaaccagacgtcaatatttcttgaaagattccagggtgattccaacgggcagcaaagtttgggaggaactacgacggtgcgggaaggcgagttaaaagagcttctgcatgctttctggttagcttcggattttcatcttagatttagcattaattttctatgagatcttgggtgatttatttaacttctatgagcctcagtttccttatatgtaaaatggggctaatttctgcattgtgggatattataggaattaagtgatattaggagaatttaggatttcctgctaccttccaggtgcttaataaagtgtggctcaggcgtaggagacgttattatattgtttcctgtgggtagaataaggcatgtgggtaatttggtttggtcaaagtctagacttaaaatattgcatattagaatataactaaaggattactcaaggcagactgagttgtgttcctttaaccctgcagtcttgacctcaaaatctggaaagtcagtgaggaacctgcttcttacctgctattaattatcacctattgtgttcatttgctgtgtaactacactttctccccagccgccggaagtgatggaaattcttgataatagcaagtggcctgtgctgactcaccttgtactatttcaagttaagcaccatgtgtgaaattcacaattctgtgcctacggcaactccaataggcacggagcagagagtagattttccattgtctaaatgtgactcttactttgagtcacgcaggtataattataggtattttatattatcatcctcagcacagtctaaactgtgccttttgttcttgtgttctgttttactacatgtacattatccattttattccattacatcaaatggactgttagagtcagaattggtctctgtctttgccctttaatctgtggtgcatgtggaatatctgagcttctcctgtctatataattaggctgcaaaacagatgatattttgctttaaaaataactatttccatagcacgctgctgtgacccaagcttgcagggtacaaaatagcataaaacagaagtgacacattatatcttccccttaaaggggttttactgggaatagttgaagagaaacaaaatataacatccttaatgtaaaaagttctttgccatagacgtgccagtagctggagagctggaattgcaatgctttctttaagtatttctcacctttttttctcagtactagatatggaatttgaggataggaaggggtggaggcagattagccttaggacagtggttgccgaatattttcatcctacagcatgagcagtgctgcatcagccttgtccttcgggctcttctgcagacgcgtggatgcctagatccctcccacgcaccccgagtgccacctgcaatggtccagacacacgcgggtcccacacgctctgctcgctttttgtaccaacacctttcaatcttgccccaaattacttggcctccacaacagctttgggaagtttccatctctgcctttgccattttccttctgtgcagagtagggaaaggcagagggaagagttgctgtcctggcagtaacaggaggcaggccaggtatgaggctgtaagctgggccgcctggaaagatagggatccagaggcctggaggagcagcattccgctgctgcctgggattgaggcggggggaagggagacagccaaggagtgggtgatgtacccagagacacgcctctctggaagagtggggcctggggcaaaaaggcggccttctccggctgcttcgtggagctgatggaggccgcaggatgtagttgagagctcaggtcttgcagtcagtctgtggtttgaatcctagctctactactggctgcaggatcgtgagcaagttttttttttttttttttttttttttgttgttttttaacaactttaatgagatatacctgagctacaataaactgtacatattaaatcatataacttgatgttttatcatatgtatatgcctatgaaaccgtcctcaatcaagataatgaatatattcttcacccccaaaagtttcctcgggagccttgcaatccctgcctccagctcctcttccttcctgtctccagacccaggaaccactgaactactttcagtttctagacattagtgtggatttcctagaattttatgtaaaaggaaacatatcttgcagacggtactctcgtgtgtggcttctttcacttagcataatgattttgagatgtaatcatttcattgcctgtatcaatagttcatatatttatatttctgcataatagtccactgcccagatataccacagttggccgatccattcatctcttgatggacatttctgttgtttccagtttggggatattacaaataaaagtactaaaggttgagcatccctaatctgaaaattcgaaatccgagatgctccaaatctgaaactttgtgagcgccaaatgacatcacaagtagaaaattctacatctgaccgcatgtgacaggtcacaggaaaaactttttgtgtacaaaattatcaaaaatattgtctaagattatcttcaggctgtgtatataaggtatatatgaaacataaatgaatttaatgtttacgttgggtcctatttccaagatatgtcattagatatatgcaaatactccaaaatctctggttccaagcatttcagataagggatattcagcttgtgtgagcatacatgcacaagtctttgtatggttatatggtttggctctgtcctcgcccaaatttcatgttgaattgtaattcccagtgttgggggagggacctggtgggaggtgattacatcatgaggatggatgtcccccatgctgttctcatcatagtgagttatgagatccggtggtttaagagtgtgtggtactctcccccctgctcactcgctctctctcctgctctgccatgggaagatgtgtcttccttcactgtgagtcaatgaaacctattttcctcataaattacccagtctcaggtagttatttatagcagtatgaaaacagtctaatatatatatggacatatattttctttcctttggggtaaaaacctatactagaactggaatcttatcaatgtctgggaatatttgaaaaaaaaaaaaagaaaaactggaatggctgtaccatatagtagatgtttaactttttaagaaatttctcagctgtttcccaaagtgcttgtactattttatatggggagttcccgttcctccatacccccaccagcatttggtgtggtcagtcttttaagttttgcctgtttacatagtaggtttgtaatagtgtcttgtggttttagtttgcacttcgctaatgaccaatgatgccaagcatccttctacacgcccattcggcatccatacctcttctttggtgaaatgtcccttcaaatcttctgtccttttaaaaattgttttgaaagtttttaatatattctggatgcaaatcctttataagatatagtatttgcaaatattttctctcagtctgtggcttctctcttcattctcaacagcatcttttgaaaaacaaatacttgtttttttatgaagtccaatttatatgttcttttatgaatcatgtttttgctgtcacatctaagaaatctttgcctaacccaaggccaaaaaggtttcttcttatgcctcctctagaagttttgtaattttaggcttcaaatttaggtctttgatcaatttttagttaatttttgtatattttgcaatgtatggactcaagtagtttttttcaggttgagggaggttaggtgtttttttgtgtgtgtgtatgaatatagtatccaaaatttccagtatcatttgttgtaaaaagctattatttctctactaaattacctttgtcaaggattagttggccatatttatgtgcaactatttctagactctgttctgttccattgatctatttgtctatctttacaccaataccacactgttttgattatggtggatgtataataggtcttgaaattaggtaatgttaaccttccaactttgttcttattttttaaagttgttttggctattcagtgtatttggcatttccatacaaattttagagtcgctttctaaatggattacgtagaaaaaatttctatcaaagaagtctaccaggattctgattgggattgcattgaagctatagcaacttggagatgattgacctcttcacagtattgagtgttctgacccaggagcacagtatctctctctagtttaggtttttattagttcccttcagtaattttttaaagtaggaaaaagctattatttaaacatgtatttcttttatattgatatataattacacatatttatgggtgatattttgatgcacgcatacaatgtgtgatgatcaatcagggaatttaggagattcatcacctcagttatcacttatttgtgttgggaacatttcattattttcttctagctatttgaaaatatacaataaattattgttaactatagcctcctactgtgctatcaaacactacggcttcctccttttatttaactgtgtatttgtaactgttaacccacctgttttatccccctcccccggcaccccacatcccgccccttcccacacacacacattcttcccagcctctggtatctaccattctcctctctacctgcatgagatcaactttttaagctcccacatatgagtgagaacatgcaatatttgtctttctgtgcctggcttatttgacttaacataatgacatccagttccatccattttgctacaaatgacaggatttgagtttttgtataactactagtattccattgtgtatatagagcacattttgctacaaatgacaggatttgagtttttgtataactgctagtattccattgtgtatacagagcacattttcttggtcccgttccattcatccatccattgttggacacttaggttgattctgtatcttggctgttgcgaatagagctgtgataaatataggggtacaggtatccctttgatatactgatttctgttcctttggacaaacacccagtagtgggattgctagatcatatggtagttctcgttttagtttttttttgagaagcatctatactgttttctatactggctgtactaatttacattcccaccaacagtgtgtaagagttccctttactatgcatcttcactagatttcatggtgggttttttttttctgtctttctaataatagccattctgactggggtgaaattatatctcattgtggttttgatttgcacatccctgatgattagggacattgaacattttttcacatacctggttgccatgtgtatgacttcttttgagaaatgtctattcagatcctttgcccaatttttaatgggtttgtttgggttttttgctgttttgagttccctggatattaattccttgttgaatgaacagcttgcaaatattttttttccattctgcaggttgtctctttgctctgttgattgtttccttagctgtgcagaacgtttttagtttaacatactccaatctttctaattttggttttcttacttgtgctttcaaagtcttagccataaaatctttgcctggaccaatgtcccaaagcatttcccctatgttttcatctggtagagttattgtttttggtcttaatatttaagcctttaataaattttgagtggatttttatatatggtaagagatagcggtctagtttcacccttctgcttatggatatctagttttcccagcaccatttattaaaggggatgtcctttccccaatgcatgttcttggtgcctttgtcaaaaatgagttggctgtaaatagatagatttatctgtaggttctctattgtgtcccattggtctatgtgtctttttacgtcaataccagcctgttttatgttacagtagcttcctagtagtgtattttgaagtcagctagtgtgatgcctccagcttgtttctttgttttccagtattgctttgtgtgcaaggtttttctctgtgtgtttaaattccatgaagaatgtcatggatatttcgacagagactgcattgagtctgtagattgctttgagtaggatggtcattttaacaatgttaacttgaactcaggattcagaaactcactcaaaaccacacaactacatggaaattgaacaacctgctcctgaatgagtcctgggtaaataacaaaattaagggagaaatcaatgagaacaaaaagacgatgtaccagaagctctgggacaccgctaaagcagtgttagagggaaatttatagcactaaacgcccacatcagagagctggaaagatctcagatcgacaccttaacatcacaattaaaagaactagagaagcaagagcaaacaaatccaaaagctagcagaagacaataaataagatcagagcagaactgaaggagttggagatgcgaaaaacccttcaaaatatcaatgaatccaggagccagttttttgaaaaaaaaaattaaggaaatagaccacttcactagactaataaagaagaaaaggagaagaatcaaacagacacaatagaaaatgataaaggggatatcacccctgatcccacagaaatacaaactaccatcagagaatactataaacacctctgtgcaaataaactagaaaatctagaagaaatggataaattcctggacacatacaccctcccaagactaaaccaggaagaagtcaaatccctgaatagaccaataacgagttctgaaattgaggcagtaattaatagcctaccaaccaaaaaaagtccaggaccagatggattcacagccgcattctaccagaggtacgacgaggagctagtaccattccttctgaaactattccaaacaatagaaaaagagggaatcctccctaactcattttatgaggccagcatcatcctgataccaaaacctggcagagacacaacaagaaaaaggaaacttggccgggcacggtggctcacagtggctcatgcccataaccccagcacttaggggagccaagcaggtggatcacttgaggtcaggagttcgagaccagcctgccaacatggcaaaaccctgtctctactaaaattacaaaaatagatgggcatggtggcgggtgcctgtaatcccagctaatcgggaggctgaggcaggagaatcacttgaacctgggaggcagagattgcagttagccaagatgaagtcagcttcatccctggttcaacatgcaaatcaataaacataatccatcacataaacagaaccaatgacaaaaaccacatgattatctcaatagatgcagaaaaggccttcaataaaattcaacacccttcatgcctcaataaactaggtattgatggaacgtttctcaaaataataagagctatttatgacaaacccatagccaatatcataatgggcaaaagctggaagcattccctttgaaaaccagcacaagacaaggatgccctctctcagcactcctattcaacatagtgttagaagttctggccagggcaatcagacaagaggaagaaataaagcatattcaaataggaagagaggaagtcaacttgtctctgtttgcagttgacctgattctatatttagaaaactatatcattggagcccaaaaacttcttgaactgataagcaacttcagcaaattctcaggatacaaaatcaatgcaaaaatcacaagcattcctatacaccaacaacagacaaacagagagccaaatcatgaatgaactcccattcaccatcgctacaaagagaataaaatacccaggaataccttacaaggaatgcgaaggaccccttcaaggagaactacaaacaactgctcaaggaaataagagaggacacaaacaaatggaaaaacatctcatcctcatggataggaagaatcaatatcgtgaaaatggccatactgccaaaataatttatagatccagtgctattcccatcaaactacactgacagtcttcacagaattagaaaaagctactttaaatttcatatgaaaccaaaaaagagcccatatagcaaagacaatcctaatcaaaaagaacaaagctgggaggcatcacgctacctgacttcaaactatactacaaggctacagtaaccaaaacaacatggtactggtaccaaaacagacatatagaccaatggaacagaacagagacctcagaaataacactacacatctacaacaatctgatcttcgacaaacctgacaaaaacaagcaatggagaaagaactccctatttaataaatggtactgggaaaagctagccgtatgcagaaaactaaaactggaccccttccttacaccttataaaaaaattaactcaagatggattaaagacttaaatgtaaaacccaaaaccataaaaaccctagaagaaaacctaggcactaccagccaggacataggcagaggcaaagacttcatgaagaaaacaccaaaagcaattgccaacaaaagccacaattgacaaatgggatctaattaagttaaagagctcctgcacagcaaaagaaactagcatcagagtgaacagacaacctacaaaacgggagaaagtttttgcaatctatccatctgacaagggtctaatatccagaatctacaaggaacctaaatttacaagaaaaacaaacatcaaaaagtgggcaaaggatatggagagacacttctcaaaagaagacatttatgtggccaacaaacatgaaagaaagctcaacatcactgatcattagagaaatgcaaatcaaaatgacaatgtgataccatctcatgccagtcagaatggtgattattaaaaagtcaagaaacaatagatggtggcaaggctgtggagaaatagaaacgctttcacattgttggtgggaatgtaaattagttcaacttctgtggaagacagtgtggtgattcttcaaggatctagaaccagaaataccatttgacccagcaatcccattactgggtatatacccaaaggaatataaatcattctactacaaagacacatgcacacatatatttattgcagcactatttacaatagcagagacatggaaccaacccaaatgtccatcaatgatagactgcatgaagaaaatgtaatacatatgcaccatggaatactatgcagccataaaaaagaatgagatcatgtcctttgcagggacatggatgaagctggaagccgtcatcctcagcaaactaacacaggaacagaaaaccaaacaccacacgttgtcactcataagcgggagttgaacaatgagaacacatggacacaaggaggggaacaacacacaccagggcctgtcagggggttgagggaaaggggagtgagagcattaggacaaatacctaatgcatgtggggcttaaaacctagatgacagtttgatgggtacagcaagccaccatagtacatggataactatataacaaaactgcaggttctgcacatgtatcccagaacttgaagtaaataaataaataaataaataatattaactcttctgatccatgagcatgggatgtcttttcatttttttctatgttcttcaatttttttatcagtattttgaagtttttgttatagaggtatttcacctccttacatttattcctaggtattttttagtagctacagtagatggggtagctttcttggtttctttttcaactatttgttgctggtgtgtagaaacactactgatttttgtatccagccacattaccaaatttatcagttctcagagtttttggtggaatctttaggttgttctaattattatatgccatctgcagagaggaacaatttgactttcgcttttccagtttggatgccttttatttctttctcttgcctaattgctctagctaggacttccagtactatgttgaataacagtggtggaagtgggcatccttgtcttgttccagttcttagaaaaaaaaggcttttagcttttccccacttattatgatgttagctgtgggtttgtcatatatgacctttgctatgctgaggcatgttttttctatgcctaacttattgagagtttttatcatgaaggatgttagattttatcaaatatttttcctgtgtctattgagatgatcttgttgttttagtctctcatatgttgatgtgatgtgcacgtttattgatttgcatacatcgaaccatcattgcatccctaggataaatcccacttgattatggtgtattatgttattggtgtgttgttagatttggttcgctagtattttttagatgatttttgcatctatgttcatcagggatattggtatctcattttggtattaggataatggtggcctggttgcgtgaattaggaagacttcccgcctcttcaatttttggaatagtttgagaagaattggttttactttactccttaattctactgaacttttaaagtcctgggcttttctttgttggggaactttttattactgattaattcttgttactcattatttgttcagatttttttattcttcctgatttaatcttgtaaggctgtatgtgtccaagagtttatccatttcacctgagctttccaatttgttcgtgtgtagttcttcataagactctaatcatttgtatttctgtggtatttttttcatttctcattttttaaaatttggatcttttttcttggttagtctaacagtttaatcaattttggttcctttcaaaaatcaagcttttattttcttgatcctttgtaatttttgtgtgtgtgtgtgtttatttcgtctctgatctttattctttcttctgatttttggctcagtttgctttggcttttttagttccttgagatgcatcattcggttgtctatttgaaatctttctccttttttgaggaaaacatttattactctaaacccctcttactactgcttttgttgtatcccgtaggtttaggaatggtgtttttccattttcatttgttttaagaaaaaagattttatttcattcatttaggagcatgttttcatgtaggagcatggttttaaattttcatttatttgtacagtttctaaagttcttgttattgatttcgttttactgaattgtgatctaagatgcttgatatgatttcaacttttaaaaatgtgttgagagttattttgtggtctaacacatggtctatcatggagaatattccatgtactgataataaggttgtgtattttgcagcacttgaatgaaatgctctctaaatatctgttcgatccatttggtctgtagtgcggattaagttcaatgtttctttattgattttctgtctagttgatctgtccagtgctaaagcggagtggtggaccaggaccaggcacattggctcacacctgtaatcccagcactttggaaggccaaggcgggccaatcacttgagctcaggagtttgagaccagcctgggcaacatggtgaaactctgtctctagaaaaaatacaaaaactagctgggtgtggtggcatgcacctgtagtgccagctactccggaggccaaggtggaaggatcgtttgagcctgggagattgaggctgcagtgagccaagatcacaccactgctctccagcctgggtgacagagtgagaccccataccaaaaaataataaataataaaatggagtggtggaggcctcaactattactgcattggggtcaagctctttagctctaatgataattgttttatataatatatctgggtactccagtgttgactgcatatatatttacaattgttatagtctcctgctgaattgttccctttatcattatattaatataatgaccttatttgtcactttttatgttttttggctaacattgtattttgtcttatgtaagtatagctactctggcacacttttggtttctattttcatggaataattttttccatcccttcattttcattctatgtgcatctttacaaatgaaatgcatttgttggagacagcatacagttgggtcttttttttttttttaaataaatccattcatcttgtctatattttttacttaaggaatttaaactgtttacattcaaggatgtcattgataggtaaggacttacttctgtgattttgtaaactgttttatgatggttttgtatattttttgttcctttcttcctcttgtattgcttaccttgatgatttggtagtttattgtagtgatgtttgactcctttctctttctcattcgtgtatctgctctcccagtgagtttttcagtcttgcgtattctcacggtggtagttattgtccttttgcttccagatgtagaactccctcaagcatttctcacagggcctgtctagtggtggtgaattccctccattttttcttgtttgggaaagactttacttttcattcattttttaaggatagctttcagcaatatttcatctttttttaaggatagctttcagcaatattttatggtttttatgtacacattttaatcatatctctaaatcatgtgtttgatgttgttgtaaatggtatttttaattttttttgagttggggtgacagagtgacacccaggctggattgtagaggcacagtcatagctcactgcagcctcaaatttgtagtgttcctgccacctcagcctcctgagtagctaggattataggcacatgacatcatacccagctaatttctttttgtatcatttttctgtagagatggggtctcactatgttgaccaggctggtcttgaactcctggccttaagtgatccttctgccttggcctcccaaaatgctgggattaccggtgcgaggcaccacacccagccttatgttttaatttctaattgtttgttactatgataaagaaatgcattgatttttgtccattgacctcatatcctgcaaccttcctaaactcacctattagttctagtaccttttttgtggattgcatccattagatttttctataggtgactatatcaccaatgaagatcatttgactttctttccaatctggatatcgttcatttattgtacttgccttattgtactggccaggacttccagtataatgttaaatggaaacggtgagagtggacatgcttgtcttgctcccaatcttagagggaaggcatttagtcttttaccattaagtatgatgttagctttagtttttagtagataccttttattaaattgaggatattgccttctacttatatattgctgaggattttttatcaggaatgactgaattttggtaaatgctttttctgcatctactgaaacaatcatatagttttcctttcagtttgttaatatggtaaattatattgattaggttttttttgttaatcaaccttgcattcctgaaataaacctcacttgctcatggtataaaaccctttgtatttgttgctagatacaatatttttttgagttggggtctcactctgtcacccaggctggagtgtagtggcatgatcacagctcactgcaattttaaactcctgtgctccagcaatccttccttccatctcagcctcccaactagctaggattacagtgtgcaccactgtgcccagctaattttttatactttttttgtagtgatgaggtcttgctatgttgccctggctggtcttgaacttcgggcctgaagcacctcagcctcccataatactgagattgtaggagtaagccaccatgcctagccctagatacaattttctaatatggctctttaatattttatttagaatttttttggcaatgttcatgagggatattgttctgcaggtttttgtgtttttttttttttttcaaacaacatacttgtttgcttttggtatcagattagtatagtatagcttgggaagtatttcttcctattttcaggaagactttgagtagaactgttattatttcttccttaaatggtgggtagaattcaccagtgcctccatctggtcctagagttttacctgtggaaaggttgtgaactacagattctatttctttaatgaatctagggccatttttattatctattacctcttgaaagagctttggaatttttcatctttcaagacatttttccattcttacacattgtttaatttactggcataatgtttctttattatctttttgatatctgtaggaactttagatgaggccatctcattcctgatattgatcatttgtgtctttctttttcccagatcatttgtgctagggatttacaaattttgttgatcttctcaaagaaccaacttttgattcatcgacttttctccattgtttttggttttctgtttcgttgatttctgctattttttttcctttctgctatttttttttcctttctgctattattttgtctataatttgctcatctttttctaatttcttaaggtgtaagctgagatcattgatttgaagccatggttgctttctgatataggcatttaatgctatacgtttgttttaagtacatcttcagggttattcacaaatttggatgggttgcattttcatttctattcacttaaaaagactttaaaattttcattttgaatttttccttgaccataggctgtttggggccaagttgtggagtttcagaatatttggaggtttttcagatattgttctacattgacttctaatttaattccattgtatcaggcaacatgctttgagtgacatgaatccttaacatttatttagacttgttctgtggaccagaatactgtgtatcttggtaaatgctttgtgtgcacttcaaaagaatgtgtattctgctattgttgggttgaatgttctgtgtcaagtagatatttgatagtattgttcaaatttatatccttatggttttctgtctacttgtcatatcagttttgagatgggggtatttgaaattgccaactataattaaagacttgtctgtttcttcatgcagttctaccagattgttcttcatggattagaacatgagccacataaatttttttattatgacctcttgatgaattatctcatttctcattatagaacgtttttttttttgactctaacaacatttttcatcttcagtcttttttggcatttttaaattgtgtgtcatagttgtacatatttttggagtacacatgatattttgatgcatgtatacaatgtgtagtgatcaaattaggaaaattgggatattcatcacctcaaacatttatctttgctttgtgttgggaatgtttattattaactatagttcttctactgtactattgaatactaaaactcattccttttatctaactgtatgtttgtacctgctaaccaatttctctttatcctaccctctgcccttcccttcccagcctctggtagccactcttctactctctatctccatgagatccactgttgtagctcccacatatgagtgacaacatgggatatttgtctttccatacctgacttatttcatttaacataatgacttccagcttcatccatgttgcttaaaatgacaggatttcattatttttatggctgaataatattccattgtgtgtgtgtgtgtgtgtgtgtatctatctcacattttctttattaatttacccattgatggacacttagactgattctatattttggctattgtgaatagtgctacaataaacatggtagtgcagatacctctttgatatactgatttcttttactttggatatatactcagcagtgggattgctggatcatacagtagttctacttttaagttttttgagaaacctccagaatgttttccatgatggctgtactaatttacattcccaccaagtgtatgagcattcaccatttcctgcatcctctccagcatttgttttttgtctttttgataatagccattgtaactgaggtgagatgatagctcgttatggttttgatttgcactttcctgatgattagtgatgttgaacatcttttcacatacctcttggccacttgtgtgtcttcttctgataaatgtctattcaggtcttttgctcattttaaattggattatctggggggttttggcccattgagttgtttgaattcctcatatattctggttattaatcccttgtcaaataatttgcaaatattttctcccattccatatgtaggttatcttttcactttgttgtttcctgttctgtgtagaagctttttagcttgatgtaatcccacttgtctatttttgcttttattgcctatgtttttgaggtcttaccccaaaaatattcgccaatgtcctgtagtatctccccagtgttttctcccagcagtttcatagtttcaggtttaaatttaagtccattttgagttgattttcataatgtgataaaaaatgaagctctagtttcattcttctgcatatgaatatccagttttcccagcaccatttattaaagagattgtcttttccccaatgtatgttattggtgcctttgtcaaaaatgagttggctgtaagtgcatagatttatttctgggttttctattgtattccattggtcttctatgtgtctgtttttatgccagtggtatactctttgcttactatagcttgtagtataatttgaaatcagatagtatgatgtttccagcctggttatttttggtcagtattgatttatctactacgggttttttgtgattctataagaattttaagatttcttttttctatttctgtgaagaatgtcatgagtattttgatagggattgcagtgaatctgtagattgctttgggtagtatagacattttaataatattaattcttctttgagcatgggatatttttccatttatgtgctcttcaatatctttcattggtgttttataatttttcttgtagagatctttcacttctttggttgaatttttactaggtatgtttttgtagctgttgtgattgctttcttgatttcctttcagattgatcacagatagcatatagaaatgttacacattttgcgtgtttattttatatcctgcaactttattaaactcatttatcagttctaaaagttttttggtggaatctttagatttttctaaatataagatcatgtcatctacaaacaagaataatttgacttcttcctttctaatttggatgccctttatttctttctcttgccctattgtgctggctaggaattctagtactatactgaataattacagtttatagttcaccactgagcatccttttcttattccagatcttagtgaaaggttttctattttaacctattcagtatgacataagctgtgagtgtgtaatatatgacacttatcttgttgaggtatgttccttctataaatttgttgaggattttcatcacgaagggatattgaattttactgactacctttccagcatctattgaagtaattcatatattttccttgattctgttgatgtgtgatgtattaaacttatttgacttacatatgttgaactatccttgcatcactgggatgaatcctacttgattatggtgaatggtctttttaatatattgctgtcttctgtttattggtattttgttgaggatttttccctctttttatcagaaatattgtcctgtagttttcttttgttatctttggctttggaaataaggtcagggtggccttgtagaatgagtttggaagtatttcctcctcttcaattgttaaaaatagtttgagtagaattggtattagttattctttaaatgtttggtagatttcagcagtaaatccatcagttccctggcttctctttgatgggagactttttattactgttccaatctattacttgttattggcctattcaggtttttatttcttcacagttgagttttggtaggttatatgtttccaggaatttttccattttttcctagattttccaatttattggcatatagttattcataatggtcgctaatgatcctttgtgtatctgtagtatcagttgtaatgtcatctttttcatctctgattttatttagttgggtcttctgttttttcttagtctaactgaaggttttaaaattttgttgcttttcaaaaaaacaaactttttattttgttggggttttttgtattgttattttagtctcaatttcatttatttctgctccatctttactcatttttttcctactaattttaggtttggtttgtttttccttttctagttcattgaggtgcaacattaggttgtttatatttggagtctatatttttaatgtaggtatttattgctatagaactttccattagtgctactttttctgtatcccgtgggttctggcatattgtatttccattttcatttgtttcaagaactttttaaacttcattcttaatttcttcattgacccattgatcatccaggagcatgttattcaatttccatatatttgaatagtttccaacatttcttgttatttatagttttattctgttgtggttagaaaagatacttgatatgattttgactttttaaaacttgttgagacatgttttgtggcctatcatatggtctgtcctggagaatgttccatgtactgatgagaagaatgtgtattttgtagcagttggatcaaatgttctgtgaatatctgttaggtccctttggtctagagtatagtttaattctgaggtttctttgttgatttttctgcctgaatgatccacctattgccaaaagtgaggtgttgaagtcccttactgttattgtattgtagtctacctctcctgtttagatctactaatatttgctctctctctctctctctctctatatatatatatatataccctgctatttggttatatatattcataattgttatatcctctttcagaattgactccttgctgaattattatataacaatttcctttgtttctttatatagtttttcacttaaagtctattttatctgatcgaagtatagctagtcttgatcatttttggtttccatttgtatggaatgcttttggtttccatttgcatggaatgcttttcccatcccttcactgttagtctatgtgtgtctctataggtgaagttagtttattgtaggcaacatatacttgggtcttacttattaatccattcagccactccatgtcttttatttggagaatttagtccatatacattccatgttattattgataggtaaggccttcctactgccattttattacttattttctagttgttatatagtgtacctccttacttcctttcttatttttgtggttaagtgattttctttgatagcatgttttaatttgctgcttttattttttgtttatcaattatagatttttgctttaggttaccatgaagcttacaaaaacatcctgtaattataacaagttatttaaaagtgataccaatttaacttttcattgtagcagaagaaaagaaacaaaaagaaaaaaacacatgcattttaattcccttctgttcctacattttaaatttttgatgtcacaagatcaaaatttgcctacctcaaaaattttatagttgttatttttaatagttttgtcttttaatcttcttaataaaattttaaatggtttagatgccatgattacaatataacaatcacattagcattatttttcctatgcttttaagaacttctttagcatttatcataggctaggtctggtagtgatacgttttctctggaaaactcatctctccttcatttctgaggaataactgcttggtgcagtatccttggggaacattttttttttccttcagcactttgaataatatcatctcactccctcctgacctgtaaaatttctgctgagaagtctgctgccaggtgtatttgatgtccgttgtatgttatttgcttttttcttgctctctcactgtttttaggaccctctttgcctttgacctttgtgagtttaattataatatgtcttggggtcttctcacttgggttgaatctgatcggtgacttttgacctttgtgtacctgaatatttatatttttctccaggtttggaaagttctgtgttatttctttgaataagcttgcaacttcttgtctttctcagttctctctttaattccactaacccaaatatttgctcttttgatgttggtccataggtcccataagctttgttcattccttcttattcttttttttctcttctgactgtctattttcaaatagtcttgtctttgagctcactgatcctttcttctttttgatcaattcctctgatacgctctattgcatttttcatttcatttattgaattttttacctccaggatttctgtttaattttattttttaaatcttttctgtgaactttctctgagagatttctgtgagctttcttgaagttcactgagcttccttaaaactgctattttgaattatttgtctgagagatcacatattttcatcactttagggccagtcttggtgccttactttgtccctttgacatcatatttccctgaatgttcttgacgcttgaagtatgatgatatctacacattgagagattaaatattttagtcttcctagtctggctttgtttgtgcctgtacttcttcagagggtcttccagagattctaagccaactgactattgtgttccctgtgatcaccacagtaatctcagcattagaggatactctattccctggcttgctgtgagtctcacaatggctttctggcccaaacggacctggggaagacccaatgacggtacttgtgttatgtgggaacactggccaccagggacctgagtcctgaagactgtcctagtttcccagacaagtctacttcccagcaggtctctgcacaggtaggttgtgtccccaactatagcaagaggggcagaagttgagactggaccccttcagaatctgctgtgggaaggaggctgatgggcctttctcattggctgagacaggcatgtgttactcagcaagtctctgcacaagtggagtagtttcttgcccataacaggaggagctaaagccaagactgggcctcctcagggtctgctataagatggagggtggccgggtgcctgtagtcctagctactcgggaggctgaggcaggagaatggcatgaacccaggaggcagagttttcagtgagccgtgattgcaacactgcactccagcctgggggacagagcgagactccgtctcagaaaaaaaaaaaaaaaaaaaaaaaaaaatggaggctggcatacctgccacattggctcaaatgggcatgcatcttctagtaagtccctgcatagacaggatagttccccaactatcagcaggaggagctggagcagaatctgggccctcataagatctgctgtgagacagatactgaaggggtcagtctcagctcagaggggtgtgtgtcacccagcaagttcctgtagagatagaatagttatctgattacagagagagggtctggagctgtgactgggccctcttgggatctgctgtggaatagaagctggagagcccagtcttgtatcagaaggcatgtctttcccaggaggacactgcatcaataggatagttccacgactgcagcaggaggtgctgtacatgcctctctgcgggtcttagcacaaatgggataggtctttgactgtcttcagtctcttttgtctaatattggtagatccactccagctcttatggttactgtttgccttatccacacttacacgtttaaatgattgtttatttctatttgaagtgtatttctcaagcatatagtagagcctcacttttttatccaatctgacgatttttgccttttaataagggtattttagactatttcaatttcatatgattattgatatggtttggttcaaaatattattttctgttttctatttgtcccatctgatctttgttctctctctctcttttttgctttcttttggatttatgaaacatttaaatggttccaatttccatcttctgtgggtttattagctattacttttattgtttaattattgctttagtgtttgtaatatatatgtttaagttaccacagtctaatttaaagtgatattataccacttatataaggaataaaaaccttacaatagtatacttccatttctcccgtctgacttttgtgttattgctatcaaacattttaattttacatatgtcatcattcacacgttacattatgatttttgttttaataataatcttttaaagagatttaaagtaataaaaattacatatttacccatgtggttatcatttccaaagctcttcattcctttgtctatattccttgtgtttttgcttatggtgaattcttttaggatttttaagtcaaaaaatatctttatttcccttttgttttggaatgatacttttgctgggtgtatatttctaacttgacagtttttagtactttaaaaacattgctccactgtcttctcacctgtatttccaatgagaaatctgccgtcatccttatctttgttcctttatatgtaacgtgcttttttctctctggctcttttcaagatttttctttatatcactggttttgggcggtttggttatgatgtgccttgatatagtttcttcctttgtgcttggggctcacttagcttcttggatacatgggtttatgactttcattaaatgtggggaagttttagccattatttttctcaaatattttatttgtaccacactctgtcttctcctttagggactccaattacacatagcaggcacttgaagttgtcctacagctcttttttttctgtgttttatttgttgttttttttccctatatattttattctgaatagttttattgctagatcttcaaatttgctgatttttcattctgcaatatctaatctgccattcatctcatctactatattttttttatctcacacattgtagtttttatctctagaggttcagttttgtgtctttttaaatatatattccatgtttctacttaactttttgaacatctgaaatacagttgaaataactgttttaataaatagctgcttctgtcaattctaacatctatgctagttctaggttggtttcagttatctcttcattatgggtttcattttcccgagtctttactttgtaaatattcttaagctttgttttagaatgcagttgcattacttggaaacagtttgatcatttttttgttttgcttttaatatgtgttaggtgggatcaggtcagtgttcagtctgtggctaagtatgggaaagacttctgggtattcaacccaatgccctgtgaattgtgaagttttccaggctggctgttaggaagtggcactattcctggctttgtgtgagtgctgtgcaccattatctccaatctttttaggtagttaatttctgagccttgaatagttttctcacatgaatgttgtgttagtcccttttgcattgctgtaaaagacacctgaggctgggtgatttataaagaggcttattctgctcacagttctgcaagctatacaagaagcatggcacccagcatctgcttctggtgaggactcaggaagcttacgatgatggtggaaggtgaaaggagagtaggcgtgtcacatggcaagagagagcaggagagagaagggggaaggtgccagcatcttttaaacaactagcttttgcatgaagttaaagagcaagaactcactcattaccatgggaagggcactaagctgttcatgagggatccacccccaagacccaaacacctcccaccaggccccatctccaacactgaagatcacacttcaacacgacgcctgtgattctcagtgttggaacctgctgggaggtgtttgggtcatgggggtggacgacacatctccaacattgaggatcacatttcaacatgagatttggaggacacaaacatccaaactacatcaggtgtgctgatcagtactcagctgaacacttgagggaccttctgcaaatctctagagctctctcctctgcagtactctgtcttgtaaattgttgccaccttggtctccctgtacttcagcagcagaggtattcatgggcaagttgcttaagttttctgaacagttattttctcatcaatacagaaaggataatagtatttagcttatgattctactgtgggaactgaacgaaactgatgtttgtacagcacctggcacttggcagatactcagcaaatatttgggtcttccctgtctctgcacctggtcgttacttcttcctgatttttgtcttgggtttgcaacctgattcctggctgagctttaggttggtttctgtataacgatcaaccaaagcaggtaatcactcatgagccattcaggttttaacttgatgagtttcagaattctgctattcaaatggcatttaggtagaaacgtatcctcctgtaatttgacatttattttctccaaaatctcattcagttcaacctgcaagaattatttgaattcacttatttgtagtgtgaatgtcagtaggctttagaaggtcagtggtgcgtggtggaaagaatttaagaggaccaatgctatttgcaaccccagcgtgatttttctggggtttcctagtaggtcatgaacgtcaaccttttacttccccttctcattttgcctcagatttcccaaggagctacatgaagaacagatgagtgtttgtcagaacttaaccatttctcttttatcttctcccctgtggtagtgtctggaggtcgcagccgcctgcatctcattgatctcggcagctgtgtgaaagctcttagcaaaaatcgagaaggaggctcagggctgtgtctctcgctgtctgctctgggcaatgtcatcctggctctcgtcaatggcagcaaacacattccatacaagtaagtgactcttctactcaaagaatgtggtggggtaagcatggtgtgggacgctttgttcagtgccatctgtggagaggtgtgccacagagggacagcctggaccccattataagttcagtgccagagaccagccttagctaacagttgtgtaatgcatgatctcccaaattcaaaacttttggaaatacttaaatctattccagttctaactttaggctgctcaaattagaggaaataggaaattatctcagttgaggtctccactcgcaaatgaaggtggtgggtcattgtcaccataataaagatgtgcctgtttcatagtgatgagagtgaggggtggaagactggcttatccttaggggtagggccaccagacttaaccaaaaaaatataggatatccaggcaaattcaaatttcagataaccaacaaataaggttgtattataagtatgcaccccaacattgcatgggacgctcctggtgacatgtattttatctggcaacccaatctcgggagttcagaaagctaggggagttagcacctgccttcccatgcaaatgtttagtcacttccaggatccttcctgtctctttactactgctccaattaaattacagccgctcctatgtctggcagagacaaagccactccaccaccatcaccccaactaagcgttctcattggaccgtgtggtggcaggccattgactggctgtccaggcttctgccaaggcctagctgagcctcttactagctgcatgaaccttcattcttcctaaaatgagggttaaagctatacatgttacatcacagaaatataaggctcaaaatgataaaacatgtataaaagtttattgtaggctgggtgcggtggctcatgcctgtaatcctggcactttgggaggccgaggcgggtggatcacaaggtcaggagattgagaccatcctggctaacacggtgaaaccccatctctactaaaaatacaaaaaattagctgggcgtggtggtgggcacctgtagtcccagctactcaggaggctgaggcaggagaatggcatgaaaccaggaggcggagcttgcagtgagccaagatcacgccactgcactccagcctgggcaacagagcgagactccttctcaaaaaaaaaaaaaaaaaaagaaaaaaaagaaaatttattgtagaatttaggacactatggccaataaccaatgatgaaagtctggttacacctatctagtcaagcctatcctcacctatttaaagggaaaaaacaccgaccttacagagttgccatgaggtgaagattaactaaatatatgtggattcatggttttatctgtaaaaaccctacaaaacctacgttgctgttgtgtaggaggaaaaagtcgggcagtgtattctataattactgagattcacaatgagtgctggagtttttcttcccctcagccctatgttgatgccagacccccccaccaaatacattgtgagtttatttcctaccaggagaaccattactggactgactttaggagcttaaatggtgattataatcctgtccatctcatttctagaaatttggaatcctagttggataaacccagaaatggttttcccggctcttgtaacaacccttttctatgggagaatattctgagttgaagaattatagagtttcattcgatgtcatttctgtagttgagtaaattcagcttgtggggagaaagggcaggggagggaaaccgttggagttggagatgaagggaagagtactagcactcactggtttccataaaatgagaatcatgtctgttaatgtcagaacttcatagatcatgatatagataaaattccaaattgcaccttagcaggaggtcattgattacatatcttacttatagcttttacactgtttctgcagggcgacatgcttttatgatttctataaatagttgttgaattgatggcgggaagatagatgcatgtaaacatgaaattatttttaatttaaagtaacttccttttagttagagttgggttttttataaatgagtagggaaacattaaaaattgtttttatggcccagcgtggtggctcacacctatattcctggcactttgggaggctgaggcgggaggattgcttgagaccagcctgggcagcatggcaaaaacctgtctctacaaaaaatacaaaaattaaccgggcatggtgttgcatggttgtagtcccagctacttgggaggctgaggtggaagggtggcttgagtccaggaggcagaggctgcagtgagttgagattgcgctactgcaccagcctgggcaacagagtgagaccctgtctcaaaaaaaaaaaaataaatgaaagtttgtattaatcgttcaagcttcgtgttaattaagcatatttttaacatgctggccctaccaactggctacctgccctcctgggagacatctccactcaccagtccctgcagacagctgcctgccttcattccaggagtccccttccttctattctggcaccaagagagtgatcattaaagtgtttctgtgtctcaagtaagcagactagcttccatgcagtgtcagcacaagacccaatcctggagctgtcccgtggcctggttgagctgttgatggcgtgggtacagactcaccagctgcccttgccctgccctgcctaacacaactcatcgagaccttgctgggttgcctggtgctggaaacacggtggccctggccatccagccagcgctgtccttcccaaaacatccattggccagtgcgtttgttctgtcacccctcagtgtcctaatgcccttcattgtacgtgatcttaaaaagacccttgccgaaatgttttctccgagtctggaccacggcctagattcaatatttggcatctgcaaatgtacatttacaaagtgattcatcaactagaaactgtcctcttttgaggtacaggaagataaggcaaaggtttactcaaatcacccagccagtgggtggcaggatcaaactgcctcgctcctcacagcttcagaggcctcgacagttcccagcctcactgcagacccacgcccacttctcatcaagctcccgaaatgtcggagctgccttcactgcgcacggcaggggagcccagcacagcaggaaagccccgatttctttgatcaattccgtcagtgctctgaagccacattatgcagcattttgttagcatactaaacaccttcagggtgtcaagccttgtctttgcagtgcgttccttagagaagtggaagtttcctgcccttgaggtttcctcttactcctcctgctcacttacggagggtggcggggggaacaaaaatagaaaaccaaattccatattctctttccttcccccaccccccccaaaaaacacagacaccccactacctcttcatttgtctccccagacaactctgtacttggaacctgcattacttgtgcttgctcctgggaaattcgctgcaatgtgcacagaggggctgtagcctgtcttcattcctcttcatcatcttaccaggctatttgtcatgtgagcaagctggaaagtgagtttggattcattacccatcccaggcattcccacaggcaccctccatgtgcgctgaatgcttctgactttgcaaatgatattgcccttgaagatgcaggaggcgtggagcaggtttccaacctcagccattacacagcacaggcacattacatggcacaggcttgccggccagtccaggcgccataaatcagttctcaacggtggcaccattcagaaaagcatgcagggaaggcagggagaccaccaagggctccaacccctcgtcagttctgcactgacaggctgcacaaattactctctaatttttgagagcctccacctccagggaaccctgccctcattcgatcattttgacagtgcatttgcaaattttctttattcggtacattcatttgctgttccttactgctcttgggcaccaaggtgctaggaatcttcccatttaatggataagaaaaaataggcagaagcgttgaaatgacttctcaggccaaaacccagtgttgcacatcccacaggagttggcccccagaagaaccgccacaaggatctgtcagggtgaactgagcttcggctaacgggtgttatgtcccagctcatctgaaggaccacagcttttcgagactcagattctcaccatgacccaattatctcaaaatagaatttctggttctcttagatgttgctttgtagagggcacaggcccttagaaagcacacacctgtcatgcaggcgtccttcaagccctgaagcatttaccttcattgatgactgctgctccatatggagaaagaattcctttaatgggtcatatgacctgtttgcttatttgccaacacagtgtttctaaacactctgtttctaaacaacagctagttgctaatgtcttggctgccctttaacaagagttcatggaaagtccttctgtggccctctcatgtcatgcctgtctgagatgcttctcccagtcatcttgaaaaatggtgctacataaccatcctgtcgtggaaatgatgcccggcacctccctctcacgggtttggtctatggttcagacccagacctaatccttgtttgttgagatcagtcactgagacactttgggtctcagcagctgtgctgagctcgcctcctcctctctctggtagagcctgaggcaatctgtgatccaagctgcaggccacgagcaaacaccgcaggcaacatccacttccagaaggctgtgttccacaaaagcgatgaggacacccatcctcaggggctataatgggaactcttttcctcctaaggccctagtgaggagtcaggaaccaaggtcatctttaagcttgtagcatcgggacacaccagttcattcaaagcagcaggcagcactagaagctcaagttcaaatcagtgacttgaaaggaaatgacacttcataagtagaggcagctttttcaaaatgcaagcaccttctcatccaagagagggtggggttctggcacctgtgggtcacacttgtggcagcaggcccagcattggcaggaacttcaggacgagcctctgaaggatgtggacattcccctccttgcctggagaagtgcttcctcctagagcccatggagatttgggattagcctctcctttctcagaactggaaacccagtactcaaggtctgggaagctggggaaaggggctcaagattgctgttagctagagcggggttccaaacccccaggccacagattggtacaggtccctggcttgttgggaaccagcctgcacagcaggaggtgagcagtgggggagcatgaccacctgagggctgttggctgtctgatcagtggtggcactggattctcataggaacctcatgctattgtgaactgtgtgtgcgagggatctagcctgtgcgctccttatgagaatctaatgcctgatgatctgaggtggagcagtctcatccccaaaccattccctactcccattgggtccatggagaaattgtcttccacgaaacctgtccctggtgccaaaaaggtaaaagggtttgggactgcggagccatggcattgaattcccatctcacacaggagaggaaaggctcttcctcaggacttggatgtatattacttagacgtaccatgaaattaagtagatatttgccaggaaaaatgcaaaggagtatcagttctccagatttgtttaagatagcatgaaacggagaggttcatgtaagaatctgtgtgtgtgtgtgtgtgtgtgtgtgtgtgtgtgtgtgtgtgtgagagagacatatgcatatttaacctcctttaaatgtacattaatgctgtattttctccccctgatttacagggagaatatcaatttagaactatttgcacaaactctagataccagtttagagcgttccctatttagaaataaaataaccaaagtctcaggttgccaggcaactgcagcaatgataattcttagtattgctgctttagaaatactcatttttatacattttagtgatggttaggatgcagagaatgtgagttcagaatgtcgctgggacatcgaagtcccttttctatgagatttttagcattctcacttgcttttatttttcccccttagctctgtttgcttccttggctagcggtatcttcatatttagctatagaaatctcgagagattgttattattttcttaagagttgaggcagaagctgccactacattaattctgccaggctcattatagaaccacgccagtcactcagggagaaatgacaccgtctggggatcggccggggtcacaaacactgggttcaagctttggttgttctgccgctagtttgacacatgaactctacacctcgtccttttcattcttaagaggaccacattctggcccctctcagagcttcactgaattgggaacagaatatcaggccccagctctgtcatcatctcttggcggcaaagccacggctcatgtttttgtctgtccactgcagcagccgttgtggcgtaatggcacatgatggtctcggggctgggtagaaattggaaggcgtcttcctttcccttttggcctttcaagtgtatcttcctttatgtctaatgtctggggttactattaaagtctttctgaattctgaaccaatgatcagatagatacaagagaatgattgggaatgaaaagcctgctaatcctagcagagtaggaaagggtagacagccccttccccaaccccacggcctcagtggaggagagaatggtgtggcctgcaggggagggacaggcagacagcgccagctgtcacccaggctcacgttcaccagcctcagcagtcagaccttcttccttcctcccttggaggaagtgaatagaagggcagaaccgagagcgggaactctatcttgatcttgctaaaggggtagaagttcctaattcgtggacttgctggaccacagggaggaggagaaaatgatttctagtacttatttcctggcatttcagctacatggaaggtagttagcacggtgcataaatgagcccccggtgagagtatttcccatcgtgagcaccacagccgggcgttgttctcactgtgcctcacaagctctgctaaatgccttatggatatttcattctgacaacctgtgacataggtactgtaatcatactagtatcacagatggggaaactgagacacagaaaggttgagtatcttgtccaagttcacacagctaataggcaacagggcctcactgcctcccagtttatcaccccccaccgagtacagtttctggaatattgtgctcggtcaacatttgttgcaataacaagtggggtacaacagaggatcaaacataccagcaaagcttgcatatgtgtagttgattataagtaaaagcacagtctgggcacagtggttcacacctataatctcagcactttggaaggcctaggcaggaggatcacttgagcccaggagtttgagaccagtctgaacaacataaggagacctcgtctccacaaaaaaaaattaaaacactagctgggcatggtggctcatacctgtagtccaagctacttgggaggctgaggtggaaggatcgcttgaacccaggaggttgaggctgcagtaagctatgatcgtatcactgcactccagcctggacaacagagcaagaccctgcctctaagtgagtgaatgaatgaaggcacagacccgaggggcagggctgatggtagccaattcatacattcaggtcggtctcctggtctcacctgtttctgtgattgctaagccaggctgatggctagatacccatggcaatgaagaatgtaaaatacgaaaggtaaaaaagggaaataaatcttcctttcaggacccaagctacttatcagggctaaacaaaaaataccaagtaagaatgtaatgatgaggggtggggagggggcaaaaaataaaattaaaaagaatgtaacaagcaacgagacgctcctgactttgaacctgtgtgcagggctccgggtagattagaaggcatcctaacctcagtaaatggctgtcagtggggcctgacagtctgggtcccgtgttctgggcaccaccaatggagggtatcctctcagaaagcttcaccctatttcatgagcctttaataaaatatagctataatctttctcgtgaaagagcctgacagttcatggagccacttcccacgccgcactgatgggagaaactgcaggactccaccaggctttctctggctccaggacccccacgaaggcctcctgatttatctggggcagctcctgcataagaagggtgaccgtttcccacagtggagaaccagacactgggcacagcccacttgataagacagcttccatctcccgcccctcctgggtatgcaaaggcattcctgagtgaataggttcaggtcagagcaggagaggttatcacccaggctgtgccttgaagctttgctgagtacaagaaaggtaaggaagagataagcaagaggtgagaatgacggcagggctggcaagtgagatcacgagcttttcctcaaacatctggctaagaatagaagctttgggaaattccacaactggcagattaaggtgatcagcctctcagctggaatttgtgaagtttcttcagactgagctcccagagaagtatgtgtggtggaatcgctgtgctttctaaagagatggattgcaacctgcgccgttgagctagtgctgagctgaggcccggtgagatggattctagcacccctgccacggctaacctcacacactcagacgctctccctgagcttttcatttctccatcagcaaaatctcaatcattcttactcctcgtccacctcagaaacatattgtaggttccatggagacgatgtctgtggtagacaaagagacgtgcttcaaaggcagaaaggtcactgttttatcatctttcagaatcgtgtaacccacgtggttctgccaccatcctgtcttctgtgcattccttgactttgaaagtacgcatcttttcttttgaccaagtagataattaccgtctatcgaaatgaaccctcatgcatttattcaatgagagtttgtgtgcctaacacacagcatggctgcctgatacagatacttggtttaagagaattctacaggctctgcacgaaagtgaagtcatgatgtaaggaggcaaaggactctgccctcaaacagtccaatgggcctgagaatgagcctggggtgggggttcgatgctgctgcacccccagttgtatctgtgtatcccagtgactggggcgtgatttgaatatttaaagatactcctttttcatacggcctttaaatgcaagccgagtacttctgctgcacagccggagaggtggtatgtttttaatgctggagtaaaacttgtctgtgttggacttagtgagagaatggttttcgttcagagattgtcaaggccaactttgatataaatttcactttacattttacaccacacgtgattcataacatttaactctgtcatccatagaactcggtgctgttctgatcagcaaggtagattctggcccaaaagaactggtggaggaatttaaggaactggttctaagcctaattgaggtcaccaaacatacagagaaaataatctgagaaatgtatagcagaaatctaagttttccatttattcatttactcaaaaataccctacaataaataccaggaatataacagatgatctgcattcttgggcaacttacagtgtagcaggaatacagacactgagcaccgagtaactgataatatacgcacatcagcgctgaatcggcactaagggaagaaggggtcgggtggggctgaggaatggcacagagcggtgattctcaagctctctcctcctcgagtcccactcattctctactcacgctcatctgtgtcttccaaagtttgccacagtccgtcctctaaatgcctgagtcattcacacctgttctgtcattccctgctttgatatagagatgatccaacacaaatcatgacaaaccactaagccaaatgcaagactctgaatccacagctgagtgtgatctttaatgacgactaaccatcatatcacaagttgtgtcataaccagaaacaaaacagccagagaaggagggctttaggttggtctggggacagtacggagagcccaagacgcccttgggcacccacagggggctgtgattattcaaggatggcttgatttaggcacaattaggcattggacaggatggagcatacaaatgtgttggggattaattcattaaaaatctgtcttgagctttaatagagcttcagtcagagtgtccaaccataaattctcacctgtttcacaactggttcaggcccaattgagcattaacagatttttttttttgttcatgcaaatgaggttttgtgtgtaattcattcattcatttcatttatttcatgtctaattgaacaatttttgaatagttacatttgtggagtagttaagttgtatcaaattgtctaatgtacctagtaattttgtaactaaaacagagctgaatttcattttgatataacaaaaggagaaccacagaagtagaggtggtttgaggaatagtcggcttttaagagactttatgatactctgttctttagggcaatgaccacagttgctgtttctttttatcctcacttttctttcttttcactccctaccgatgagatcaatgaaaatttggggggcatttctagatttggcagcctcccatttataagcatacatttttttagttttgtgccctgacatgcccatttttctgagggtcaaatgtgtctgtctttaaaacaccgcgttggtgtctttcaaaccacttatcaagggttgtttctcccacgagaccttgtcacccctgagcctgaaatcgcgcgctgagaactaattgcagtagctgcatacacacagtgaacaaagttcactgctcccttcattaagggcacctgccatatccactgtttccttccgagaactcttttggtgaagacgggatttttgttttctttacattccacatagctgccagaaggcccctttaaaatgcaaatctgatgtctctcagtctttaaaaccttcagtggcttcctgttggctacaggatagttgaaacccttttgtggcctatggagctcttccgaatttgggccacacctacctttctgaccatagaaactacatagagatgactgaacaccccaccccacccccacagtcacatgctttgccgatgccgattcttctgcttccagcggctgttcattcactcactcattcattcattcaatcaatagttaccaagaacataccctactccagtactgtactggagctcctcctccatttgtgagattcttcttatgtctttgacatgttttgattgtaagatgtgttgcatatgcagatgtagaaacacacctactcagtctatagaatgacaaaaaatctgtgtgcccaccacccaggttaggaaatagaacattccactagctcaggtgcccttgtgtgatcgtctgccttccgtcaccctcctgcctgttccagcggtgaccacagtgctgaattttctggttttgatccccttgcttgtcttataggttttaccacctaagtatgtgtccccccaaaacatactgtttagttttgtctgctgttgaacgttacgtaaatgaaatcatactctattctatgcccttccgtaccttcttttgatcagtatttcatttttgagatccatcttgatgcgcacagctacaggttcttaatcttcattgctgtacgatttttccattgtagatggatattgcaaaatattcttctgtgggtggatttctaacaagtttttaaaaactgattgttgaagttaatcgaacctatttctgctctaatgagatgctcacttggttcctccattaatcatttaatatggtcaattacattgtgagttttcttttctttttgagacagggtgtcactccgtcacccagactggaacgcagtgacaccaacaaggctcgctgcactcccaggctcaagtgatcctcccacctcagcctcccatgtagctgggactacaggtgtgcaccaccatgcctggctaatagtttatattttttgtagagacggggttttaccatgttgcccaggctggctttgaaatcctgagctcaagcaatcctcctgccttggcctcccaaagtgctgggattacaggtgggagccactgtacccagccaatcagttttccattaataatactaaaaattcttggattccttcctacttattctttgaggcttatctcaaatatcatctcccctctcaagccttctctgatctcctttcccccctcctaattctttgctccaggaaagttgtttccatcttccaactcaatggcattaaaatggtattttaatgtaggcacttatattttaaatatttgtttacatatacctctcctatcatatgagctcatctagataatgatagagggcacatgcagtggctcacacttgtaatcccagcacttcaggaagccaaggcaggaggatcacttgggcccaagttcaagaccagcctgggcaacatagtgagactccatctgtacaaaaaaaaaatttaaaagtatagtagccatgcatagtggcgtgtgcctgtagtcccagctactcggcaggctgaggtgggaggattgcgtgagcctgggaggttgaggctgcagtcagctatgatcatgccactacaccccagcctgggcaacagagcaagaccctgtctcaaaaaaataataatgatggaatcttgttcttcagcttccttacgattttgcactaatctgaatgaaaccagcctgatctaaaccttgcatctttagtgacagatatgagtctgacacccaccttcaactttgtggtagcctgcccagcttcccagaggacacctttgtgcccgcaggcttcctgtggccatcggatccccaatctaaactaggataaagtatatgttttgtggtattgtcacctgtttaggatgagaagaggcactgaagctataaccctattttctgagccagataaaatagcaaacatatatttgctctaccgggttattttgacaaatttatcaagcatcttcaaaatatacagtactagtctaagcattagggctaatgcagagagcttttgcaccagtaggacagaggaaaaaatgtgcacaaattagagtacaaggcataaagcagttaaaagtcacattatcaagtacattcaaggaaagaggtaagcagttccagcaagtaggccgggcgcggtggctcacacctgtaatcccagcactttgagagcccaaggagggcggatcatttgaggtgaggagtttaagaccagactgaccaacatggcaaaacccaatatctactaaaaatacaagaaaaaaaaaaaaaagccaggcgtggtggaacatgcctgtaatctcagctactcaggagcctgaggcaggcgaatcgcttgaaccccgggaggtggaggttgcagtgagccgagatcacgccattgcactccagcctgggcaacagggcgagactccatctcagaaaaaaaaagttccagcaagtcagctgtgaatattttttctatggcaataataataaacacaagatgcaggtatagattcctatttatgactacaactctccacatgtctagaatttggtggaagcaaataggtcttagaatttaccccaaagcttgaattactgaaactgcctgttagtaatagtcatttatcacatggatttggcgctggtgtcgtgaggatctaagtacagggaagttctgggcatgttcatttgccatttattaatttctgttctttgctattttttgggggggcgggtaggggagacaaaggtcttgtcacccaggctagaatgcagtgatgtggtcatagctcactgcagccttgatctcccgggctcaacagcgatcctcccacctcagcatcctgagtagctgggactacaggtgtgcaccaccatgcctggttaatttttaaaaatttttttctagagccagggtctcactgtgttgcccaggctggtcttgaattcctgagctcaagtgatcctcccatcttggcctcccaaagtgctgggattacaggcatgagccaccgcacccagccctactttgccattctttatttctcatcttaaggtggctacttagcttggcagtttccccttcttgttctgtaagcacctacgttgctctctaagtactgctttgtctgtatcctcaagttctggtaatgacaggtattttcactatcattcactcaaaatattttccatttctcattgtaattatcattttttgagacggggtctcattctgtcactgaagctggagtgtagtggtgcgatcttggctcactgcagccttgacctgctgggctcaagcaatccacctgcctcaacctcctgtagctgggactacaggcgtgtgccaccatccctggcttttcttttttcttttttttttttttggagacagagtctcactctgttgtccgggctggagtgcagtggcatgatcttggctcactgcaacctctgtcttctgggttcaagtgattctcctgcctcagccccccgagtagccgggattatttgcgcctgccaccatgcccagctaatttttgtatttttagtagagatggggttttgcatgttgccaggctggtctcaaactcctggcctccagtgatccactccctgcctcagcctcccaaagtgctggaattacaggtgtgagccactgcgcctggcccattttaattattttgtgatccgtgggttatttagaaatgtatttactaatcgccacagttacttggaatttgttccttttgagccttttaagccttgcaaaggcaggtgcagcacagcctagggctgctttgatcccactgttagcgcagtaaccttctgaggacgctgaggaatgatttacatacactcacatatatatgtacacccattatatacaccatatatattatatacaatatacacacatacccaatatgtatatacacccaatgttatatatatatatacacacccccaatatatatatacacccaatgatatatatatacacacacacccaatatatatatacacccaatgttatatatagacacacacactcaatatatatatatacacccaatgttatacatatatacacacacaccaccaatatatatacacccagtgttatatatacacacaccctatatgtatacacccaatgatatatatacacatacacacacacaatatatatacacccaatgatatatatattacacacaccatatatatatatacaccctatgatatacatacacacatacccccatatatatacacccaatgatatacatacacacactcaatatatatatacacccaatgatgtatacatacacacaccccatatatatatatactcaatgacataaataatatgcacacccaatatatatacacccaatgatatatatattacacacaccctatgatatacatacacacatacccccatatatatacacccaatgatatacatacacacactcaatatatatatatacccaatgatatatacatacacacaccccatatatatatacccaatgacataatacacacacccaatatatatatacccaatgatatatataatatacacacactatatagatacacccaatgatatatctatacacacacacacccaatatatatacacccaatgatatatatactcacacacaccctatatatatttacacacctaatgatatatacacacacaccctatatatatatacacccagtgatatatacacacacaccatatatatatacacacacatacacccagtgatatatacatacacatacccgatatatatatatatatatatacaccccatgatacatatatacacacacccaatatatatatatgtacacccaatgatatatatacacacacccccaatatatatacacacccaatgatatatatatacacacaccctatatatatatacacccaatgatatatacacagacacccaatatatatacacacccagtgatatatacacacacacacatccaatacatacatatacccaatgatacatatatatacaatatatatataaacccaatgatacatatacacacacacccaatatgcatatatacccaatgatatatatacacacacacacacacatgcatgccctgggtataaacagatctcctcactctgtctgcttgaacacagacttccaatcccttcttggcttcaaggattattccaactctcctttctgtggccttgcttgtttttttgtacacatgtggattagagctcaaccagagggctccagagagctcttgcttgctctcaggtcacctctgtctttttttttttttctctcttattctctttcccctcttctatctctccaattcttgctttgtatctctctccattcttcccttctgctattttgtcctacaaattttagctgccctgatctccccaaagtctggacttttccttgttcagaaggatgtggctgcctggctctgcttgggtcccctgtcgtgtttgggggcctggaacctctctcctggcagtaagctggggcacttacaaggctcagctcatcttttccccttctctcagacatgactttcctctgctgcttgttacccagtatcagaaacccattttttttttcttatagtttgtttggttttctagttgcttaaggttggagggtaaatccagtttctatttttcaaacatggccagaagcagaaattttgtcatttgtgatcatttttttttgtttatttctttaaacagtttaattgtctctaacatgttaatcaactttttgttgtttatttgtgatctaggtttgaacatctcattcttgcatctgtggtttctgctggctctttctcatggtgccgtgtttctttgtttatttgtgtctgggggctactcattttcactggcattttatttgtgagaattctgcaagctctgggataaagatagtttactccagacagcatttgtgtttacttctaccaggtgccagttgaggatagtctaaactacattctcagcttgaaatatttttgaccacccagatatggagaactaagcgtgcaaacctgcatgtaattcagaccagggttcgcaattctcaggacagtttctttcccctctgctcagtgcttatttcaagacagtcatgtcttgaatacctacaagggacaattattgggggttgattttcctgtgaaaattcacatgtggagcaggcctccagctttgactgctgccacataaaactcagcagggtgttacctggctgggcagatgtctttggggtgaaagaaagcttgcctgttctgcttatttatcttgagttcccaacttcacttgcttttttttggcctgaggattctttacctttttgcaggttcaacaatgcatttactaagacttaaaaataatatccacggccgggcatggtggctcacgcctgtaatcccagcattttaggaggccgaggcaggcagatcacctgaggtcgggagttcaagaccagcctgaccaacatggagaaaccctgtctcgagtaaaaatacaacattagccgggcatggtggcgggcgcctgtaatcccagcaactgaggcaggagaatcgcttgaacccgggaggtggaggttgcagtgagccgagatcacgccattgcactccagccttggcaacaagagtgaaactccatctcaaaaaaaaaaaaaatccacaacatttaactgtacttggtaagaaggttttcctaggaacccagcctatcatattgctcctttgcttttttttttctcctgttacacacctctccttcttttaaataagtaaggagatcatataacttattatcgaagccacttttgagagtgaaaagggacacttaattattattatttcatgttttgaaatattttctgacacagccgtctatattggtgaacctataaaacagttctattcaaaaattactttcaaacatgaaatgctttcttaataaaagaaaatacatcaaagtagaaaaaggttaaaactgctttatattgtttatctggacattaaaaaataagcagaataatcacttaatatacttttgtgtattttaatcattgtcttcactatcttctaataccacttcagtagtatttttcttaacactattttttctattgttaatgtcagggcgtttttctccttcacataatccaactgccttacctatatatttacatatatgtttatgtgcattaacacatcaaaccatctgtttttgataactgtggcttctgtttctcttgatagaatatcacagtttgtttaaaaataagtgtgaatttattcatacaaccaccaattacaagtttatttcagtgaaatacatttctcaattcagtgagaatattgtgtgttaaagtttcaaaggatcttcccacaagtcaatttccagagcatacttgtagaatttcacattttaatcttctatacagtttgagctcttgtcatctatatttcagggtcccctgtttgcaaattttgtttttaatcattgcaattcattacaggcttcagaggctgagctttttgtgtttcattggttgaacacttgattatggattacaacttattttgaaccacaagccatcaaaatttagatgacttgtttccaaaactggagtactttttttgtagagcatttggattgactcatgaagtatgttttaaagttaaaagctgcctaatgtcagcaatttcctatcatttcattatttcaagtgtcaaatatttctcaaatccaacttgacaggcagcaaagagagaaccgcacactctactgatgaaatgtttttaatccaatttaaacttcataaaaaatttttgtagttcagttactctcagtttatgtaaattttacacatttcaaaaactatagcttgtgcttctctgggtagaattagaactgtgtttgagctcagttatgaattacataggtacatcaattacaggtacatttcagcataataagtttctcagcttggaacattatatcttttttttattttttattttttttgagactgagtctttctccatcacccaggactgcaacctccgcttcccgagttcaagtgatcctcctgcctcagcctcccaagtagctgggactacaggcacgcaccaccatgcccagctaatttttgtatttttggtagagctggggtttcaccatgttgcccaggctggtctcaaactcctgacctccagtgatccacccgcggtcagcctcccaaagtcctggcattacaggcatgagccactgctcctggctggaacattatgtccttttttttttttttttttttgagacggagtctctctctgtcgcccaggctggagtgcagtggtgcaatctcagctcactgcacctctgcctcctgggtttaagcaattctcctccctcagcctcccaagtggctgggattacaggcaggtgccaccacacttggctaattttttttgtttttagtatagatggggtttcaccatattggccaggctggtcttgaactcctgacattatgtcttaaagtgctaactctgttcactgcacataacctcatatgttcctagatgagaccactgaaatagaaagtgaaagtctatccaattcttccatctcattttaataagtcttagtaataactacttgtattttgaataaagaaatgaaaaatccaggacaaaataaaccagacaggatgcagggtgataggcatacactgagacttctaggcaagtgagcaactggtcagccgaattaaagcccttggaggggttcctgtaccctaggttcttaatacatgcttgttgaatgaacaatcggaggtagcttatttgtttgaataaggctttctgtgtgttactgcaaaggaatgaggatgggacaggtttaggctttgtaacaagacctcccaaaggctaacacataggcggctgcttcctcggcaagcagagatgacgcttgtggccctttttgaaacaccttttttacatgccagaggtatttaacttgtccgtaccaaatggtacggacaagttaaaagggttatccgcccttttaactcaaatatcccgttgggatcaaacatttttgctctggagacctttgtacctgtgcagcatcagtataaggatagcctgggggtggtaacccagacacagctaacagcggggtctgagtggcttggccagagtcttggcctcaaattgagggcacagcagtggttctgactgttcctcttcggggaacgttgtacatcaggaggggcctgatggtaatgttggtgtaaaatgtctctgctgtgatccacccttgaagactgtgagctgtgcagaacgaagcaggtcatggcttgtcctctaggatgtgatgggaggctgaaagcatctctctgctgtgacgtaggagggaccgtgagccttatgctaggcactccttccagcccaaggcagcatcgtctactttggttttctttctttctttttttgaaacactctgcccaggctggagtgcagtggcacgatctcggctcactgcagccttaagctcctgggctcaagctatcctcctgactcagcctcccaagtagctgggacaacaggcgtgtgccaccatgcccggctacttttttaaatatttttaatagagatggggtttcgccatgtgtcccaggctggtctcaaactcctggattcagacaatctgcctgcctcggcctcccaaagtgctgggattacaggcgtgagccaccgtgcctggcctgctttggttttattctgactgtggctcctaggaagaaaaagaaaagatgatgctttggaagctgtagggttgggaagctggagacttcttgtgatggagaggtacacccagtagatacttatttaaatacttatagaaagacgactttatgccggacactgtgttaggtcctggctatacaggaagaagagaagtggcatctgcccatcctacgcagttctccaggaaggaggtggcaggagtgacatttgggccatccaggcaactcaccaagtcccttcgcagcactcctgaaaagctctgagatgttttgaagctaaaacagacaaacaaaagggaccaaagaggtggcatgagtagcatgagtcagatgtgattaattcctaattccttagctgcttctgtttgtttgttttgttttgtgtttttgagatggagtctcactctgtcacccaggctggagtgcagtgcagtggcgcaatctcagctcactgcaacttccacctcccaggttcaagcgattctcctgcctcagcctcccaggtaactgggattacaggcacacgccaccacgcttggctaatttttgtatttttagtagagacggggtttcaccatgttggtcaggctggtcttaaactcctgacctcaagtgatcagcctgcctcggcctcccaaagtgctgggtttacagatgtgagccaccaagcccggccccctatttccttatcttcttatccgcagcaggactttgagaaacggctcagttagggtcttgcagggataacagtgattagagcctgaacacaaactacatttatcccatgtcagaaatgaatagcttatcaaacgtaccaacttaaaagatgcaagaattgtgcaacaatagctaccttcttttcaaacaaaataaacatcactaaaaaactctaatcttaattctttttcaagaaatggataattcctccacatcattctcctttaaaattttgtagattctcccttaagttacttaatgtatgagttgtggcttctgtgtaacgtcttttctcaggcttgtattggtaatggaaagcattcttcagcttaatttccttttaattccttccaattactatgcactgttctttgtgccaagtgccagtccagttatccagttggtgcattttgtgagaactgtaggatcatggagatcatgtttcttttcttttcttttcttttctttttttgagacagcgtcttgctctgtcaccaggctggagtgcagtggcacaatcttggcttaccgcaacctctgcttcctgggttcaagtgattcttctgcctcagcctcccaagtagctgggattacaggcacgcaccaccatgcctggctaattttttgtagttttagtagagatggggtttcgccatgttggccaggctggtcgcgaactcccgacctcaggtgatccgcctgcctcagatcacccaaagtgctgggattacaggcatgagccactgtgcctggccaggatcatgtttctttaaaccacacatgatacccagaaggcatcataatagagttggcttcatcatcttccttatcctaggttatgcttgatttcaaaagaaatttgttcctcgacaatacacagaaaatgcacttaacaatagcccctgaagttttccccagccaatgactggttagcagtctaataaggatcatattggacaagtatctttaacacaaaacagcacagggaatcatgggccactctcatcgttaggctctcttcacaggtatagcctatgttagaaggcttctgaaccacagatgctaaagaaaaattagttaaactgaagactgatgaagtattccctacaaatgaaaaggcaatcttatatgacaaaggacactatcaggaggttgaaaaacaacctatagaatgggagaaaatatttgtaaatcatatgtctatgattaatatccagaatatataaagaactcctgtaagtcaacaaccatcaccacacccagttcacaaatgggcagaggaatcttatggacatttctccagcggagatatatgcacagccaaggagcacgtgaaaagatactcagcatcattagttgctagagaaatgcaaagcaaaccccaagaaggtaccacttcctagccagcaggatgtagctattaaaacaacaacagaaaatcagtgttggcaagggtgtggaggaattgcagtccgtgtgcgttgctggtgggaatgtaaaatggcatagtcattgtggaaaggagtgtggcagttcctccaagagtcgcatatagaattgtcacatggtccagcaattccattcctaggttacccaaaagaatggaaagcaggggagctggaggccattatgctaagtgaagtaactcaggaagggaaagccacattcctatgttctcaggtataagtgggagctaagctgagggtccacaaaggcagagtggaggaatggacattggagactccgaaggggaaaggagatggaggattaaaacgctacattttgggtacaacatatactacttcggtgacaggtgcaccacaatctcagacctcaccactatacagttcatccacgtaaccaaaaaccacttggacccctaaagctattaaataaaataaataaatataaacattcagtaacattatctttagaagaacactttttaataaacctgggcatgaagaaaaaaggctgaataatattccatcgtatgcgtgtgtatatccatatatatatatatatatatatatatatatatatatgcacacacacacacaatgtatatgtctagtgttaccaacttagtttcctttccttcaatattaaacgtctcatatttcccccagactttttgagagatagttgagaaataaagctgtgtaagtttagagtgtagtatgtgatgatttgatatatattgtgaaattattaacacaagttaggtgacacacctgtcacctgtcctagttatcatttttttttgtattgtagtgaaataaatgtctcatttaaaaaaaaaagaattgaaagcaggaaatgaaacagatacttgtataccaatgctcatagtagcattaagcataatagccaagaggtaggaacaacccaattgttcatccacaaatgaggagagaaaatgtggtatgtaaatataatggaatatacgtttcatggaaaagaatgtatctttcaatttttaatttttgtgggtacatagtaggtgaatatatctatgggatccatgagatgttgggatacagacatgcaatgtgaaataagcacgtcatggagaatggggtatccatcccctcaagcatttatcctttgagttacaaacaattcaattacactcttttaggtacttaaaaacgtacaattaagttgttatagtcaccctgttgtactttcaaatactagatcttattctttcaaaaattggttgaacctattaaccatccccacatcccccatactctcccaatacctttcccagcctctggtaaccatccttctactctctatgcccatgagttcaattgctttgatttttaggtctcacaaacaagtgagaacatgtgatgtttgtctttctgttcctggcttatttcacaaaatgatctccatttccatccatgatgttgcaaacaacaggatctcattcttttccatggctgaatagtactccattgtgtatatataccacattttctttatccattcacctgttgatggacatttaggttgcttccaaatctaatggaatatattattcactcataaaaagtgtgaaattctgatacatgctgttaatataacacggatgtaccttgcaagcatgttgagtaacataagccacaccccaaaggacaaatattgtatgattccacttatacaaggtacctggcacaggcaaattcatagagacacaaagtagaatggtggttaccgggggccgggggagtagggagtggggagttgttacttaatgggtagagtttgtttgtttgggaaggttctggagataaaggatgtgatggttgcacaacaatgtgaacgggcgcaatgccactaaactgtgcgcttagttgcaaggttacaataggacattttatgtatatttcaccacaataaaaataggaaaaggcaggtgatttctaaggacacaagtcccttggggttgctagttctgtcagacttttccccttgtttttctgaatgacaaggattagtagtggatgataatgagtggattcatggatttgagcaggacatgaaacaatttccatagacagagatgaaagggcatttctgacttgaaacctgggatgagcaccgatgcaggagaggcacgaaagctcacagcgtgttcagggcgtagtgaatagaggggtgcgtgccccgagcctgcagagcgggcagggatgtgtaggaaggcaccttcatcctcctcactcagcctcccagctccaggtccaaagccgccaaatcatctttcttgtcaccatcacatgataagggggagtccttccagactgccagtcaatgaagtaacacacacagccacggtcatgccagtctgagcccatcgggcgagccctgaggggaataacagtcttggtggcattgggcaagccccgaggactccatctcggggaataacagtcttggtggcatcggcgcttcaccaggcctcctggaaccatattcgggatccccaactgagtgctggaaagaccactggtcaggagcagggagcaggggtggaaggaggtggctcgtcctgaccttgacaatgagaatcctgttttaagcttcacgctgctgactaaacagaaaggccacggcacagggacagacgtgcgcatgaaatcacaggaagaaagacatttcacgaacaaatgcatcctcccaaaccagtctgaatccctccggacagggtgatgttaccacgcaactggcctggcctaatgagctggtttctgtcatccctcctggaaggttaccctgtaacacaaggcgtgcccactgacatgcagcctgatggagcaaggttacacctgtctgccttttgtgtgcacaagatcagaacacagtcaagtgaatacaaatgcaacagctgcttggggctcaaacttgcatagtctattttatttggatagagagcataaaattggctctaccaaagtctggaggctggaagtaatcataattgtaatctagtataattaccaagcctagacctttacctagtcctatttaacctccctttcacctttccaaggaatgtggagggataagagagtcactgaataagttggttggtaatactgtattgtatctctcaaatccattgtttttttttaaagaatgagatcaataaatataaattccaatattttcttccccaaagcaccatcttgtaccgctttggagaacattagagggactcacctgggtttccagagctggaaaacataagccccataatgcacccagtccccacggcgcgctgccatcttaggcccagtccccactgcacgctgtcatcttaggcccagtccccgctgggcgctgccatcttaggcccagtccccgctgcgcgctgccatcttaggcccagtccccgctgcgcgctgccatattaggcccagtccccgctgcgcgctgccatcttaggcccagtccccgctgcgcgctgccatcttgggcccagtccccgaggcccagtccccgctgggcgctgccatcttaggcccagtccccgctgggcgctgccatcttaggcccagtccccgctgcgcgctgccatcttaggcccagtccccgctgcgcgctgccatcttaggcccagtccccgctgcgcgctgccatcttaggcccagtccccgctgcgcgctgccatcttaggcccagtccccgctgcgcgctgccatcttagggttttgcttagggggcagatagaaaatagtaaatgaaaccctttcagatatttcctggccttatttagtaaacacgtctttttgaaagaactctgaatacacctgcagatttttcaaagcccagattctacacacttctaatgtcaaccttgaagggagatcgtagattgaattacagaaaggggtgctgtcaaaatgccacatcaaatataaacttcacatatgtttcttacctgaaacactcactcacactcatggaaaagcacaggaatgttctaaaaatgcaagtttatcacgaaggagacacaggaggttcagagacgatgaagcggcaagccgggaggaaagatctgagagaagccaccaggctggggcaggatttcattatatccagaattccacttgggctctgcagtttctttcttcctgagaattatttaaaagtccctggggaaggacaagagtaagaaaaaatcaagggagagcctctgggttactatgacaacatgactcttgaccccttctctctcacccagcagtgcctaagtcccttttgcattgctgcagagatctctggcactgtgattagcacatactcctaaacctgaggatgatttaaagtggaaggagatcaaagtttctaaatagtacaatgagctcatcttgactcaaaagatgtgtaatggttataatgcaacataactgagatgtttccttatcccccccaccagtaaagctggtcacagaccgttgcaaaggctctgtgaaaaatgacaggtctatggaaatgtctactgcaaagcactgataactcaggataatgattcaggccaaaaaaaaatttaaaaggaagtgaaacttcagacaatgtgaaacatgtcagagtcgtgtttgcattctaaattgcagtaatgatataaacatcattattcctaatctgatcctgcaggtggatcaaatacgcacacatctattaaagaacagtctgcatgctcagtaagtgcacagggtcttattaccgaatctttcagcacatcttcatttcatctttaacttcattagaatatgtaagttttggcagtctattgattcaggagaaatctatggatctattattttctatttgtctataaagtccactaattcaccttctaagttgttgttttgggttttcatcaaagtgatgacattccaactcctgattatgctacattgaataaaaataaatgtaggattttctcctttctgacctagagctaataagttgtacatattggctgagttactgcaaagaaagggcaaaatgaaaacacagctcttatagtcaaggttcttaggatcttattgagatgagctcctcagaatcagccaaacttcaaacatggagagcacggcccccagtctgccaagtcggcccaagactactgacacctactgcaagcaattagggtccaactacaaagttagcagaaagagcccacccaagaccactgtcacgtgtgacaactgcatgtttggagggttcccaaaacgaccctcaggctcgtaattctctagagggactcacagaattcacggaaaatactcatggctacaatttattatgttggaaaggagacagattaaaatcagccaaaggaagagacacatggggcagaatctaggacggtttcaaaagggacgcttccattgtcgtcaggacacattacattaccttcccggcatccgtgtgtgatggtacacgtggagcactgccaacccaggatgctcacctgagccttgtatccagagttgttactgtggtttcattacattggcatgattgattgattgatttcccatgtggtctaactcagtctccaggtggactggtactgtgtgaccccaaagcccctgccctaaatcacatggttgatccttctcttgcaaccagcttggaccatatgactatcaggtatggcccatcctaccctaagatcttatgtggccaaccctcaccataacaaaggcactcccagtgagtatgatgtagtttacctcccagaagctcatggaaaaggccacatctatctttgggaaaggtcaaattttttactacccaagcctgacctgagaagtgctaaattgtgagggtggaaaggggctagtgtgagcttggatgaacgaagtatctgaagagcaatggaaggaacatggaatgttcttaaacaacagaacatttttaggaccatagagtattggagttgaaagaatttgggagattattgcatttcttaataagagcactgccatgcagaagtggccttgtcttggtaacatgatagaagcacatgataactgtctttaaagtgtgaggggcccatgtgagcaacagggattatttttaccccatataatcctagagaacaaagccagtggccatgggttagaagttattaaaaagaagatttaagtttaatagaagaaagagctttctaataattgaggctattcagaatattacacaggctgtactgggatatggtaagttctcccaagttaaaaatattcaagcagaaagcagatcacctgttaccatggcagtgcttttattaggaaatgcaataatctcccaaattctttcaagtctaatactctgtggccctaaaaagagttttcaatcttgacagaattgtattctggaattagtggactatttctttcataagtcattatgtgaattaccttgaaaatttctaatatcgtacctgagtgccatggccttggcatgaatatacacttcctgagcagaacttaagaatgagaatatctggagtaattcaggttctgctaattctgcatggttgtcactgcgatgatgttcattgttctaggtaagaaggataaatgagtaataaaagtttcatgggacacatataagtgaactcatgttttatatccacttcagtcattcattgcaagcgagtcttgttcaatgagatcaaagcagattggttaggattttgacttgaaaccttctgttatttataaattggagttacatcatatatttcttctaaaagattctattgagactgtttgctgtctacagctggtctttctccagaagtaggttgaattgccatgaattttatcttattcagataaatagaatgctggtatctaggatccaatagattcatgtggcccaaatttcatccagacttcatcctcctctgtgtacagtggcaactattaaaatcataacagagacttgttggctccagcccatacttgcaatgtaaaacctccacttggtgcaaactctttccatccagtattttctgatgtccctgagggctctcatgaatgctcatcacacgtctcctcctggaaacaactgctgcttcaccaagaatcgcaggccccacggggaaccatcacttctctcctgcctgtcactgggcacagccaccaacattccagagccatcatggtgccagccccaaatgaccaggatggtgtcgggaagaacgcgtctctcccacgcattatcctgcctcagaggcatctcaaatgatgctgcttgcacctcagggttctacagtgtttcataaaaagagatcgatgagcaaataaatagattaacttcatgtactcttaatagttcaagacctctgccaaccagcggtctcaggataagcaagacatgacctcataataggaggtgtgctggttggatcacaaaggctggtccttcagccagagtgggtggttctctgcagggacctcttctaagctctccttgatgagacaactaatcatcgtgtacactgccgaatgacagtgtttgcagaacctctagcatgcatgctggcctcggctatctctgccaatactttattacacaagccagagtcaccttcatcggaagacttgagaacttggcttctctatcccacgaatgttatgcagtcatcttcccagcatcctgcaggacagacctgcttatgccatttgcagtacaaacaaagtactatctatctgaaattgagcagcaagtactttaacttcacgtacctctccttctgaaaatgccatcaggatagctcagcccataccaagcttctggtacttctctagtaccccaaagcaagtaattcatgccctaaggcattagcatccttgaagggaatgttgccaagacaaggccacttctgcagagcagataccttccccagaggggaggcgtccaaagtcttgcctcaaacgtaggaatgttcaggaagcagtcatggacagcgagatcatcaagtcccttaggaataagtaaactcaaataaaataaaaataaagtgattttcccttttggaggtatgtgtttcagtctggcgcaactcaacactgtcagaaataataaagacacttacttgagacctaggagaccctttggggcagaattgccctcagcagagctggtgatggtttcccttgagaacagcctttcccatgagggataaggaactgcggagatgctgctcaccttggccaggagcattgggccagggatgatggcttgggaccctggtccctggcatctcaggctggtctccaagggtcactggtgacctttcaggggacaaaagaaaaggatcttcacagatagttggctgtaaataggaaggaggcagggtcagtggtgaggaggatatttgaacagtcagcgtgtatttcaaagccgtggttctgtccccctctggtgttgcttccttctcctcttcactctgcagccgcctcttggtggtcagagggtgaatgcagggccctggggtttggggcctagggctgggagatcagagctcttggagctggcttgatacctggcaatcctcatccagcatctccatctctctacgacgcgttctggcacgttgcaggtgaagtgggtagagcgtgggatggttactggaatcgatgtagttccagggtgctgtccttaagagtgcgagtggtaccagtcagtgttctcggcatttaaatattagttgttgttatcttggctatctcatgcgtgtaagaattctgtgtgtgtagtttccatccttaaattcaaccaaggtattactgtaaaaaaaagcaagacaggcctggcacagtggctcacgcctgtaatcccagcactttgggaggccaaggagggaggatcacgaggtcaggagattgagaccatcgtggccaacatggtgaaatcccgtctctactaaaaaatacaaaaaattgctgggcgtggtggtgcatgcctgtagttccagctactcaggaggctgaggcaggggaatcgcttgaacccaggaggcggaggttgccgtgagctgagatcacactactgcactccagcccgggtgacagggcaagacttcgtctcaaaaaagaaaaaaaaaaaagcaagacaaaaactctctcccttttctagaaaagagcatgcctgtgcgtatggctggctgtgtgcctacagttcatgtgcctgtttccgtttttgctgctcaaagccatggattggtgtgtagtcaggacctgcattctctgcttggtggttcagtgtctgggatgatactgtttcccggttactctagagcagaggtcaacaaacttcttatgcaaaggagcaggtagcgagcatttttggctttgtgggcgacacaggctctgttacaaccactcaactcttattgtagcacaaaagtagccacagacactatgtaaacaaatagatgtggctgtgttttaataaaactttatttacaaaagcaggcagtgtgccagcttgggcctgcaggaccctggttggtcagccctgtgcctgagtgataacatgctctttcatgcctttaaaaatgattattaaagtgtgttcattatcctgttctttttgtcctttttcttgtttaataagtgttcactgattttaaaaagacatttttctaaaaatctgggggttttttgtgttttttttgtgtgtgtttttttttttttttttttttttttttttgacacaaggtcttgctctgtcacccaggctggagtgcagtggcgcaatctcggctcactgcaacctctgcctcctgggttcaggtgattctcctgcctcggcctcctgagaagctgggattataggcgcgcgccaccatgcccagataatttttgtatttttagtagagatggggtttcaccatgttggccaggctggtctcaaactcccgatctcaggtgatctgcccgcctcagcctctcaaagtgtggggattacaggcgtgagccacggtgcccagcataaatttattttcaaaggcaagtgtggtcagtgtaggcagggagtgaaacatgtatgcgtaaacacaactacttgaaagagcggtgcggtccttcctcaggcccccgtcagctctgctccatccccagtcccttcctgtgcctgcccaacctgtcctccatagccagggccccccaacccaaacccctccaggcaccacctccctccatccctcccgcctggctctggggagggggtggccagcggccctgcacgcttcttcctcttttctcttcctctctcttcagacttgatgcaaagagtgggctaagtctgtgctgactgttgccctggaaactcttttgaacctttctctttccctccaaagattccgagttcctcctacagtttgcagccttcagtaccctgccccttccctcccctgccctcccttacttggttgtctttattccaagttaaatgatcatcatgaggttgggaaagccgcagctttctatgcaccatgttttactccccaaaggacatcttttagagtccgcagaggcccacatgaagggctcaccagcagctctaccggtttgctttccacaaggagagctaaaatgccggttgctaagcagcatacatgccgctgcttctttccacaatgtagacttaaaaaaatcgccgtaaacattttaccatatgattgagtcaggtgtggggagtcgcagtaaacattttaccatgtgattgagtcatgggtggggagtcgcggaaatacacagggcaggcagttcgctatcacgatgttctctctcaattctgtctttggtctgtcttcctgggtaatgtcacatggagacccaggggatctgccgtcagctgtgtgcagtgggttaacaagacgacggggaacttcagagtgcaggcagtcctcatcttttgcagattctgtatttgcacattcacctactcactgaaatgcatttgtaaccccaaaatcaatacagcggtttcacagtcattctccgacacgggcagaggggtgaagatactgagtcgccagatgcacgcgttccccgccgaggtggagcgtgcaaagctctgccttcacgtttggctctcatatcgtgcacatgtgtcctttttgcagtctccttagcactgtgtttttcatatttttgtgctttctgatggttattttgctgtaaacggcccccaagaatggtgctgatgtcctatttagggtccctaagcacaggaaggctgtgatgtgccttatggagaaaatccatgtgttagacacacttctttcaggtaggagctacagtgctcatgggggtctagtgttaatgaatcaagaatacacacacccagaaaaaggaagaggaagcgcacagggcagccagcttgatgtcaccacgttacatccttttatccggtctttggtaagttttcttttcttttttttttttttgagacagagtctcgctctgtcgcccaggctgaagtgcagtggcgcgatcacggctcactgcaagctccaccccccgggttcacgccattctcctgcctcagcctcctgagtagctgggaatacaggtgcccgccaccacgcccagctaattttttgtatttttggtagagatggggtttcaccgtgttagccaggatgttcttgatctcctgacctcatgatccacccacctcggcctcccaaagtgctgggattacaggcatgagccaccgcgcccggccggtctttggtatgttttcttggggacttacacagggtcacgtggagatacagggggatgcgccttcggcccatctgtatgtggggccactctggaaagtgctaaggtaacagctatagtacatgaggaagccatggaagagatgaaaagtggctgaatgtgtggattcatcagatgatgagaacatttaatgtaatagatagcattggtgtgaggctagacaccaaagaaatgtacaatcatgttacccaagggaaggaaagtattaaacccttcttggctagtgttttattttaaagaaataccaaatataattcattattttgaagaaacgtattaaataaagcatcttattaacaaggttacgtattgaccagttgaagaaacttttgtcatcagaggttcacagaaacctaaaccatacgttaggttggtgcaaaagtaattgaaatgggccagatgcagtggctcacacctgtaatcccagcactttgggaggccgaggcgggcggatcgcctgaggtcaggagtttgagactagactggccaacatgggtgaaaccccgtctctactaaaaatacaaaaaattagctgggtgtggtggcgcgtgcctgtagtcccagctactccggaggctgaggcgggagaatcccctgaacctgggaggcggagattgcagtgagccgagatcgtgccgttgcactccagcctgggcaacagagcaagagtctgtcttaggaaaaaaagaaagaaaaaaaaagtcatcgaaatgacagaaaccgtaattacttttgcaccaaactgtatttcccctaagaacaatggcccagtatttacaaattcagtgttcacaaatattttatagaacacagctaccatgaataacaagagctgactgtatatgatcacaacctaactgagcagaactcaccctccactactcatgtaagacctgactgtatatgatcacaacctaactgagcagaactcaccctccactactcatgtaagacctgactgtatatgatcacaacctaactgagcagaactcaccctccactactcatgtaagacctgactgtatatgatcacaacctaactgagcagaactcaccctccactactcatgtaagacctgactgtatatgatcacaacctaactgagcagaactcaccctccactactcatgtaagacctgactgtatatgatcacaacctaactgagcagaactcaccctccactgcgcatattgaagacagagcccaagacgcatccaggtgcaacgtctctgctaagaatgtgtgccaggaatggggcctggcttcctcgtcgagtgcggctgtccgtgggtttctgctagacagataacgttctgaaggagttaaactttcacagctcctcctcctcctcctcctcctctatatcccttacctcgccacgttcatcactggtcattttgctggaagggaagccctggtatattcttacattgctctggaagtgagctttagcccagcgtcgccaaacttacaccttaattgatcccagatgagaaggaaaagctattgctcttaccccacagtcttccctccctgaggccagaagcaggtcacgtgtaaaatggtctgctctctgctgacagtggcctgagtctcccatagtgtctgctgagctggatagtccctctccagggagctttgcaggggatgggtgatgagacatggacatggggacgaattcctctcatctggaatcgcagacacagcatggagatatgagcacgcggcatgggaaataggcttcctcagcccttcaggatcagggaacgtgccagagatgcaatgacatttggcagcagttgagagtatgagtgctgttgatgaaataaacagaggcctttaaaagcaaggcaggaaaaatgctgggacgagtacaggaacagaaaaccagccatttctccaggtctattcaaagacgtagcaacactccctgcaaaccccagggcctcattatcaccactcagggcagtggccccgcacagcacctgcacagttgccagaggaggcctctctataggaagtgctgctttctgttgtggatagagtgactggctgggcctctctctgtgtttctcccctagtcttcaggaatatgaatgccttttccttcagtgctactaggtgcaaatatgcgagttaagggacaatgccaataaagtagccgcagtttcctggctaaaggaactgtgcaggtattaaaaacccaccgatctttaatccaggttcgtggcagggggactcctttttgttgcaagattgtctgtgtgtggaaaccctggagaaaggccacacgtgcagtcagcaagccgagtcaccaggcacagagccctttctcctgatcccctcctcttgtttctattcccaggcctcattatgtataatgtcacagacacacacgcccaggaacatcccatcacagccaggacagaagcgccaagggaggtgctttgcacagattccatcttggagttagaagcacttgctcggtgcttgccaactacaaatagccccatgctggaaaatgatgctaattagtatgccattaaaaagggtggggggaccaccacccacaacaaaatggccgtgtgcaggcctgaagccctgccctgagggccacagggaagcatggccgctaatgcagcctaattcactttgtttggcagagagagcaagctcgccatgttgctgcgggagtctctggggaacatgaactgccgtaccaccatgatcgcgcacatctcggccgcggtcgggagctacgcggagaccctgtccaccatccagattgcatcgagagtcttgaggatgaagaaaaagaagacgaaggtaaggagctcgcggggtgggggggtggtggatgagggagcctttggagccgtgccctggaacagagtcagaaaaagccaaatcaacgttgccaatcccccagcatcaggagatgtgacttggagctgacaacacgtggctcagggtccactttggggcagggaaaccttggggctgatacaaagtcatgtcacctccccacacctggtgctggccctggtcacccagcctggacccctgaccggaagcacttggtccgctttagagagtacaaatggattgctacctcaagaggaaaaacgttggagggatggaaaatattgtttttctcatgcatggcctcggtcctgcgtaggtggagactgtgtccttcgaaggcttggcaccaaagaggttctcaactccctgctctcagggcccctcccctgctgcatgtccaggagtcactccctggctgctgcttttgtcctggcaattcagtggtttctggatgatactgagtctgctggacatcgctgggctcattttctcaggcagaggccaagccaggatggtggcagggtggcaagtagttgagaaaaccatcatgatcgtggccactcagtggcaggggcagctgctgaggtgggggcctttttcccccttctctgttttgtaccttttttatctttaaatagcgtttcttaaccagagttccacggcacagggtgccaaacattggtgagccagcagcccttagctggtcaggcagggcctggatggtcaccccctttcctgagcagctgtttccccagcgtgccacacggggcttccccttcacaaatgcagtggtgatgtgacaccgggcgcgcgggcatggcaccccgagtggcccacgtgcgggaggccaacgggggtggctgtcagtagcctgtgtcgtcaggggccttcaccacttgccgcgcacagctgggctcccggggaaactgccacggaaaggccaccacattaactgccgtctcactcacagtacacatccagctcgtccggcggggagagctcctgcgaagaaggccgcatgcgcaggcccacccagctgagacccttccacaccagggccacggtggaccctgacttccccatcgctcacctgtccagcgaccccgactactcctccagcagcgagcagtcctgcgacaccgtcatctacatcgggcccaacggcacggccctctctgacaaggagctcaccgacaacgagggccccccagactttgtccctatcgtgccagccctgcagaagacccggggcgacagccggcccgcagaggcaggagaggctgcagccggcaagtcagaaagggactgcctgaagtgcaacacgtttgccgagctgcaggagaggctggactgcatcgacggcagcgaggagcccagcagctttcctttcgaagaactgcctgctcagtttgggccagagcaggcaagcagaggcccccggttaagccaagcagcgggggcaagcccactctctgagtctgataaggaagataatgggtccgaaggtcagctgaccaacagagaaggccctgaactcccagcctccaagatgcagaggagtcactcacctgtgcccgccgcggcacccgcccacagccccagcccggcctcacccaggagcgtcccgggcagcagtagccagcacagcgcctccccactcgtgcagagccccagcctccagagcagccgggagagcctcaactcctgcggcttcgtggaaggcaagcccaggcccatgggctccccccggctgggcatcgccagcctgtccaagacctcggagtacaagccacccagctctccttcccagagatgcaaagtctacacccagaagggggtcctgccgtctcccgccccactgcctccctcgagcaaggattccggcgtggcgtctagggagtccttgctgcagcccgaggtgcgtacgcccccggttggaatgagcccccaggttttgaaaaaatccatgtctgctgggagcgaagggttcccggaaactcctgtcgatgatgagcagcaggcagctactccttcagagtccaagaaggagatcctgagcaccacgatggtgacggtgcagcagccactggagctgaacggtgaggacgagctggtgttcacgctggtggaggagctgaccatcagcggggtcctggacagcggccgccccaccagcatcatcagcttcaacagcgactgctctgcacgggccctggcctcgggctcgcggcccgtcagcatcatcagcagcatcagcgaggacctggagtgctactccagcacggcccccgtctccgaggtcagcatcacacagttcttgcccctcccgaagatgagcctggatgagaaggcccaggacgcagggagcagacgctcttccatcagctcctggctgagcgagatgagcgcgggcagtgagggtgagcagtcgtgccacagtttcatagcccagacgtgttttgggcacggggaggcaatggcagaacctgtggcctcggagtttgtcagcagcctccagaacaccgctgtggtgtgcagagagaagcccaaggccagccccgacaacttgctcatcctgtctgagatgggagatgactctttcaacaaagcagcccccatcaaaggctgcaaaatatccacagtgagcaaggccatggtcaccatctccaacacggccaatctgagcagctgcgaggggtacatccccatgaagaccaatatcacagtttacccctgcattgccatgagcccccggaacatccaagagccggaggcccccaccgccacccccaaagcaggccccacattagcccagtcccgggagagtaaggaaaacagtgcaaagaaagagatgaaatttgaggacccgtggctgaaacgagaagaggaagtgaaaaaagagacggctcatcccaatgaagaagggatgatgaggtgtgagactgccacgggcccctcgaatgctgagaccagagcagagcaggagcaggacggaaagcccagtccgggagacaggctcagcagcagcagcggagaggtgtcggcctccccggtcactgacaacttcaggagggtcgtggatgggtgtgagatggccctgcccggtttggccacccagagccccgtgcatcccaacaaaagcgtcaagtccagcagccttcccagggcctttcagaaggccagccggcaggaggagccggacagcctctcctattactgcgctgctgagaccaacggggtgggtgcagcctcgggcaccccgccctccaaggctaccctggaggggaaggtggcttcccccaagcactgtgttctggctcggcccaaagggactccccctctgccccctgtccgaaagtccagcctggaccagaagaaccgggccagccctcagcacagtgccagcggcagcggcaccagcagccccctgaaccaaccagccgccttcccggcgggcctcccagacgagcctagcggcaagacgaaggacgccagcagcagcagcaagctcttcagtgccaagctggagcagctggccagcagaagcaactcgctgggcagggcgacagtcagccactacgaatgcctctccctggagcgggccgagagcctgtcctccgtgagctcccggctgcacgcgggcaaggacggcaccatgccccgcgcggggaggagcctgggccgcagcgccgggacctcgccccccagctccggggcctcgcccaaggccggccagtccaagatctccgccgtgagcagactcctcctggccagccccagagcgcgcggcccgtccgcctccaccaccaaaaccctcagcttctccaccaagtccctgccgcaggcggtgggccagggctccagctcgccccccggtgggaagcacacgccctggtccacgcagtccctcagcaggaacaggagctcgggcctggcctccaagcttcccctgcgggccgtcagcgggcgcatctcggagctgctgcagggtggcgcgggcgcccggggcttgcagctgcgggccgggcccgaggcggaggcgcgcgggggggccctggccgaggacgagcccgcggccgcgcacctgctcccgtcgccctacagcaagatcacgcccccgcggaggccccaccgctgcagcagcggccacggcagcgacaacagcagcgtgctgagcggggagctcccgccggccatggggaagacggccctgttctaccacagcggcggcagcagcggctacgagagcgtgatgcgggacagcgaggccaccggcagcgcgtcctcggcgcaggactccacgagcgagaacagcagctccgtgggcggcaggtgccggagcctcaagaccccgaagaaacgctccaatccaggtaggcggctgggcgcagggacgcgggtgaggagggcggcaggtgggcgagctgcccaaaccccactgccagggtgtcccgtgccctggggagggggcgtccaggcctggcctctccttgcaggtgggcgaactgcccaaaccccactgccagggtgtcccgtgccctggggagggggcgtccaggcctggcctctcctttcccacggcccggcaccccgcggggctccgccggggacatcaccgcggagggtttctctgtgagaaactgccctactgcgtgccgtcatcaggcttagggccgtgaatcccttggcgctcagcagggtggaaaggcgagggcccggatgcaggtggcagcatgacccgcacctgctcgctctgggggcagcctggctcttcgccgtccattccctcacccctgcccctctgttcaacaaccaaggatcctgtggacggtttacagcctgttgagggatcaggtgagggtacctaccctcatgacctggtggcttcagaagcccctcctgtgaggttggtggcctgcaagaccctggcagcctctctcagggatgtgggataacgcacagattgtcccattgaaagtggaatggcgaggcccttcctccacctccaccccaaacatatttgtggacagtcatgtttgcacacctgccacagggcctgcagtgccccccgccacacacaccatgatgcctgaaatgcgtgattttggagaaagtctttgccatttctttttttcctttttttgagacagtcttactctatcgcccaggctggagtgcaatggcgtgatcttgccaaactgcaacctctgcttcctatgttcaagtgattctcctgcttcagcctcctgagtagctgggattacaagcgtgcaccaccgtgcctggctaatttttctatctttggtagagacaaggttttaccatgttgaccaggctggtctcgaactcctgacctcaagtgatccgcccgtctcagcctcccaaagtgctgggattacaggcgtgagccaccacacccagtcagtctttgtcatttttaagaatctcctatcaaaaggcacgtactccagaataattaatatataaagcccacagacttgttaattggagtcttgggtggcacatgacagtaagttatgatgggcaaggagaagaggacccgggtcagagctggtggccctggaggtcttggggtaggagaaatgaaaggatggtaaggagagaaaaagacagacagaggcaaaagttcccaagaacaactgaagctacttgagaattttgcctggaatcatctctgctcataagtggcttccaaagaaattacccctgctcatcctttaagggcttaaaaaaaaataaatgaaatttacgcagaaccccacgtgcaattctgtggcttggttgaagccagggcggccgggttcctgccctcctggcctgtctctcccctcccgctgcccttctgtgcaacactaggctcttcacatgctctcagaagccaggtccctgcagggatccgtgcccgcagcatatgtggaagtaaaagatggggtgagacacagatgtagggcttcccctttcctactgctccagcaactgccccacaggcttgttctctgtcatggggtggcttcttcctgttctcccaccacaggcgagcacaaactctggaatgttccaaatgtaagggctgtggtcagtgaacattataaaccattcctcttcctagaatcaaagaaatccaccttaagggatggtgtagttatgcagatgtagttttatgatatagacagccccatccgctcccctcatcacagatcacagaacttggccatggggatgttaggctctaagcatggtagggaatcatcgtggctgtcagtaccttgacatctttatttgcctggggggggggtatgcttcagtctttgatacgctttgactctgctttacttcacccctcaatctcggtgacagcacttggagcagaaccccatttaagacaagttgaaaaggaagagccattccgtgtaacgtagcagcttctgtgtcttatggccagggccaagggcattgaaacgtattgatgagagtaaaaataacaagcaggaaagcatctgccggccttcccagtacctggttaatgaactcttgttattctaatccacgcagcctcggtcttcaaagtccagatgactgtgtggcatcggctgcgtggccacgtgtgtttcagtgtcccacagtgctttcatggactcaaatttagtgccttgcgtctaccagtccatttcattatttccgtggctttcacaggtttttgtttttttccccaagacttttattgtttggtttggcggttacagtggagtaaagaggaagaacaatgatggaaaaacaaacgtgtgaagtgactgcttggcgagcaggcagcaggctctgcatacgcccttgctctgggctaagtgctctcgtaaatgctgtcctctaggagcctctggttaggtaaggctattggaggaaaacagtgtaaaattaaaatgccagggcaggtgctagaaatggatttcatgtggaatgtcaagagcagaagacctttgtgatgagctgctgtagatccaggctccatgatggatgtggcagtggagatgtgctggtttcaggttaggtgaccttgtctggcttatttatgattattattaagagaaacggtggctgtcagacatggtcagcataaatcaaaagcaacttctttaagagaagctataaaactcctccaaggaaattcctaactagatggctagagtttacaattatgagaggtgtttggaaccagagaggagacatcttttgtctgagatggcttttgaatttggaatattttaatgcttatttccttagtaaaaatgaactagaattattgggaaaataaccttgacctctctgattccttggtagtacatgtaacagcagaaacgaccaaatatcaccgtggttccttcttgtcttctcattcttggaggtccatgttgctgaggagtgtgcagcattgggcttgttccaccggccatagcagggtgcagtgaattaagttagaaagcaggaggaggcttagaatcttgagctgtgtgacctttggggaataactgtcctctttgagcttcaattttctcatatgcaagtaaaacgagaagattgataggtaatagccatggtctctctgctgcccacatcatatgagactatgcagataatttaaataatgttatggtcatgtgatgtcttttccttagagcaatctgtagtcagtggggtttattttcagttgttcaacattgaccaggtatcttctgtgctcttagagcttggtgatagtttctggtgtgtgggtggaggtggaggcagccggcacaggggacaaggccactgtaagaagtttgtaatctaattggagagaaagggtgaaaagcgtggaatagagaacagtgaactgagtgcattcccagatgctgagtggggtagtgaaggcccaagtggagagagcatttagacaaagcaggatcctgcaaggcaaaggctgcagagaaatgtcgggattgagcttggtccgggagggtgcttacatcgggacaggcagagagggcgcagggcatcgaggctgaggcagggatgggactgcaaactcccagcggcaagagcctggcctgtgggcgacacagcgagattaactcaaggagggaccgtcccagcaagcagagcaagacgctagcaaacgcaagccacagtcacacccggaacaaacacaagccacagtcacacctggaacatctgggagctacaagaacagtacacattattctatattctacatagttctaaaagaatatcagtatattattgtagttggcaatggggagtcattacaggctcttgaccaacaacgtgataaggtgagagaaatgatgttgcttttattgatggattttcattgcttcatccacagctccttgccagcccctctatggtcagcaagatgaaattgtgtatagcccagagccaagaatgagcccaggagggaagggaatgtctgtcctggccagtgcacatatcagcagctgaggatgtcaatctgtgatacacagttgatgccataattacaccagctgagcccctaccctgagcccccagtcctcgcgctcccccgtcccctatcatccattatatgttatgtcaatcctattttcttcctccagtctcttaacatttcaccctcatcctggtgtgttacttccttggattctttcccttgctttccttttcttggactggatggggaagtctgacagttagatgagcaccttggtctgaattaaattcattcccaccacagggaggctcagcaccagaaaagccctggagtgagggagggtctgcctgaagagaagcccctcagggaagcatggaggttctggaatgctccagaccttggcccgcctggacatgagcaaggcctgttctgcgctcgacccagcctgcttggtgcccagcactgggctggtgcaggttactgttggatattattggttgattcattgatgggctggttgcttggttggcggcacagtcctgaaagtttactcatgtttattttctgtgtatttctcatatcttttcctgctggtgctaagtgctttaagtgttgagtctagtctgctactttgtcattctaagcgccagaccctgtgcctttctcttggtgctgagtcaacattactgactgatgggcctgtcttgtgagttgtgacttgcacctgtagtgaattgagctcccaggctaccaggttcagttcccagggcgctgcacaaaaacttgtgactaattgctcctcaccgagggcaccatggtttgctctgccaacctctcctattcgtttggttctcaggcacatcctggttttgttttaataaattcaagcagcacagtgatcactggcttaatgaaaaccagaggaaggcaagccgcttgctgtcagacttcagatttccagaatgtttctaagcgaaccaacctagagccagttgagaataggttcagaatgagagcctttttgaatacacagttgggggaaaaggaggagagtcattgattctctcagacaccaaggaagctccttagaatagaaccccaaagagagtaggtggcgctgatgctgtgagatgacactgtggtcctaggtgcggggttcggaatcgcagagaacacgggaggaagcccaggctcggcatcgaggagagctttgtggccctggagaacctgcctctttctcatccccagcacgggagcacttgccttttcagctaaaacatgacagcaggccacacagccagcatcgttcttcatcatggagctggccccttcctggtcaacaaaatcacatggattgattcacattctctttctctctctgctctgatatctacagttcctttcaacattagtgcctcgtgcttttttgactgtcttcctagtgcctactctttgaatcagaatgcagacagtgggcgatggagcgaaagccatgctggagggctctcaggagcaggagtttgggaatgggcagaagcatattccccagggggagctgagagggctcagcactcagaacacccatgtttcccaacacttaacctcagcagcagcatctgcagactcgtgtggggacttctgtctggactcagggatgttaagagtagaaggcccaatgtcagcttctcacgtgggctgtcagcaccgcagatgataccggaagatggactgtgatgggccagcgacccctctgactgcacgcagctgtcagccaggcctggaacaggaggggcgagggggtgggctcagcctctgttagtgggagaggtcctggttggaagtttcactgaagtatcagtgttgactttctcaggtcaaatctgggccatttcatgcggtaaatccatgtcggcaggtatcagcccaagtgttttgaacatgctgcacttgtacatgcctggaccaaatgccaggctgatgagcagggaggggttgaaaagcagaagggagcccaacccaccggcgtcagcaggaggctggccctggctgtggctccccgatcagacaggcggcgtccaatggggcaccacacgactcccgccagggtggggcttcccctgtacctttcttagagctgatggtcccctgaccccactcgcagcctggaaggaggggatccctggcagagaccgggcttggcagaaaactgggcatctgcttgagaggtggaaatgctggagcatgcagaaaatctaagaacccttatttatatggggccccagaccaggaccctcgggtcagtctttctttgcccagggatggcatagcagtaacatcgcttcctgtgccctttccagtaatgtgagggcaccatctccgcccctgaactcccttcaggccacttcactccatttcctcagcctgaccacattacccctgccccagtacttggcttccctcaccatcacctaagtgaagctcacatgcacctctggagggagacaggcgcggggagagggagcctcagctggaggtgcaggaactgagtatcaatccattcacgggattgaggttctggtacccaaattcagaattttacgaaaatccaagacacttgttcattcgtgtgcaggaaaaaggtattcctagcccccaaaccacacctaacctgacagtgggcactcacttcaccttgagagggatcgatgtggtgaggaagttcaaggttgctagatggcatggaaaggaggcaatgggaaggaagtagatacccgccaggatatttctgtgaagctgttgtagcccagtgaaatgtcactctccaggtgtttttaccttctctactcccagctcacacggtgccctggcacgggtattggcaggactctccaggtgtttttaccttctctactcccagctcacacggtgccctggcacgggtattggcaggactctccaggcgtttttaccttctctactcccagctcacacggtgccctggcacgggtattggcaggactctccaggtgtttttctctactcccatctcacacggtgccctggcacgggtattggcaggagatggagggtggctcttatccaagacattttcccatctgatcatatcccatccgcggtagccaggctccaagatggcccccatggtctctgcctcctggtgttcacacccttgtgtagtcccctcccgtatttaccagagttggtctctgttgagtgaggtaaggcagagtgatggtatgtcactttcaaaagtaggttataaaagacactgcaccttctgtgctgggtgcccctcttgctttcttgggtcattccctctgggggatgccagctgccatgtcataaatagtcctgtgtaggagaggcctgcatggcaatgaactaaagcctcctgccatgatgacatgagtgagcttagaaatggaagcttcaacctcagtcaagccttcagatgagtgcagccctagctgacagcttgcctgcgactccgagaggctctgagccagaaccacctggcaaaaattgctcccagattcccaacccacagggatatgtgagatcaatgtttgttgttttagccgctgggtttggggtttatttgttacacagcagccatttggaagctagagttgaggcacacagaagctaaacagtttgccaacaaacagtcagctagcttgatcagactgatttaaaagaaaaaaacccctctgatctggtcccttcccagggtaggtgtctcacgctaaggagacagacatttgctttattcccgtggtcgatgttacttagtttcgttagttggggcctgcactttgttggaaactaaatgcgattgtgtatgtgtctacacaagatcaaatctgggctctaaaaagtgaggttttggccgggcacagtggctcatgcctgtaatcccaacactttgggaggctgaggcaagtggatcatttgagatcaggcgttcgagaccagtctggccaacatcgtgaaaccctgtctctactaaaaatacaaaaaattagccgtgcgtggtagcgggcgcctgtagtcccagctacttgggaggctggggcaggagaattgattgaacccagcaggcagaggctgcagtgacctgagatcacaccactgcactccagcctgggcgacagagtgagactccctctcaaaaacagtgaggtttaatatgaagcaaaaggagctcggagcccagagttcactccatagagaaaattaacacagcagtgagtgccccttgttgtctcctggaggaggcatgcttcagctggcatctgctcatcaaaacgtcagtcccctgtaccatgcaagagtttagtctccattctgggagccatgtgcttcactaatacccagggtctcttctgctgtgaaagaaagaggatagatactgggagagaactagccgtcctcgtcacaacgtgtgaagtgtgtgaaatagtaccaggcacgtaaccagtgcatgtgagtgctactgctgctgttataagcaaataaacagtgttttctggaactcctgtaatgacatcaaatgctaggaccttttgacctatccatgctgaggatgccccctaggctgcgtgttttacaggtggaaactaggaggcggttctaaagattcctcagggagtttgctgagctaaagcccaagtgttggtttaggggagtagaggtggaggtgggtggtgggaagtgggagtgtttagccctacctcagatcctggggtgcttgtcatgacctcctctgttacatccacaaaatatttaaaagattgaaattcaggcttcagctgaatttcagggtgtagtggctcacacttgtaatcccagcacttcgggagattaaggtgggaggatcacttgaggccaggagtttgagaccagcctgggcaatatagcaagatgtcgtctctcaaaaaaaaacatttaattagctgggtgtggtggtgtgcacctgttatcccaactacttaggaggctgagacaagagaattgcttgagcccaggaattcaaggctgcagtgagctatggatcgcaccactgcactccagcctgggcaacagagcaagaccctgtctcaaaaaaacaacaaaaaaattgaaattcagaaagactaactctctgggcttatccccctcctcaggttctcagagacggaggcttatcccagcactatccctggacacctcttcccctgtgagaaaaccccccaacagcacaggcgtccgctgggtggatggccccttgcggagcagcccgaggggccttggggaaccctttgagattaaagtctatgaaatcgatgacgtggagcgcctgcagcggcgacgagggggtgccagcaaggtgaggcagcctccttcccaccccctgcctacgtggtggcagctccccaccaagcctgagcaggtgctaggcagggccctggggaagaaaactcagacccgggcttcccagcgggcttctggcatgggtggtgggaagggggcttctgtcccagcaaagggcctttggacagaggccttggagagagccccatgtttctcttcctgaaatgttttaagggcttcaaagccaggggtcgggggctggtgatcttgggggcttttctggctccttgaggctcccagtcttaaccaacctttgtccaacttgaacacccaccacctgctttctcaacttaagaatggcctgtcatagtccaaaaatggtctgtcatagtccaagaatggtctgtcatagtcctaccttgtgaggtgtctgaattgaggtctgtcaagggagaatttggtggggatgacccatgtccctcccacacgtctccaagcccagcctgttttccatcaacgatactcacaggtgctcctgtggtgtgggctgggtgtgagcagaagggccctttctcctctctgtctgtgtgctaggaggccatgtgcttcaatgcaaagctgaagattctggaacaccgccagcagaggatcgccgaggtccgcgcgaagtacgagtggctgatgaaggagctggaggcgaccaaacagtatctgatgctggatcccaacaagtggctcagtgaatgtaaggccggggtgccttcccacccttgtgactagtgggttcacctgctcaaccgggctggcgtgtagcccagggtgacagtgacacaggctgtgtcctcgtcctcagtcacaggatgcccatcaaatggaggaagttgcaccgagcgagcagccctactcccctggggatgggcgggaggggccgggacagcagaggggtggtgaatattgctcttgcaagattatttctacgtgtctcagtccaaagcacctgaaaatgagatttttccccctgcgtgtggcagaagatcacccagacatgaaggctgtattacaaatctcctaggccacaaaatcacactgcatatctagcctgaaatagacaagaatttatagagcccttaaaaaggtagagtgtacagtcctcgaaaagccacgcagagaacccagaaagcaaggaaaacatttttgagtggaaaaaaaaaaaaaaagacagccacagtgttatttccatttaatagaaagcccaggatgaccataaccatctaataacaattcaggacaattttgctctctttgaaaggtggattcaattgtcttgtcttattagttcctgaccattccatttagcacaaaataaaacttcagtctggtcccagctattacacggatataggagctaatgctggaagactcagtctgtggggtgaaatacattcctgccattcaagttccctctgcctccccttcccatccagccctcagcctccggcaggcctcctttgtacagcccctcccctgcactgccccaaccctcttccagtcttccccagccagtgtggagggcctacaggtggaggctggaagcttaggtttatgttccaaagcagctggttgaaaagatattggtgtgaaatggtcctgggtgaaggtgcggaagaaagtggcaggacttgtcagcctcccagctgtgccttccacatgtaactgcagtctcgcagcagctgcctctccacagggataaggtgataacaacatttccctaagtactcattggattcttgggacagtctgtggagcattctataatataatattaagttgcagcatttgccgctgtggccacaggcatacagacctgctttggctgctggctttctcacatactagctgtgggacctcaggtaagacacttaactctgagccttgacttccttagctgtaaaatgggaaaaataatggtgactacaccatagggcagttgtgaggtataaatcagttcccgttggtcctcttggtgcttactacactgcttggcccaggatgagagctcaggatctggtagtaattattactattatcccaaagttcaacaacaggagacatttcctggccaggcacggtggctcacgcctgtaatcccagcaccttgggaggccaaggtgggcagatcacttgagcccaggagttcaagaccagccttgacaacatggtgtgaaaccctgtctgtctctaccaaaaatacaaaaattagccgggcgtggtggcgggcacctgtaatctcagctactcaggaggctgaggttgcagtgagccagagattgcgccagaccctgtctcaaaaataaaaataaaaaacaggaggcatttccttcgtgtctgcttgcatgatgcactgaggagttggatcttctgttagaaatttgagcaaagaaagacatgaactagtcctgcgagggcctttcatcgaaggcgctaatggggagggcagacaggggcgagggcgctggttactgtctgcgcgtgacatgcgcacggggcgctgtgcttatccctccccgctgcggatacccttttccttgtttcaggaatccctggccacttcaagatcccaggggcctcctttcagtcagtcagttctctctccttcatttttgctattttcattaacattttattttcaagaactgtttatgcccaaggcagacttgacttgaaaattatcttcatcttacaaagtcagtcatatttttcccaggatgggaacaagctgaaacatcaatacatatgtgtttagatgcttccaggaaacaattgcttccttctagtctttgtacatgtcaaaaatcactgtgtttttgatgctgagaaagaaaatgaacagaaagctacatgaaaggggaaatatatattgtttcttgaagatgaattgaaaacagtaatgaaaaaaaggatcaatgagctgcctgctgactattccctgtgggcatgaggcaggggactggcatggaaagatccatttttagttctattatttcttcattctgatgccacttttaaggttgtccagtaatgtagtctgatgtggtcatagaatgatgtctccttttgcttttttgttttggtttttaaatattaaactggtattcagggccttcggtctccttccagctctagtcctggttaactgtgtcagcctcagtgagtcacgtcactgtccagctctcagggacctcatctgcagaaagaagacactctgcagacagcggccactctaagccccagtgtttccatagcacggcatcgttttcaaatcaagttcgtgttcattattatctcattttattcttcacagcaactcaaggcaggcagggcaggcagcgtaggagttactattctcacatgcctttaaagacactgtcagcagaggtggaggtcccagagctcgtctcttcagagcttgtctcgtgcctggggttccagggccatcccaccaccttggactgctgtccacgcctctcctcctcgtactgggagcctgctggacccctggacctgggccaggcagcccatccctctgcccggccacctctggacaaagcaggggacttgatgccagaggggttgatcccagatacctgctcttcaggcctggaatgatacagactttttactctgtgcaggcctgaacatcaggaaaggcatctgggttataatccagaaacgtcctttcatataaggaagcagaggtataaatgtcactcaactgagacccccaaaagggagggactctccccacctcaacttgaattatttacttgattgattgatagtgaatagtgtggtagcgtctctcaaatcctgggatccatcctggatcctccatggctggaggtagggggagctagaatgtcaccttattggtcagtagaatctcagaaaaaaccttaaggatctaaatactggtaaagagtgttcctttcaacccaaaagaggccgagaatcaggcaggagggaactctgcagtggcctaaggcaagcgaactagacctttagaccaaggggtagatgtgggggtggcagctccaggctgagccgtcgggagttgcttctcaccctgtttgctctgcgtctccatcaggctcttcctctcttgcagttgacttggagcaggtttgggagctggattccctggagtacctggaggcactggagtgtgtgacggagcgcctggagagccgtgtcaacttctgcaaggcccatctcatgatgatcacctgcttcgacatcacctccaggcgccggtagatgagccagacccttgtcctagtggtcccccgctccccaggacttcagagatgttgcacgcccctaggccctctgtgctggggcatcaaagacaatgaatgaggatgaaggttggtggcaagtctggagcgggcgttgagcggaaggcgagttttcttttgttttctgtaggaaaggtgcaaacgtcaaacaccgtggaaggagaaaaggatgggaagcccgaggggtgtccaagccctgtgagactgaaaaagcactttgaggaaccttaaagaccttgtttgtacataagaactgctagcaaaagagacctcactcttctcttgctttcgtgagaaaggaggggcgtggatgtaggattgctgtggaaagcgaacacaaaacaacccagaatgactgattaagtgccttgcaaatctttattattatccaaacatttatgttcatactttcttgtgtacagatggtgctagtcaagatgaaaacaacaaaacaaacaagaaaaacattttggaaatgtattcacagctctttttctcttggtgttttatcctatttctgacttgctgtttctaagtaagttgtgtttgtagagctatttcttaatcagtattgcttatgaataaatattacctgtcttttatggttattctggtgaggccactcaaacagagagacttccctcggcacgagccagtgtgtgtgtttccaaagtaggtttggagcagcaggtgacctcgatgccacatcccaacaagcagcgtggtcaggtagacccagaaggttgattgtggggcaggtgctttagagaacaggtgaggagacggcacctgcagcacaggggaggaggagtcctttgcgacctgggccctccctgctcctgggaggtgggccgtatgttctgtagaccgtttgcccccctcaagtcctccacacatgtggttccttgacccacaaatccacagtttgcgtggccctcaaaattcatattcatttttattccaaaaagtcttgaacgaaagctggaaccaattcaccagagccatatttctttctttagtattttctagtgttgtgttgtagattgattaaagtgggtttttccccagctgagagaccttctcaggcttgttcagagacttcaactgtattggattagaagaaggattcttgagactgtacatcttgtctgttgtccagagtacaaggatttcagctctcctgtgtcccaaagcctctatgccaagaagggacaggcttgtcctctcagtctttgctcctgcccaaaggcagagagagcttcccctccataactcacacgaccctggataggcagaacatagctgaagactatggatgtccaggtcttggctcccaacaactcaggacctcaaattcagatgttcctccctataacaattcccttaggaattatgatacccattttagtgattgatagaaacctggggtacagagtggtcaagggatttccctgataaaagctgtggtgctgatgatagtgcagcccagaatctaagagtccctgcagccttcgcatcgaggatggtacttaggcgtgtgcagagcacgcttcccttttgccctcaaatgcagcatatcttcatgagcctatttatttccaagctaggctgtctttattaaccaacaactcagccccagccactccccaagcggggaaaaaaacactacgtttcttggtcagtgtacctctggacactgcagcccacacagctggctgaactcggtaaatgggaaccgaagtcttgtgagcttcacatgacctgatcctttgttatcagaacagggttcaggtggccctgttggctcatgtgctttggaagccagctccctgggtcacgagtctggctttgcactttccataagagtctgcttctatgcaaaggtgcaaacaggagacatgcccaaatctgctggctgaacaggctaaactacagtgagaggctgctctggcatggctcgttcttccttctgtgtatctcccaagtctgacaagtgtgttgccctgggaagcaggacctccctgagctccttaaccttgaccccattctgcaggacagtcgcatgctctgggctcgcctctggcctcaaagcacttgtgtaagtgggcttgcttaacagtaatatccttggaggcttctggacccaaagggaagccaatccttcgagtttgccattgggctgctggttgctggtttcaaacatatagttcatgaaaagtctttaattggagattttcaaaggtgaatattctgtttttgttggaaagaaactcatctgatgagtcatcgatgagtttggctttcgcccctgccacatcctcccctgaggttccttccatgctgcactgccttcctttagccagtgacagagcctggtgcccttcctggactgaaaccgatggaatccttccgaggggagtggcattcggcttgcctcctgcctaaatctgcttttatccatttgtagcaactttatgctgtaacaaaaggcggaaggaaaccaagagttctcttagcaagtcagactccttcccaagatggcaatcacagaacacctcgcaggatctcgcaggccacggtgaaggagaatgctttatgttgatgttgtccattctctctctcttctctttgcttttttttgacctaaataagctgcaaacatgttaatttaccaatattgataaaccacatgaagaaatcaggcattttacgttatgatgtgcttgttcctgtctctgcctataaattgactgtattgatgatgaaggaaggagttccggctgaccattctgaagcagtcccagtcacgggaggatgccttacccagtggccagacatgatagttccaggtctccccttggttttggtgatagagaacccaaggaggcaagggggaatatcaacgaacccatttctatttcattacccacaagcgaaaggactagaaaaaaatatttgaaattaacatttagatgcataggtctaactccttgtgtgaacctgtcctcctcaccccctgctccaaatatgtgaggtggaagcattagcagcggagcaaaactaagatctaagaacgggcggtggtgctattgtgtccctgggagtcactccacgtcgcattgcacggtggtgctgaggagcgagagtttgctttatcatgggctttcagttcccacctgcgagctgcaaactttgatcttgttgtccttgaattcccctctacatcacgaggaagctgtctctttcatctcttccggatttggaatcagaacactctgcccgttgtttattcgccagttgccattcttaacatgggggagcattaagatgcaaatgcagagatgtgtcctgtcttgacaaaggtgggaacccctgagctggagaaggggctcctctcatgagaagctggggtaaacagccaggcatcgcagcgtggggaattagacaggcaggaatctggcctggtttgtcataaattagccttcaacttgaagtctattatgttcttataaggcggtagtgacttcagtccagccgcatctaccatccagggtggaggttcaaaaagtcttatacgcacctacaagtctcacgcttgctgctcagactttctgataaaatctcagagttctgtttgtattgaccaaaaatgcagttgtgcccacttgggtgtgtatctcatgtccttgtaaaccagccaccttctttggatagaaggcaaggctgacaaatctgcagatttgttcaatgcaaacacagccgtctatatcattggccactgctgattatattgagtgtttttaggttttttaggtttcttattccaaaaaggattttagactgtaaaatgactaaagatgagttaatttccaaactaaaaaaggaaggagtcctgcctgtactcattgttctttcctgctggactagtaacccattcttggagcacacacagagtccctcgcttctaaagacaatacgtcttaaaccctgaaaacttgccagtgagaaagaggttgaaagtcctgtttgctattagttgaggctaagccgtctgctgccactgtccctggggcctccatgctgccgccggggtatgtggcccagctgtccccccatgaaggacactcttcaatgccaccacacgggagtctgggcagggaggaaaggcacacagcccacttttctctgcaccaaatgaaacaaagctgggtgttcagtgtcactgatgcaagtaaatgggtctcaaattttggtgggggcagtgtttctttggattctgatacctctttttccacctccagaaagtatctgtcaacattggtgggtaacagcttataaagtgcatcacttagtaatcttcctgacaaaatgacacattttaaaattacaacctgttcattatttccatcataatgcaagcgtaattctaatccgggagaagatactgtcatttaagctcatcttctcaaaaaaattttttctgaaaattcctggaaactaatttatccctccctaaacaaacacattctgcttttgggtggccctacccagaacctgcagcaatgtcataacactggacacagtgcggcttggggcagtatcaagccttcattgcatacaaaccttaatctctaagcatagttgttcccaaggtccacacgtgtggaggcgagtactgaaataccacactcacacatctattccatgcgtacctagaaattaccttcaacactaaaaaaggttccttctttcattccctatcctgctaacagcccacattgtaatatttgatttatgaagaagttctaatttatttgtgaactcaggatgttgctttacagcattgctcgtgttctctcatttacttattatgcatcacggttggaaatgctatccacgtgccgtgcatcgaggtggagatttgctggatctgtctgtggctatttttttccatgtttttctcactcaagcaaagtctgttagtggaaacatgggctgggggatggggagaggacagataaagcaagagaatagggattagggtccaatcctcaatgcacagggcttagttcaaaatctaagctgtttctgtagtaagcagccaaatgggaaagatcccttcgttttgaatttgatgagaatgggcttggaaatccacgcccaccggcttgcacggaagaggactcagcctcttcctaatggttcaacattcaattcctgaggaaagtgctgatagtattagttccctacatttccctaagactcccatccaacccctagtgctactgaagagggtttgggaaagcaattggagttccttagcttggatatatatagtacctgtttttttcctctggaaaaaccaaagtactttagtgagtcttacaatcttaaggcattttgtcccctcactgggtcccgagaggcagggaggggctaggccttgagctaggagcaaggacatgggccgccaggcctggttgttactagctgtgcaaccttgggcgagcctcttcgctttgctgggcctcaggttcccgagtggaagactgggggtcagaacagctgcccttctgggagagcatcaagagaaagtggtataagtgatgggaagtgctttgaagaaattaaaggtctgtctaggagctgggggtaatcatttacagatgaagaaactgaagtctagtcattgactggcccgagttcacagagtggttttatagcaaaacagggacttgagtccagcttattggattcttcccatcagatcatattgcaccaggtatgtgtagacatgaacacataccattcctctaaggtgtgtgtacatacacggatgtgtgtgtacaggaggtacctgacatggtgaaaggccataggacagaaaacctgagttctaattccagctttgccagtcgtcccgtccgtgatatattccataggacagaaaacctgagttctaattccagctttgccagtcatcctgtccgtgatatattccataggacagaaaacctgagttctaattccagctttgccagtcgtcccgtccgtgatatattacctaactcctccagaactcagttttctaacctataaaatgaagacattgtgctagatgatctttgtggttccttcaagctctggatctctaattccatgattagtaatgtatgtatgtgtatataaatatgcttatctgtagaaatgggcccatttgaaaagtggagacaaggtctgcccaggtgcatttattgtgccagaaacagtgaattcctaaataagttcataaaatcttgttttacaattcaatggtagtgcttaatgttactgtctgaaatccactgtttaaccagatggaagactggggccattcaaaacattattagttcacaagtgtttgctgttaaaatgcttcaataaaactcatttgttaaagtcagaaattcaactcttctgtacttgggcaggtcccagcagccccttggcaggctagttttgtgcatgggcctttgcaagctatataaacgttaggtgttggcttgattatgataaatatgagcaggctccctggagaacagtccagaaaaaaagagttatagttctcacaaactggtgacatgaatccattaagctgtgtggcattttccagtgtaaagacattgtttgctggctacgatctctgactttttgtggcatatgaggtgtaaaatgttgtcaaaaaagaatctggtgtttaaaaaaaaatcaaactatggtggcattaaatgttcacttttattctacccagagttgtgaattcctctatccagcttctccttctgtacctcgggggaaagcaattcaagagctaggggtgggtgcttctcacggcagcaacaccttggcccaagtctagcccccaggcctctcaggacctcatgggatgaggcctgtctagtcgccctgtggagctggcccccaacaagttcagcagctcagccaggagtgagtagaggtgtcagctaagtcccagagtccctggacttgttctgcacacctgagagccagacgctggggaaagtgtggagaagcttgtgttgataatgggatattttctgttgccctccctcagtccagtgtttctggggcttacacaaaataagggaatttgcagtcactgtagattgctcgggcctggatgcatgggcctctgttacactggtgcttggtctcagttataactgggcacattcaggcaagaaggcaaaaacagatcagaactagaaaaaggtctctcagggtagccccttcccttgaggacagtctccctccactgcagacatttccctctgaacagtaatgagggactttcctagatgctggtgccacattcatccaatcaactgagtgctccacacccccaggagatagggcaggatggccactcaaagcaaatacatactcttcactcctggcaagatccctctctgagtccctgtctcctactgcaccacgcttgcctggacatgcacacctccaaggctccctgcttttcttctccccaaatcctagccaagaccttcttgggctccctttgggtaaaccgagcagaagccgtaagggttttctaaacataatgccttcaactagaagagaaggtagaggtggtgccaaactgatcattcccttggggaggagacgatggaaaggcagcctctattatagaattgtttctaatgccctcactcctcccaattaaagaccttctcagtgctctgctggcctgtcgtagcctataatacatcttgtcccaattcacatcagcacctctcgtctctgggaaggatatgtattgtgtggtcatcagaagtaacttttcattaggaaaaaaactatccaaatatacaatcttaggtggatctgtccctcaaaccattaaactatccaaactgttcttacttttattctttccatcctttttgatcctgtctctttgtctcagggaggacagtggccattctgcctaccttggcaccatgctgcatttggccagacgcccctgggactagaaggtcatagaaaagaaagcaaggtgatgtcattgtccagcaatggcagatcaggctatggctgcacctggatggagaaaatgcctccgcatctatgcaggacctgttgcagtgtctgatgcttccacttgtttttctagctgaaggtgttgtttctagaaaacccttataaatctacagagcacttggagtgtaaatgcattgacctgccagtggctgcagtgctcctaacacccatggatatctcttgttctataactccagtggctagaacagaacatggaacatagtgggtgctcaaccaatattagctgaatgaatgaatcaatcaattattcaactttgggggaagaggcaacaacaaaaacctgggcaggggcctgcagcatttcagagtcccgtgacaagtggaccaaaggtctgcatttgcaaacccctactgggattaatccctaattcccagtggagaaggagcaccaggcccacacaaggccagacccacgccctgggcttcttacgcacacagccttgacctccacagccacggagcagccttggctttcaggcctcctaaagcatgtttctaagagatgaaaaagagtcgtgttcaagctcgtggattccgtctcaacatgtataaaacaatcgtcgagcaaaccctcactgagcagcactcgcactgtcccagacaccgtgctggttgcagtgaatgaaacaggttccaggctcccagaactcagtgaggttggcgagccgggccggcacacagaaacgctgctacaaacacgcaaacgtgctcccctccatgcagggcaaaccctcctcaggggccccttttcctagaatttgggcccttgtccaggcctcacctccagaagagtctccttaagcaggaggctgagagggcagcgaggcggggagggaagggggacagccagtgtcactgcaagtcgctttatttctcctgcggaagtccagccctccctcactcccctactccccggcacttccagcttcctccccgcagcgggttaacacgtgcatttgccaagagctcaggaagggcgcgctgtgagcatccagccagctgaggaggaggggactgtcccctgggcagccaccccgctgccacctgaggaagctactttggggtccacctgcatgcacggtaagcagcacgtcctttctttttcattttaaaattgttacattgccccgctcagcccatcctctgtgctctcccctctccagcaggttctggggtgctgatacatattacacaccttttgtgtgctcagaagaaaaactcaaaaaaaagagctttatagaccacaaagatctacaaacccccaaagtccctgatggcccagtgagagaaaggccgctgctttttaaaactgcactttgaaaatatggaaattgaaaataaaaaattaccttcatctcaccccagagagaaccactgttatttaatagatacacacacacacacacacacacacacacacacacacacacacacacagaggcacgtgcgctattacaaattttggattatcctggatatggtccttttggaacccttttcccctttaataatcctaccatgtatatttgtttccccaattggcacatgtgctctgacaacatggcttttaacattgcagaatattccatcacatagatcgaccgactctcatttatgcacggctactattccctgctcttggaccataagattgcttccactttttcacaattatcagttacactgttgaacataaatcaacacatattgaatataaatcttttttgttaacctgacaagtccgtagggataaattcctggaagtaaaatagctataacaagaggaataaaagattacaaggcatgttacacacattgagggtggctgtgctttaaaccgtccaacctcaatgatgattagaagccttccctgatagccccagatggagtcatctcttcctctcttaacttttatttcattgattcacttatttattcattctacaaatatacattaaaaaactctggccaggcacggtagctcacgcctgtaatcccagcactttgagaggccgaggcggggggatcacttgaggtcaggagttctagaccagcctggccaacgtggtgaaaccccctctctacaaaaaatacaaaaattagctaggcatgatggcgcgtgccggtaatcccagctacttgggaggctgaggcacaaaaattgcttgaacccgggaggtggatattgcagtgagccgagattgcaccactgcactacaccctgggcaaagagcaagactaagtctcaaacaaacaaacaaacaaacaaaaaaaaaaaactccaacatgggacagtgttcctgttgtaagatgtgccaagttcttagtatacacttcatcatattttaaagtaggacgtgtttatctgtccttaaatattaggcatcaggctcacgcctgtaatcccggcactttgggaggccgaggtgggcagatcacaaggtcaggagattgagaccatcctggctaacacagtgaaaccccgtctctactaaaaatacaaaaacttagctgggtgtggtggcgggtgcctgtagtcccagctacttggaggctgagggaggagaatggcgtgaacccaggaggcggagcttgcagtgagccgagatcgcaccactgcactccagcctgggcgacagagcaagactctatctcaaaaaataaaaaataaaaaataaatttaaaaaaataggcatcaggagggtaggagctctttttatggctccctgtgtttaacacaatgctgggcacaaaatcaggttaagattcagagggtttcgacagccaaagctattgaagggaatggcattttatacacagtatagatatccatacactggaaacacttttctggggattctgacatccatctcagcccttgctgagaactcttagctgaggggccatgaagcctgggtgctcgtgtgaaactgcaacttgcagttgactttgagggagtctcagtgcgtctccaggctccatctcctcatctgtgtaagagaagtgaagcccaatctgtcctgcctagtttcccctgggtttgttctgaggatgaaagaagatgctgtgtgtagaaccaggtcataatctggtaagtgctcaacagacgtaaggtcctgggataacatacacttgttttgataattacaacaagattcctcaggcagcctttacttctttcctagactgtgcccgctacacagtttcttcattcagcacctgcctcattctctcatgttgttttttggagacagggtcttgctctgttgcccagactagagtgcagtggcacaatcatagctcactgcagtctcaaactcctgggctccagcgatcctcctgcctcagcctcacaggtagctgggactacaggcacgaaccaccacacctctctaattttttaaaaaaatttttggtagagatggggtcttgctatgttgcccaggctggtctcaaactcatggcctcaagcaatcatccctccttggcctcctgaaaggctggaaagccactgcatctagccctattcattttctttctttccgagacagagtctctctctgttgcccaggctggagtgcagtggcacaatcttggctcactgcagcctctgcctcctggattcaagtgattcttgtgcctcagcctcctgagtagctgggatttcaggcaaccatcaccatgcccagctaatttttatattttttgtagagatggggtttagccatgttggccagactggtcttaaactcctgacctcaggtgatccacccagctcctaaagtgctgggattacaggtgtgagccaccacgcctggccccattcttttaaaaatatcagtggcttccatctattagaagtaggttgggctatacatcacactatccctaaatcttactttcatgtggtttgtttaataattaattcccaataagtctcaggggagagttctgcaatatgtataaaactttggcaagatggcatattaggaacagctctggtctgcagctcccagcgagatcgacacagaaggcgggtgatttctgcatttccgactgagggaaattgatattagggctaatatcaagaatctacaaagaacttaaacaaaattacaagaaaaaaacaaacaactccatctactgccttgagtgggcagtaggcaagctgaggcctgggtttctaagtggtcgagaggaggctggagaccagcaggggtcagacgctgagacgagacagatttaaccctcatcacaattttgctcaagtcctggggttcctgccccaccagtttccttttcggaagcctgaaaacataaaccaggtttaccaacaccctcaattcgcaaccagccccttctctccggtggatgtgtttgggaagccaggcatagagaatattgccattgacctcctcctgctcctttccttgtcccgctttattagcatcacatgaatttgatgggtgtgttgccgaagccagaataagtagtttagacggtgagggcagcagcagctcagagaagggagcagctgaaaaacctcagggcttgtgcaccacctcttgaggccagccagccttgccctgtctccaggcagctgtgctcctaaaccgcgacaaatgactaagaaatttctgctcaggggagtcctgagggaaggaaggtgctctttccctgcaggtgcatttgacgtcactcaggcacagggggcccctcccagcagcctccagaagcagcctccagagcctgggtcggtgacagcccgtctagtatttaagcatgattcagccaccctccctactcccgtgtaaatccgtggatatgcacggaatccagcttcctctttctgcacatacacacatccttttggctatttctctggaggaccctgactaacacaggccaccgaccctccatcactgtgggcttcctgtttctgcagtaagcactccctttgggagagtccaatgagaaaaaaggaaagaacctcattaggtccctccacgtcaacactgactgtgttaaccctaattactgcacctgaattattcttttccagttgcaaagaaggaaatctctaaggtcttttttaaaacctacaaaacttctaaagaatggtaaaatgggaaggcttttttgcattggcaggagcataaataattcctgagggcatctgaactccaaccaggtcagcccagcccagcttccccaacatcccccttgccagggaagaggcagagaatagtaactcaagtttatagagactgtattgttgcctttgatcttcagcaccaccccattgaggtaagcattagctcatacctttggacaagggcaagtcagaaagtgagagggaaagtgagaaaggcatttggaaaaaacagggaggaggacttggtcattgcttcattcatgtattcattgcacaaatatttattggctaccacaatgtgtcagctgtggtgctggaagtggagagacaatagcaagtgagacagagaaggtccaaacctttacccaacggagtgtatagtccagcaaacatttcctgaaggcctgcacctggcaaggcactgctggcaaagcccaagagtacagcaacccagcttaaaggagggtgatccaactttgaaagctgccccttctgtgagcgccctcaatccctcaagcttattctgcctcactaatgattgctctcccttccatggtctattgtaccatctttctctccctattggcctgagagctcttccagggcaggaccactctccactcagcccaacacaatgtctggcgcacggttcttcaggcacattcatccaatgatgacctgcaatgagccgagcatggtgtcagcagctgaagcaacagagagggaagaaacccaggccccttcctccagggatgtggagtctagtgggggagaaagataaagaaagaagcaactattttgatgtgataaatttcctggggaatgactaagtgccaagctgtgcagaagaagaaatgctggctgggcctggtggttcacacttgtaatcccagcactttgggaagccaaggtgggaggattgatggaggccaggagtttgagatcagcctgagcaacagagcaagactccatctctacacaaaattttaaaaattagccagctgtggtggcacacaactgtagtcccagcaacttgggaggctgatatgggaggattgcttgagccccggagttcctggctgcagaatggccactgccctccagcctgggcaacacagtgagacctagtctcaaaaaaaaaaaaaaaaaaaaaaaaaaaagccaaaaaggagagaggagggaggagagaaaagaggagggaggaaggggaggtcaaggaaggaggaggaggaacatagctgtaatgggaagatagggaggaaaaaggaggatggaagacatgctcagatatgtcttcatggctagatggtaagttctgactgggcagagacaatgtctgtttccttagtacctagcaaagggtcttgcactgggtagatattcactgtattttcagtggggaatgaattcccataatagggaatctgaagcccttaaagaaaaccagaatagcaaagaatagaataatgtttactcttttatattgattagaaatgcatactccacatatagaaagtacaaactcaacagagtaaaatctcagagaatggtttttacacatatttgcagtgtgatcagtcaatgttcctgaaagctaataagaatccagtaaccatttaatattaaatgtatggagaagctacctaaatcctagggtcatgttgcttgtcacttgagagaacaccattttcttgtctaactcttatttttattcacattcatgatcatacatgcatgtgcagccacacgaacatcaacatcaatatctggtttctagagtagattctcaaaaggtaggaaaacctgccttgatagcatcttataaaactcagcacattaccacacacagatgcattccaattgtgaaatctctcaggacgaaaagtattctatgggtgatgctgtttttcttttttttcccaggttttgcttattaatgacccagccaggctttctcacattgtcttgtgctagaggcattgactcctcacatcggaaaagtaaaatgcctagaaatgcctaaaggagaaataaaacaaagtggttgatgcttagaaagaaaagtcatccaattcactcacagtgggtcatgctgcttaactcagccacaaggaaatcccaattcatgcaaaaataattctgtcttcattattctacaatccagtgggtgtctatgataatttgagtactcctttcttgaaaagagaagatcagcacgtgtgtctttaacaatacattcctcttggtcttgctgaaatgctgcattagtgactgcatctgattgcactggaacctggctcaggccccctactgatgctcttacaggccattattaatgcgtaccccttcaggggctgtaatttgggactcaatttgccataaaattgtcctaagtgtcaccttagtaatcggagatcacatgacccatgaaacacattgagatgaaagatggcacctcttggaaatgaatgtcaaattttcccccatagtaaaaaggcactagccattgtatttgcagtggatttcactgtgccttgagatggggaggggttacaatgttccctgtgcacatgccttgagctgggcctgctaggcctcagaccagagccttcacctaccacataccctgaagactcaacacacagactctagtaattcagccatccctcaggtggattttgatggtgcttatctttttaaccaaaaatccatatgttttctaacaaaggagttttatcctaattccagatacaaaaagtaggttagatgtcaagtctggcaaaacaaaaggtagtttgattaatcattagggaaatgccaatcaaaaccacaatgagacacaatttcacacctatcaggatggctatttccaaaacaaacaaacaaacaaacaaacaaacacaaaacagaaaatcacaacggttgacaaggatgtggagaacctggaagccttgcacgtggctagtgggaaggtaaaatggtgcagctggcgtagaaaaacagtatggcagctcctcaaaaaaaggaaacccaggatcactattaacatgtgatccagcaacttcacctctgagtacacaacccaaagaaccgaaggcagggacttgaatagatacctgtgtatcagtgttcatagcaacactattcacaatagccaaatgacagtaataatgatctacatgtctactggcagatgaatggataaacaaaagcggatacagacataccatagagtgtcattgagtcttagaaaggaatgaaattctgacacatgctgaacatttgcccatggatgaaccctgaagacatgatgctaagtgaaatcaaccagacagagagagacaaataacgtgtgattccacttatacaagatgcggagagtagtcaaattcacagagacagaaagtggagtggtggttcccacggtggagcaggggtcattgttcaatagtatatagtttcagtttgggaagatgaaaacatctgaaaaatggatggtggtgacggctgaagaacaatgcgaatgtacttaatgccactgagctttctattttaaaatggttagaatggtaaagcatacattatgtaccttttataacaaaatgttttaaggtagattggttgtcaaaatactagaatttcacatttcaatggacgaaagccaaaacgaatgcaatgtgggactgccctggaaaactccaggcatttggacggccatcttgaaactgtgctgtagataaggtagatcaagaccaggaagccctggggagaaggtggcagggatatagagctggagagaaggggaactgtctgcctctttccttcagaaaagcctgcggtgacaacttgttcacctctagccttactgctcgggctgcagaggacgccggcaccagcacctttgtccatctcaagggctctgttggaaacttgagtcaaatcaactaccttgcagccttaatctatagtagttatttttgttgttccttctgttcctggtgacacttggttctgaatttagtctagcagaatgagagggcctgcacaggggccctgctataagttaccttcactcacaaaatgcgggcatccccacccctagttacaacacacatgtagcaacatgtcttcgtatgttctaaagcagaggaaagagccaatggaacttataagctgtagcttataaagcactcttagatgattctaccattttttaaaaaaaattaccatgatttatctggtcatctagaggggccagacacagtatgattatgatgctcttatgaacttcagagcactcctagaggccacttttaatgaagtacaagcctcctgactggagattaagtcaatatcctttatcacactattgaaagcactgaatattttggtatcgactctcactactctatttcaaaagaggctgaagaagctgaaaagctgagcagcacttctcagtttcaagaaactaggaggcaaaaactggagtctaggactcatcaatgagggcctaataattccctccattttggggctgagatctcaaagaactgtaccctaggactaagggtgatggaagtcgactaaaactcagcaacaaattatctcaattcatgaagtggaattaaggtgatcaagactgctagtctgggggaggggtggagcaaaatggctgactacaaggctccactgattgtccccacagcaggaatgccaaattcaacagctatccacataaagacagcatctttataaaaccaacaatcaggtgagcactcacagtccctggttttaattctatcactgaaagaggcaccaaggaaggtagcaaggagagtcctgaattgccagtgccccacttcctccatcgcccaacagcggccatgtggcacagagcaagaacctgtgcactcaggagagacagcacagtgattatgagactttacactgaactcagcactgccctgtcacagtagaaagcaaaaccagactgaactcaactgatgaacgcccagggagggagcattcagatgggcccaagctggaggggaaccgctgtccccgtggggggaatctgagttccagcaagcctcaccaccatgggctaaagtgctctggggccataaataaacctaaaaggcagtctataccacaaggactgtaactcttaggcaagtcctagtgctgagctgggctcgaagccagtgggcttggggagcatgcgacctactgagacaccacccaacacagctaaaggagtgtttgcaccagtccttccccaaccccaggcagcacagctcttggctccaaaagagatccctccattctgcttgaggagaggggagggaagagtaaagagtaaagagaactttgtcttacatcttgggtaccagctcacccaaagtaggatagggcactagtcagagttgtgaagtccccatttcaggtccttcctcctggatgacatttccagacacacccagggccaaaagggaacccactgctttgaaaggaaggacccagtgctatcaggatccatcacctgctggctaaagagctcctgggtcctgaataaccagcagcaatatccaagtaatatccaggtggtggtagccatgggctgcctgtggaaacgggacgaaagagtgggaagagctgggactcatggtttgagtgccagctcagctgcagtagaatagaacaccaggtatatttctaaggattttggttccagtacgtggctcctggacagcacctctggacctgcccagggcctaagggaacccaatgccctgaagagaaggacacatgcctggttggcttcaccacctgcttactgtaaagccccagggcctcgagcaaatataggccatagccaggtagtgcttctagcaggccttgggtgaaactcactactgtgctggcttcaggtctgaccagtgcagccccagtgatagtggccacaggggagcttgtgtcacctcacacccaactccaggtagctcagcacagagagagagactatgtttgtttgggagaaagtaagggaagagaacaagaatctttgcttggtatccagagaacgcttgcagatcttatccaagaccacaaaggtggtacctctatgagtctgcaagaaccacagtgttaccaggcttggggtgccttgtaatacaaacatgacttagataacacacccaagtcctttcaaatacctcaaaagccttcccaagaagaacaggcacaaacagcccagattgcaaagactataagtacctaactcttcaatgcccagacaccaaagaacatccacaagcatcaaaaccattcaggaaaatgtggcctcaccaaatgaactaaatcaggcatcagggaacaatcccagagaaacagagatatgcaacttttcagacagagaattcaaaacagccattttgaggaaactctgagaaattcaagataacacagaaatggaattcagaattctatcacataaattgaacaaagagattaaaataattaaaaagaatcaagcagaaattctggagctgaaattgcaaatgacatactgaagaatgcatccgttattggccttaaagaggaggtagagaaggagatagggatagaaagtttattcaaagggttaacagagaacacctcaaacccagaagatatcaatatctaagtaaaagaaggctacagaacaccaagcagatttaactcaaagaagactacctcgaagcatttaaaaatcaaactcccaaaggtcaacaataaagaaaagatcctaaaagcagcaaaataaaagaaacaaataacccattggagtttcaatatagctagcagccgacttctcagtggagaactgatagtcgagaagagcatatttaaagtgctgaaggaaaaaaacttttaccctagaatagaatatctatcgaaaatatccttcatacatgaaggaagaatactttctcagataaacaaaggctgagggatttcaacaaagactagaactgtcctacaagaaatgttaaaggaagtatttcaatcagaaagaaaaggatgttaatgagcaataagaaatcatctgaaaatacaaaacttactggtaatagtaagcacacagaaaaacacagaatattaaacattgtaactctggcttgtaaactactcttaccttgagtagaaaagactaaaagatgaactaataaaaaataataactacaactattcaagacatagacaatacaataatacatacatttaaaagttaaaaatatataaatttaatatataaatttaaaaagttaaaaaacacgggatgaaattaaagtgtagttaacctaaccattattaggattttttgcttctttgtttatgcaagcagtcttaaaataatgggtaatagatattatttgtaagcctaatggtaacctcaaatcaaaaaacatacaatggatatgccaaaaataaaaagcaagaaattaaatcctaccaccagagaaaatcactttcactaaaagaaagacaggaaggaaggaaataagaaggagaagaccacaaaataaccattgcattgggcctgcctgggtggtccgtgcaacccaagagagtgaggaaaagcagggtggggcaacagcccacccttgagcggggtggaaccaggtgagccctcaccccaggcaagaaaggtggtgagtgattgtacaacgcccccccaggaagccatgcttttcccatggatctttgcaacccgcagatcaggagatccccttgtgcacccagcaaggccttggttcccaagcacagagctgtgtgaactctcgcagctgcttggccatgcacaaagacccaggagtttcttgcatactccaccccgggaattccagtgagacaggagatcttccaagctttcccctaggaagggggctaaagccaggacactaagcagcgtcatcctgcaggccccactcccatagcacctcacgagttaaaacccactgacttggaattctagccagcctgtgggagcaggctggagattgccggagatgaccaagttcccagggggaggggcagccgccatctacatggctcaagtcagccattttggcctgccaactccaggagtctgcaaggtccagaccaaaaggaattcagcgccatgccgcgcagccagctgctgtggtagatcgcggccaggctgcttctttaagtgggaccctgacccatccctcctcactgggtggggcctccctgtgggaatttcataactccgatctctccctgggatggagccactgtggggaggggcggccaccgtatctatggttcagcctgctggctctggaaagtccaggtgatctggaaaagaggggctcctcccactgcagcacacctgctctgccaaggggcagccagactgcttctttaaatgggtcccattcctcctgactgggtaagacctcccaataggggtctccagacaccttctagaggagcatttgggccagcatcaggtcgggacccctgggatggagctcccagaggaaggagcaggctgtcatatttgctgttttgcagccttcactggtgatacctctaggtgcaggagggtccaaggcaactagggtctggagtggacctccagcaaaccacagtagccctacaaaaaggggcctattaaaagaaaaacaaacagaaagaaaaacaacaacagcacagaccccataaaaacccattaaaacgttagcaaacccaaagatcaaaagtagataagtccacaaagatgagaaagaatcaacacaaagatgttaaaaactcaaaaagccagagtgtttcttctccttcaaatgatggcagcatctgtccagccaggccacagaactgggctgagactgagatggatacattgccagaagcaggcttcagaaggtgggtaatagcaaacttcactgagccaaaggaccgtgttctaacccagtgcgaaacagagaagaatcatgataaaacattacaggagctgataaccagaataaccagtttagggaagaacagaaatgacctgatgcagctgaaaaccacaacacaagaacttcacaataatgcaatcacaagtatcaacagccaaacagaccaagcgggagaagaatctcagagcttgaaaactatctggctgaattaagataaacaaacaagaatagaggaaaaaaaaaaggaacaaacaaaacctccgagaaatgtgggattatgtaaaaagaccgaacctatgactaattggggtagctgaaagagatggggaaaatgaaaccaagttggaaaacatacttcaggatatcatccagaacttccccaacctagaaagacaggccaacattcaaattcaggaaatgcagagaaccccagtaagacattccatgagaagatcaaccctaagacacataatcatcagattctccaaggttgaaatgaaagacaaaatgttaagggcagccagagataaagaccaggtcacttacaaatggaagcccatcagactcatagcagacctcttagtggaaaccccacaagccagagatttgggggcaatattcaacattcttaaagaatttccaacccagaatttcataactggacaaactaagcttcataaccaaaggagaaagaagatccttttcagataagcaaacgctgagagaattcaacaccaccagggtgccttgcaagagttcctgaaggaagcactgaatatggaaagaaaaaccattatcagccactacaaaaatacactaaagtacacagaccagtgacactacgaagcagctatataaacaagtctgcaaaaataaccagctagcatcatgatgacaggatcaaattcacacataacagtattaaccttaaatgtaaacaggctaaatgccccaattaaaagacacagaatggcaagctggataaagaatcaagccctatcagtgtgccgtattcaagagatacatctcatatgcaaagacacacacacgctcaaaataaagggatgaaggaaattttaccaagcaaatggaaaacaggaaaaagcagggagagcaaatctggttccagcaaaacagagattaaaccaacaaaaaatcaaaaaagacaaagaaggccgggcacagtggcttatgtctgtaaccctagcactttgggaggccaaggctggtgggtaacttgaaatcaggagtgtgagatcatcctggccaacgtggcaaaagcccgtctgtaataaaaatacaaaaattagcagggcgtggcagtgcacacctgtaatcccagctacttgggaggctgaggcacaagaattgcttgaacccaggaggtaaagactgcagtgaggcaagatcgcaccactgaactccagcctgggtggcaaagactctgtctcaaaaaacaaacaaaccaacaaacaaacaaaaaacaaagaagggcattacatgatggtaaagggttcaattcaccaagaagagctaactatcctaaatacatatgcacccaatatatatatatgcatctaatacaagagcacccaaattcataaagccagttcttagagacctaccaagagacttagactcccacacaataacagtgggagactttaacaccccactgtcaatattagacagatcaatgagacagaaaattaacaaagctattcaggacctgcactcagctctgggtcaagtgtacctgatagatatctacagaactctccacccaaaaacagcagcatatacattcttctcattgccacgtggctcttgctccaaaatcatcacataattggaagtaaaacactcctcggcaaacacaaaataactgaaatcttaacaaacaatctctcagaccacagcacaatcaaattagaactcaagattaagaaactcacccacaaccacacaaatacatggaaattgaacaacctgctcttgaatggcccctgggtaaacaatgaaattaaggcagaaatcaagaagttctttgaagctaatgagaacaaagagacaacataccagaatctctgagatgcagctaaagcagtgctaagagggaaatttatggcactaaatgccctcaaaaagctagaaagatttcaaatacacaacctaacatcacaacgaaaagaactagagaaccaagagcaaacaaaccccaaagcaggcagaagacaagaaataaccaagatcagaagggaactgaaggagatagagacacacacacaaaaaaaacttcaaaaaaaatcaatgaatctgagttggttttttgaaaaaaataaaatagaccactagctagactaataaagaagaaaagagagacgaaccaaatagatacagtcagaaaggataagggggatatcaccactgatcccacagaaatacaaacaaccatcagagaatactataaatacctatatatacataaactagaaaatctaggagaaatggataaattcctggacacatataccctcccaagactgaaccagaaagaaattgaatccctgaatagaccaacagtgagttctaaaattgaggcagtaataaatagcctaccaaccaaaactagcccaggaccatacagatttatagctgaattctacgagaggtacaaagaggagctggtaccatttctactgaaactattccaaacaattgaaaaggagggactcctccctaactcattttatgaggccagcatcattctaataccaaaacctggcagaggtccaaaaaaaaaaaaaaaaaaaaaaaagaaaacttcaggctgggtgtagtggctcacacctgtaatcccagcactttgggaggctgaggcgggtggatcacctgaggtcaggagttcgagatcactctggccaacaagtgaaaccccatctctactaaaactacaaaaaattagctgggcatggaggtaggcacctgtaatcccagctactgggaaggctgaggcaggagaatcgcttgaacccaggaggcagaggttgcagtgagctgagattgtgccattgcactccagcctgggcaacgagagcaaaactctgtcacaaaaaaaaaaaaaaaaaaaagaaaaagaaagaaagaaagaagaaagaaaagaaaaaagaaaacgtcaggtcgctatccctgatgaacatcaatgcaaaaatcctcaataaaatactggcaaaccaaatccagcagcacatcaaaaagtttatccaccacagtcaagtaggcttcatctctgtgatgcaaggttggttcaacacacacaaatcagtaaatgtaattcatcacacaaacagaactaaaaacaaaaaccacatggttatctcaatagatgcagacaaggcctttgacaaaagtaaacatcgcttcatgttaaaaactctcaataactaagtattgaaggaacatacttcaaaataataagagccatatatgacaaacccacagccaatgtcatactaaatgggcaaaagctggaagcattctccttgaaaatcagcacaagacaggatgccctctctcaactactcctattcaacatagtattggaagttctggccagagcaatcagacaagagaaaaaaataaaaggtattcaagaaggaagagaggaagtcagatagtctttgtttgcagatggcatgatcctatatctagaaaaccccactgtctcagcctaaaagtttcttaagctgataagcaacttcagcaaattctcaggatacaaaatcaatgtgcaaaaatcacacgcactcctatacaccaacaacaggcatgcagagaaccaactcatgaatgaactcccattcacaattgctacaaacagaataaaatgcctggcaatacagttaacaagggaagtgaaggaactcttcaaggagaactacaaaccactgctcagggaaatcagaaactacataaacaaatggaaaaacattccatgctcatggataggaagaatcagtatcatgaaaatgaccatactgcccaaagtaatttacagattcagtgctattcccattaaactaccactgatattcttcacagaattagaaaactatgttaacattcatatggaactaaaaaagagcctgtatagccaagacaatcctaagcgaaaagaacaaagctggaggcatcacactacccaacttcaaactatactacaaggctacagtaatcaaaacagcatggtactagtaaaaaacagacacatagaccaatgaaacagaatagagaattcagaaataagaccgttcacctacaaccatctgatctttgataaacctgacaaaaattaactcaagatgtattaaagacttaaatgtaaaacctcaaacaataaaaaccctagaagagtatctaggcaataccattcaggacataggcacaggcaaagatttcatgacaaaaacaccaaaagcaattgcaacagaagcaaaaattgacaaataggacctaattaaactaaagagcttctgcacagcaaaagaaactatcatcagagtgaacagacaacttacagaaagggagaaaatttttgcaatctagccatctgacaaaggtctacaaggaatttaagagtctaaaaggtcttaaacaagtcttaaaagtctacaaggaacttaaacaaatttacaagaaaaaaccaaaaaacccctttaaaaagtgggcaaaggatatgaacagacacttctcaaaagaagacattcatgcagccaacaaacatatgaaaaaaagctcagcgtcagtgatcattagagaaatgcaaatcaaaacaacaatgagatactagttcatgtcagtcagaatggcaagtattaaaaagtcaagaaacaacagaggctggcaagcatgtgaagagaaaggaatacttttacactgttggtgggaacgtaaattagtttaaccattgtggaaaatactgtggcaactcctcagagatccagaagcagaaataccatttgacccagcaatcccaatactgggtatatgcccaaaggaatagaaatcattctgtcataaagatatatgcacatgtatgttcattgcagcactattcacaatagtaaggacatggaatcaacccaaatgcccattaacaatagaccagacaaggaaaatatggtacatatatgccatggaatactatctaaccataaaaaggaatgagatcatgtcctttgcagggccatgggtggagctggaagtcattatccctcagcaaactaacacaggaatagaaaaccaaacattgcatgttctcacttataagtgggaactgaataatgagaacacacggacacatggtgggggagaacaacacactttgggacctgttgaggggttagggggagggagagcatcaggaagaataactaatgaatgctgagcttaatacctaggtgatgggttgatctgtgcagcaaaccatgatggcacacgtttacccatgtaacaaacctgcacatactgcacacgtaccccagaacttaaaacaaatgttgatgaaaaaaaaatgacagaatggctgaattgattaaaaaaagacccaatgttctgttgcctaccagaaacacacttcgcctgtaaagacacatacagatagaaaataaagggatggataaagatattctatgcggatggaaaccaaaaagggacatgagtagctatacttacatcagacaaaacagatttcaagtcaaaaactacaaagagagataaagaagatcattatataatgattaaaggatcaatttggcaagagaatataacgactgtaaatattacatgcacccaacattggagcacacagatatatacagcaaatatcactagagctacagggagagagatagaccctaatacaataatacatggagacttcagtacctcacttttagcattggacagatcttcctgacagaaaatcaacaaagaaatatcagacttaatctgcactacagaccacatgaacctcaaagatatttgaagactatttcatccaatggctgcagaactcacattcttttcctcagcacgtggatcattcttaaagacagaccacatgttagatcgccaagccagtcttaaaacattccaaaaagctgaacaaatatcaagtatcttctttgaccacaataaactagaaatcaataacaagaggaattttggaaactacacaaacacatggaaattaaacaatatgctcctgaatgatcagtgggtaaatggagaaactaagaaggaaattgaaaaatttcttgaaacaaataaaaatggaaacacaacatactaaaacctatgggatacagtgaaagcagtactaagagggaaatttatagctataagtgcctatgtcaaaaaagaagaaaaacttcaaataaacgacataacaatgtatcttaaataaacaacataacaacgtatcttaaataacttggctttggtttgcttttgcaaaattagtagaaaaaaaagaaagattagagcagaaataaataaaactgaaataaagaaaatacaaaagatcagtgagacaaaaagctggttatttgaaaagataaacaaaatgacaaacctttagccagactaaagaaaaaagggagaagatccaaataaataaaatcagacatgaaaacagagacattacaaccaataccacagaaattcaaaggataattggtggctcctataagaaactatatgcaaataaattggaaaatctagaagacatgaataaattcctagccacataaaacctaccaagattgaactgtgaagaaatcccaaacctgaacagaccaataacaagtaatgacattgaagctgtaataaatagtctcccacaaagaaaagcccaggacccaatggctgaactgctcaattttaccaaacacttaaagaactaatatcaatcttactcaagctgattcaaaaaaggtgaaggagggaatacttccaaattcattctacaaagccaatattaccctcatactgaaaccaaagacacatcaaaaaaaagaaaactacaggccaatatcactgatgaatattgatgtaaaaatccttagcaaaatactagcaaaccaaattcaacaatacattaaaaagatcattcatcattaacaagtgagatttattcctgggatgcaaggatggttcaacacatgcaaatcgatcaatgtgatacatcatatcaacagaatgaagcacaaaaatcatatgattatttcaattgatgctgaaaaagcatctgataaaattcaacatcccttcaggataaaaaccctaaaaaatggctatagaagaaacataccttgacataataaaagccatatatgacagaccaatagctagtatcctaatgaatgaggaaaaactgaaagcctttcctctaagatctggaacatgacaatgatgcccaatttcaccactgttattcaacatagtactggaagtcctagctacagcaatcagacaagagaaagaaataaagggcatccaaattggaaaggaagaagtcaatttatccttgtttgcagatgacatgatcttatcatatttggaaaaacctaaagactccactgaaaaactattagaactgataaacaaattcagggaagtttcaggatacaaaaccaacatacaaaaattagtagcatttctatatgccaacagtgaacaatctgaaaaagaaatcaataaagaattccgtttacaatagccatacataaaattaaatacctagaaattaacttaaccaagtaagttaaagatctccacaatgaaatctataaaacaatgatgcaagaaattgaagaggaaacaaagaaatgtaaagatattccatattcatggattggaataatcaatattgttaaaatgtccatactactcaagacaatctgcagatttaacacaatccctattcaaaataccaatgacattcttcacagaaatagaagaaataatactaaaatttataaggaactacagaagacctagaattgccaaagctatcctaagcaaaaataacaaaactggaggaatcacattaacctgacttcaaattacactacagagctatagtaaccaaatagcacagcactggcataaaaacagacacatagagcagtagaaaagaatagaaaatatagaaataaacccatatatttgtagtgaactcattttgacaaaggtgccaagagcacatattggggaaaggacagtctcttcaataaacggtgctgggaaaactggatatctgtatgcagaagaatgaaactagacctctttctcttgccatttacaaaaatcaaatcaaatcaaaatggattaaacacttaaacctcagacctcaaactatgaacttccacaagaaaacattggggaaactctccaggacattggactggacaaagatttcttgaggaacactctaccagcataagcaaccaaagcaaaaatggacaaattggagggcatcaagttagaagcgtttgcacagaaaaagaaataatcaactaagtgaagagactatgggagaaaatatttgcaaacgatccatctgacgaaggaataataaccagaatatataagaagctcaaacaactctataggaacaaaatttaataatccaagtaaaaaatgggcaaaaagatctgaatagacttttctcaaaggaagacatacaaatggcaaacaggtaaatgaaaaggcactcaacattactgatcttcagagaaatgcaaatcaaaactataatgagctatcatttcaccccagttaaaaccacttttatccaaaagacagacaataataaatgctgacaaggatgtggagaaaagggtattctcatacagttggtagaaatataaattaatataactactatggaggatagtttgaagattcctcaagaaaccaaaagtaagctaccatatgatccaccagtcccactgctggatatatacagccccccaaaatgaaatcactatattgaagagatatatacactcccacatttattgcagcactaatcacaacagccaagctttggaagcaacctaagtgtccatcaacaggcaaatggataaagaaaatgtgttaaatacatatatacaatggaatattattcagccataaaaaagaatgagatcctgtcatttgcaacaacatagatggagctggaggtcattatgttaagtgaaataagttaggcacagaaacacaaactgccatgttctcacttatttgtgggagctaaaatttaaaacaattgaactgatatagatagagaataaaatgatggtttccagagacagagagggcagtcaggcagtggtagtgggtaagcagagatagctaacggatacagaaaaagaaagaataagacctagtatttgctagcacagcagtgtgattatagtaaaaaacaatttaattttatattttaaaataaccgaaagagtataattgaatcgtttgtaacacaaggagaaaagcttgaggtgatagacacccccatttaaccagatgtgattattgtgtattgcatgcctgtatcaagatatctcatgtaacccataactatatatacctactatgtgcccacaaatttaaaaataaaaaatttttttaaaggattgctactttgactagccacatgccagaaacaaatataaatcttatctggaagatgataacatttttctatgtctaaattatgtcagtaactttttatatacaatgtttaatactcaattaaaacataagcatagaaagagacaaaaataacatgaagaaaacttgaatgaaacacaatgtacgcttgctacagttacacagaggcctagataatgaaattaccaaatacagactttaaaatagatatgcttaatatagtcaaaaagaagaaagacaaaattgggaattttcacagaaactaggctatttaaaacacaaaaataatttctataaatgaaaaataaaatagctgaaattaagaactaaatggttaggcctaacagcagcttagactcagctgaagataacactaataaactagaagaaaattcagaagaaaatgtctagaatgaagttataaagtcaaaagaaagaaaaaatagaacagggtaagagacaagggggcacagaaagaaagtctaatatacatggaactggaatatttgaagaagcaagagaagggtcagaagcattatttgaataaatatttgctaagaattttccattacagatgagataaatgaaaccagcactattcaaggacccctacaaatgccaagtaaaataaatgaaattttaaattaaacatcataataaaactgctgaaaagaggagaaaacagattactatgtggggtaataaaacagattactatcaaaggagcaataagaccgggtgctggggttcatgcctgtaatcccagcactgtggaaggccaaggcgggtggatagcttgagttcaggagttcaataccagactgggcaacatgtgaaactctgtctctaccaaaaacaaacaaacaaacaaacaaaatattagcagggcgtgctggcacatgcctgtggtcccagctactggggaggctgaggcacaagaatcacttgagcctgggaggcagaggttgcagagagctgagactgcaccactgaactccagcttgggtgacacagtgagaccctgtctcacaaaaaaaaaggaaaaagaaaaaaaaagaggcaataaaagaacagcaattgactactcaacagaaactatgaaagtcaaaaaacaaaggttatgaggctagattaaaaaaaaaaattccatgctatgccgtttacaagagacatatctgaatgacaaaaatatcaaaagtttaaatttaaaagcctggaaaaagagaactttactagagattgacaaactgcttgtcaaagtggttgtataaattttactcccttgtataggagttcttgttactctacattctgttcaacatttgcactgtcagtttttttttaacttccagtttgatgaatgtatagtaatatcttattgtggtttagatttgcatttctctgattactaatgtagttgaacacatgctcatgtttttttgaccatttggatttcctcttttgcctgtttaaattttctgccatttgatatatttgcctttgttcatcaaagtgtagtttattaaacattctaaatactggtcttttgtaccttgatggcttgtatttacattttttaaaatgtatttttttcactgtcctatcttctatgagagaatcacatactggtcactgactcaaagtccaaacaacagctatgagagagcaccaaacatcccgggcttgtctccaagtttgtgttgtaattgaaacttaattagaccataccatattctgtcagctctgcatgatggggtgtgtgatatatacatatgcacataaatatatgaccagttaattccacgaacttggtggttctggcagaaacaatatggggatggaagactaatcacacacacacacacacacacacacacacacacacacacacacacacacaggaatagatatattctaatctagtagaacaaataatttatccttccagaatgaaaaccatccaacataattcacctcaacctgtttccagatggcagcttggttctactagggaatggtggacttttggaattggtctctgatgctggcaaactgggtattctgcagtgacagcaggtagatcatccttggtaagaggaatccaccttatcaaatccacaaatggtctccattcctgtctccatggttaccttatatatacgtttatggtgcttatatatgattatatattatatatattagatactagtctgtctgtatgtataacttatataagtatatggtatctaaatactttttatataagtacatgccagggaggctgccattcccaaaataaataatcttgtccacctgatgattgagagccacctttatatatcttttacaggataaacaaatgggacacagatatctgcgtattttgtccatttcaagaggtacacccacatacttgtaactctctgttgccaatcttttaatatttctttctggagatttttttttgagacaggttcctgctctgtcacccaggctagagtgcagtggcatgatcttggttgactgcaacctctgcctcctgggttgtagcgattctcctgcctcagcctcccaagtagctgggactacaggcacataccaccatgctcagctaatttttgtatttttagtagagaaggagtttttccatgttggccaggctggtctcaaacaatctttaatatttcttgtcaactatctgaacatatggtctaatcattagccactgccatgttagtatggatctgtacctcaggttattttttatccatatgaggcagaaaaccagatgtacatcttgacgttctgcccattgggaggatttacttttacggtttttcaggaacactcttgatggtatagtacaacattggccaacttctagctgaggacagcatatcataaaggacaatctgtaaatgagcccattatttttctttctctgtcaacttatcataaagaattttctatgaggccaaaagtgtaaattaaaggtgagacagccgtgcagcaagaactggtgtcaagagaacccgagccaccttctcatgcaacttactcacgccttcatgactgattcgaacctgacctctgtatgtaccatttccatttggtgatggattgattgttcatattccaaattttgggtcttgatgaatcagttaatacccacttcatgttagacagctctgttgcaaaccaggtgctatttctcaaaagaattatctacagaagagggagtgcctttgctccaaaattccagggatcttcctattgataaatgccactcagtaaatgggtcagagtagcatagtcaaatgggatctctaacactgaaaaatccaaagtccaccaagtgctatgtcactttctaattggtatattccaaaggtgcaataactcatctttcactctgaagggaataacctcaaattgtctacagtattgtaatttagaaacttcacttctgtggtgggattttggcatgtatggtcttagtagatcagtgaaggaatttgccatttactgttcaccaggccaatttagcagaatgtcatcaatgtagtgaaccaaagtaacgttctgtgggataacaaaatgattcagatctgggaagactagattttgggaacactgacatagtctgaaggcaaaattgtgaagatgtactgctggtcctaccatgtaaaagcaaagtgcttcttttcgtccttgcaaattgatatagaaaaaactaattgaagtcaaaaaaactctgatttccactttgcccatactaattataatgactgttcccaccttctctttggaggttaagttttgtccctctgaaatcttattattctcagtgaaactaaagagcccatttcagggctggcatctctcatcatcctccctgggttctgaagagcacagccaccacggagtttttcaaagatgaaatgctcctctcattgaagcttttttttttttttgagacagagtctcgctctatagcccaggctggagtgcagtggcgtgatctcagctcactgcaacctccgcctcccgggtcccagtttaagcaattctcttgcctcagtctcccgagtagctgggattacaggcatgcgccaccatgccaagctaatttttgtatttttagtagagacaaggtttcaccatgttggccaggctggtcttgaattcctgacctcatgatctgcctgccttggtctcccaaagtgctgggattacaggagtgagccattgcacccgcccactaaggcattttttagtgcattagtaaatggagtgtcctctggggtatatgattgagagctaccttggagttggggtggctgtggggatgtgatagccatgataaaacattccaacattttaatatctttaagtctttgtactgcttcctcttcaacacaccaggaagttctgacttctcaatctcatttaacgagacaagtttaggtctcagtttcagtcaagcaagcaagcaaattgttagagtcagtcttagccatcatgctacatcattaaacccaccatctttattgataaattcagtctgatccagaattatattacatcttcctggctctaataactttagacttatttcttacacatattccccaggatatataagctatctcttcctgaatatttaaaaatcaaggatcatatgaagaaagttggtgatggttaactttacaactggactctggtttatcatgctttttttttttttgagacagggtctggctctgtggccaaagatggagtgcagtggcatgatcttggctcactgcaacctctgcctcctgggctcaagtgatctcctgcctcagactcctgagtagctgggactacaggtgtgtgccaccacactcggctaatttttgtctattttgtagagacagagttttgccatactgcccaagctggtcttgaactcctgcactaaaatgatcctcccaccatgacctcccaaagtgctgggattacaggcataaggcaccatgcctggcctagagtagagttcttaatgtttttggaaatactattcaaaggaactcagggcaaaaaacaaaagcaaagtaaaaaaataaatgacaaactgagagactaaataccacagataagggaaatctccctaatatacaagaactaaagatcaagggaggaaaaaagaccaaaaaccctgagagaaaaatagacaaaagacatgtaaagattgttcacaaaaatatagacacaaggaaaagaaactgtcaacagagtaaacagacaacctacagaatgggagaaaatactggcaaactatgcatctgaaaaggtctactatccagcatcaagaaggaacttgaagttataagaaaaaagaacgccagtaaaaagtgggcagaggacatgagcagacacttttctaaagaagacatacatgtggccaacaatcatatgaaaaaaaactcaacatcactaatcattagagaaatgcaaatcaaaaccacagtgaaatacatctcatactagttagaatggctactactaaaaagtaaaaaaataacagaccctggagaagttgtagagaaaaagaaatacttaaacactgttggtgggaatataaattagttcgaccattgtggaagacagcatggtgattcctcaaagacttaaaaacagaaataccatttgacccagcaaatatacccagtatatacccaaaggaatataaattgttctaccataaagacacatgcacgcatatgttgactgcagcactattcacaatagcaaagacatggaatcaacctaactgcccatcagtggtagattggataaagaaaatgtggtgcatatacaacatggaatactatgcagccataaaaaagaatgggatcatatcctttgcaggaacatggatggagctgggggctactatccttagcaaactcacacaggaacagaaaaccaaataccatatgttctcacttataagtgggagctaaatgatgagaacacacagacacatagaggggaaaaacatacattgggacttatcagagggtggtgggaggagggagaggaacaggataaataactaatgggtactattaatacctgagtgatgacacaatctgtacagcaatcccccatgacacaaatgtacctatataacaaagctgcacatgtacccctgaacttaaaagttaaattttatacagaagatagaaagacagacagacagacacacaggcacacactcagcaaggtgtggtggttcacagctgtaatcctagcactctgggaggcggaggtaggaggatcttgaggccaggagttcaagaccagcctggtcaacagagggagaccctcccatctctatttaaaaaataaaaaagattaaaaagaaaaagacactcaacttcactaattagaaagtgcaaattaaaattacattgaggggccagacacagtggctgacacttgtaatcccagaactttgagagtccaaagtgggaggattgcttgaggcaaggagtttgagaccagcctgggcaacacagtagactgtttctaccaaaaaaaaaaaaaaaattgttgggcatggtcgcatgcacctgtagtcccagctactcaggaagctgaggtaagaggataatttgagcccaggagtttgaggctgcagtgagctatgatcacaccaccgcactccatcctgggtgacagagcgagaccccgtctccaaaaacaaacaaacaaaaaaccccactagtgggccaggcatggtggctcatgcctgtaatccaagcgctttgggaggctgaggcaggtggatcacttgaggtcattagtttgagaccagctcagccaacatggtaaaaccctgtctctactaaaaatacaaaaaaaaaaaagtagccaggtgtggtggcacatgcttgaaatcccagctacttgggaggctgaggtaccagaattgcttgagcccgggaggtggaggttgcagtgagctgagatcatggcactgcctgggtgacacagcaagagtctgtctcaaaaacaaaaccaaaaaactacattgagataccatttcttacctattagcttagcaaaaaattcagaagctggacaatccaatctgttggcaaggctgagaggaaacaggcatggtcatacaacccctcgagaggtgaatttgacaataccctataaaatgacatatgcgtttaccctttgactcaacaactctacttgtagaaaattatcctgcaagatgcatttccagcaatgtgaaaagacagaaggccaagattattcctcatggcattatttaagataacaaaatacatattatacctttgtattgacagatagatgccaatataaatcaataatgggaaaaccctaaaattgaattcaaatagaaacaaacttagatattaaattaaatatgtaatcatacagaaaataacaattcaagtaacttttaaacgtagtattctgattataaaagtttttgtctaaggaaaaaaaacactggaaaggaatctcaaatttcacttaggcttgtgtttgtcatggttgtaatgtaataatttcaaaactattttgtatgtataagggaagcacaaacatggaaggagaaagatgaggaaccaccccagatgttggattttaattggtggattcatgatcttaaaaaggcccaggttaggagcaaccaggttagggtttctaaatatcactcattaccaaaagaaatgagatcagtgagggggtctttgcagtggctgagaaatgaggtgctgaggcctgctcaggggctgggaaacaaggctgaaattcaaaaaagcactttgcgggatgaatagatagaattgcttccctcagtaaaggagaagagagaatcagtaagtgagtttctatgatgaagagtggaaggggccatgatggcattgaactaaatatgaaaggcagagaactggtttttaacatgttttgaatcaattttgaatatgttgactttgagccaatagctttcagatgcttacaaacctccagaagttaagggggtgtcccaatttgggggtagtgtttctggtccttctcctcaaccagtttgatctcttacttacttcagggacagagagggcgccaggggcttcctgaggcttctgccaacgattgcctgtcatagggattacacgatgctccacagacaacgcccagaatcttctccctgcaggatcccagtgggctactcttgagtgagcgaacatcaattcccaattggggcagaaaagcattttcaagacctaactcagggacgggcccccacgtgtggaatttctctttcatccctgcagcgaaggctgactcggggcctctgtggtttgtggctgtctggcttcatcaggctccggctgcccccctgcctgcccagcgctcctgcctggctacagcaagcatgtcctgagcatccattctgagcaggcttcccgggcagccttcctcccctgcactcttggcattcatgtggcatggctataaattatgtccagcatgttcattttcagtttaaatgtgttctcatcccaaaggagcaactaatggcatcaagttactgacgtgaaaaaagcctgccgctacaatgactatggattaatgaaatagcagtcatggaggctggggtggcaataaatcgccagccactggtgacacgaattttaaattttgttctccatcccttgcccccttctccaaaattattttgctgtaaagttgtttggtaaatgtttacctttgcttagatgtttgctttctattaaaagttgatgcaggcagggcccctagctcttagaaaactggaagcgggatgagagggatttaaaagcctatcatgctttctctaggaggcgtgaaggcaaatctcttaatccaggatcatcactgactgataaatttcattcagaaaatttggcaaacacaaggttctttcagtgaacgctgctcatctggcatgtaagttactattcctaccttctgttatgacttttttcctaatgaatttaaaatgaggaacccgtacaattcccaccagtgtttttgaaaggtagcaagtctatttctcatctgatgaagggccccagggtatccactgatgggccacagggagtctcagaatctctgatcctaaaagcaaactgttcatacgtacagttggccctctgtatctgcaggtcccgccatctgtggattcaactaatattgggttgaaaatattcagaaaaacactgcatttgtatggaacaggtacaaactttttccttgtcattattccttaaatgcagtatagcaactatttccatggcatttacattttagtaagtattacaagcaatctacagatgatttaaggtacgcgaggatgcgcatgggttataagcaaataccacgccattttatgtcgggaacttgagcacctgtggattttggtacccaggatgtcctggagccaatccctcatggataccaagggaaaactgtatggttttctagaaagaaggtctttagattcatcaaattcactaaatgttctgtaacatcaaaaacaaacaaacaaacaaacaaacaaacaaaaaaacaaaaacaaaaaacgtaaggctaactatggtggactgcagtgatggctccagtttcttcctccccaggtgtccacgcccttgcaatggtgctctgcagtccctcctaatgaggagcctgtacccatcccttgattctggggtggccttgagattggctgtggtccatgggatactaatatgatacaagcagagttgaaaaagtatttgtacactggggcttgcctccttacagtgcccagaactccacagccacgtgaacaaggctgggcgaactgatgagctacatggcccagtcacctccacttcccagcagacctaccaaccagcaaccacatagagtgagtgagcccactgagaccagcatgcctaggccaaaccagaaggactgtccagctcaaactgctgacttacaataaccttaaaaaaaaggttattttaagcaactaagttctggggtagtttgttatgcggtaaagctaactgacttgctaggttggggaagttctcctggataatatcctgaagagagatttccagcttggttccattctccctgtcactttcaggtacaccagtcaaacgtagatgtggtcttttcacatagtcccaaatttcttggaggctttgttcatttcttttcattcttttttctctaattttgtcttcttgctttatttcattaagtcgatcttcaatctctgatatcctttcttccacttgattgatttggctactgatacttgtatatgctccacaaagttctcgtgctgtgtttttcagctctatcaggtcatttatgttcttctctaaacttgttattctagttagcaattcattgaaccttttttcaaggttcttagcttccttgcattgggttagaacatgctcctttagcttggaggagtttgttattacccaccttctgaagcctacttctgtcaatttgtcaaactcattctccatccagttttgttcccttgctggcgaggagttgtgatcctttggaggagaagaggcattctgggttttggaattttcagccttttttttttgctggtttctccccatcttcatggatttatctacctttggtctctaatgttggtgaccttcagatggggtctctgagtggacgtcctttttgttgatgttgatgctattcctttctgtttgttagttttccttctaacagtcaggcccctctgctgcaagtctgctggagtttgctgaggtcctctccagacccggtttgcctgggtatcaccagcggaggctgcagaacagcaaagattgctgcctgttccttcttctggaaggtttgtcccagaagggcacccaccagatgccagccagagctctccggtatgaggtgtctgttggcccctactgggaggtgtctcctagtcaggatacacaggggtcagggacccacttgaggaggtagtctaacccttatcagagctcgaataggcaaaaactggaagcattccctttgaaaaccggcacaagacaaggatgccctctctcgccactcctattcaacatagtattggaagttctggccaggacaatcaggcaagagaaagaaataaagcgtattcaaataggaagagaggaagtcaaattgtctgtgcttgcagatgacatgattctatatttagaaaaccccaccatctcagcaccaaaatctccttaagctgataagcaacttcagcaaagtctcaggatacaaaatcaatgagcaaaaatcacaagcattcctatacacaaacagagagccgaatcatgagtgaactcccattcacaattgctacaaagacaacaaaatacctagaaatacaacttccaagggatgtgaaggacctcttcaaggagaactacaaaccactgctcaagaaaattagaagatacaaacaaatggaaaaacattccatgctcatgaataggaagaatcaatatcatgaaaatggccatactacccaaagtaatttatagattcagtactatccccatcaagctaccattgactttcttcaccgaattggaaaaaaactactttaaatttcatatggaatcaaaaaagagcctgcatagccaagacaatctaaggcaggaagaacaaagctggaggcatcatgctacctgacttgaaactatactacaaggctacagtaaccgaaacagcatggtactcgtaccaaaacagatacacagaccaatggaacagaacagaggcctcagaaataacaccacacatctataaccatctgatctttgacaaactggacaaaaacaagcaatggggaaaggattctctatttaataaatggtgttgggaaaactggctagccatatgcagaaaactgaaactggacccctcccttaaaccttatacaaaaattaactcaagttggattaaagacttaaacataagacctaaaaccataaaaaccctaaaagaaaatgtaggcaataccattcaggacataggcatgggaaaagacttcatggctaaaacaccaaaagcaatggcaacaaaagccaaaattgacaaataggatctaattaaactaaagagcttctgcacagcaaaagaaactatcatcagagtgaacaggcagcctacagaatgagagaaaaattttgcaacccatccatctgacatagggctaatatccagaatctataaagaacttaaatttacaagaaaaaaacaaccctatcaaaaagtgggtgaagtttatgaacagacacttcttaaaaaatgacatttacgcggccaacaaacatatgaaaaaatgttcattctcactggtcattagagaaatggaaatcaaaaccacaatgagataccatctcacactagttaaaatggcaatcattaaaaagtcaggaaacaacagatgttggagaggatgtggagaaataggaacacttttacactgttggtgggagtgtaaattagttcaaccattgtggaagccagtgtggtgattcctcaaggatctagaaccagaaataccatttgacccagtgatcccattactgggtatatacccaaaggattataaatcatgctaatataaagacacatgtacatgtatgtttaatgtggcactgttcacaatagcaaagacttggaaccaacccaaatgcccagaaataatagactggattaagaaaatgtggcacatacacaccatggaatactatgcagccataaaaaagaatgagttcatgtcctttgcagggacacggataaagctggaaaccatcattctcagcaaactaacacaggaacagaaaacccaacaccgcctgttctcattcataagtgggagttgaacaatgagaacacacggacacagggaggggaacatcacacagcggggtctgtcggggcagtgggggactaggggaaggatagcattaggagaaatacctaatgtagatgatgggttgatgggtgcaaaccaccatggcacgtgtatacctatgtaacaaacctgcacattctgcacatgtaccccagaacttaaagtataataataataataaacctcaaatgagagggaaaaaaaagctaactgatacaagtaccagaccagacagtgtccgtttggaagatggggatgtgtcttattcagtctttgtatctcctttccctttaaaccctgtaaccattcaatatgtatttgttgaactgggtagaaatggccccttgaaaaggctgcaattaaacccctttttctcaaggctactcaagtcaatcaggagggaaacagcacaccaaggattccatttcctcatttttataaaatgggcttcaaaatacctaccttgtcatgctgttgtggttgttaaagatcctgtgtgctttagagatgtccttgatacataatagacggtggctcaagcagaaacaagcttatggaaaggctttagaactcatcaggatgcaggatattgtatattttttttctatcaaagtggtcaccatgtgttcagcctaagaggactccagtttcaagtcatcagctttctctgttgtagaagtaaggttggttccttcacgctccatcagacatccatgtgccattctaacagtgcctcgtcagaggacttgcggcgccctctgtgaaagacggggagggctcctgagcgggactcaggaatgtgggttgctactctggattctgccaccgcccatttccttgcttgtgaaataaagtgtggatgactgcacgctctctaagaatcctttcaactctaggaatccacgggcttcagttaccaccagtgtcatctaagcgtgagggactgcactgctcacaggatccctgagccataagacaattgacatttttagaagtggaaaagaaaaggttttctgtatttgtctaaagtagaaaggcagaagaacaggccaaagaattaggaaataataaagaggaaaaagcaagcaagcaagtctgatttgagctgggatgcgagaaccttgcttgctgcaggataatggagctttacaccgtgcataccacactcacacactcacatgctgaaccacacatttggctaattacagaaaaaatttcaaggaaaaaaaaaagacatacacaaggagttataaaatgctgatgagaaaggtttacacaaagagctgtgagacattcgaaaaactggtttttggcattaagacttcctatccttttctagtaatatctaaaatggcttcttcctagcatttaggataaaacttcttgtgttggagaagtatttggaagtaaataacaaacacaaacatcatttatcacaaagagcaaaagatgacatctcaaaattctgcttcttgccaaaatggacattaagtttttgcttggaagcaaatgtgaaaatagtgacttttatctaattatccctacatatatccaaagagaaagttataacttatttgtcatgcttttaatatgattttctgtcttgaatgttggtattttaaacattaaaatcgccaatgagtaagcaaataagacaattaccagatggcatcctcaaccaaatgttttgaatttattataatcgtgcttctctacaactaatgattcttgtggtttgcaaaccatgtctgcctttatttacctacacaaacacggaacagaatttccaataggagaggttcacacagctaacaaagcatagagtgtgtgacctcaataaggcattcaacaaagacacacgccgtatttccctctgactgcgttcccttaggatgctctgatgttggcgtcgcattcttctaaaagtagaatcaaatcttcaatcaggctgtgttctctgccatgtgtcactctcataatatcaaaagcctaaagagaaaggacggaagagagattagaccccaaaataggtgagctcaggccattccccacctttaccccatgatgccaggggcctggtgaaccccacaggtttacagggtgaacagtctttaacaggcttacagcactgtggttctcccagctggaaagtcacatgaaaagggtgatttctgaatgtggtatttggaaagcagactcactattcgagtcatgctggggcccagtgacaatcgatgatcttcaaagactgtcagtgcacaggtttggtgggtagtcacagggataagaagagttaccaaaatgattgagtcatatgaaagaccatgctgctaccaccttaaaatttttctttattgcacactccattcaattctcatctatatgcaccaggattattatatacatgtattctcacattttttttcatatcatattatagcactggcatttcaacagtcctctccttcactgctcatatttggtccattattaaatcttgtcaactcttatcttcaaaatatttctgaaatctgtgtgggcttatgagtacttcaataatagagtataatagaagtaaagcaactgacttgtgagactaggtcaaaaaggcctctgtgttgtttactggtcagtatgtttgctcccagaaccaagagactccatgctgcaaggaagcccaagccacatagagggaggccgtgtacaggcactctggctggcagtcttagccaagctcatctttcaagtcattctagacaaggcaccagacatgtacataaataaaccttcagacgattccagcacccagctgaagactgccagatctgtcttcccagatgaaacaccagacattgtagaaaagaagaaagccattcttatgctgtgtgccaattcctgacacacagcatttgtgcaataattttgccgttgtttactccattcagttttgggatggttatggaacaacaaacaaccagagtatccttgaaaatatttttgtaataaataagagataagcaatattatcctgccctgcccaaatgggggggtggggtggggtggggtggactggggagaagggagggacaccagaaccactgcatttgatgtaaatgtgcccaggagacttgtaaagatatgactctggtggctgttatgcacccaaagtacctggaagtggcactgaggctctcagccttagctacacagcaggatcaaccagggagcttcaaaagagacaccgagggccagaccctgcacatcaacagctgaagcctgctctccaggaatgaggcctaggccccaggagattccaacatgttctcaaggttgaaaacaactgatagagcaaactctcaacaaataacatcaactactcatgattcagtgttaatttatagccagaagaattaccattttaattgttgtatataatgaatgccatcatgcttataaaccattatttactaagctactcctggaaatttagatcacctccaattgtttattaggatatgatgcagaccttccagaatagattttttgcctttcttggatatttaagagcaattgctaggggtggaattcttgagcatgaacatcttgaaaaccacagagatttcagaccttggtggtcatgtggtgagacgcctgcattttgcaattctgcatgcaggaaaactttccattctacgttggaaaaacgctgaagcttcgagaaacaaagcatttcagggggatgggtaatttcaacctctgtttctggcttcttttttcacctcttgaatgttccctttaggctggaaggaaaacaggcagacagagggggtctagatttgctgctgagagagagagaaagagagagaaagagagagagagacagagagacagagagaaagagaaagagagagagagagaaagagagagagagaaagagagagagaaaaagagagagagagagaaagggccagcgcctcagaccctggcctctcagcctggaagacagctctgctctgagtccagttgtgaccccgcactggcagtctggcccctcaccctgtgacactccagctgcaaagcccagaaggtggctggagctgagatgctggcggtgggaattgacttcctattcatgcgagcaagtctgctctgtgggtgcacagcatctgccagcaaatccctaggcagggggctgtccggagtgcaggggaggagttgggaccagcccccaccttgcaagcagcccagctctatgagattcccctgggcagaagattaaaaacaaatgtttgatggcattcatggagcacatgcctcgtgttttattctcttttctccacactgccctggatcctccgctgctctggacatcttgaggtctgaggcagagacctgtgtgacagcacgattgcggaaagagaaggtttctcagatcagagagccttcatgggaaattttcttacttgaaagcactcttagatgttctcttcccttttactcaacaaagagccagagtgcttgtgatctggcaaaggaagatgaatggggcagaatcactgcctggaaagatctttgcagagagggacgtaaccctccgtcctgaaaaaggccagacctaacctgctcggcctcgcctccctccctgccctcacagaggccctcggctgggtgagggcctggccttgttgctcagaatttccagaccagcctcttttttgccctcctggttacattccccaggttccccatctgaagaatgatctgtgcttctctctgacttgactcagaggctaaatgacaaagccatcttcttgtcacttcaacaacataagttcactggcatgctttgaacatactacaggctccaggcttccttcctcgctcttttcttccagttccagtggtgagtttcactttctcctcttttgcagctttaagagtaaggtctactccccactgatccagtatattcctgttcatggaaggggcagacctgcccatcccacagtacggtaactacttccagttcttcagccattctggaattagagccacagccaggaagggggagtttcctggccttcctccagcttcacatccacacctcacagcctgcttccttgaggaaagaccagaaggatcatctagtccaataccctcatgttatggaaggaagtgcttcctgaggtcacctggcttgagagttagactaaggatgacctctcggctctcaggactcaacccagtgtgtccattccatgactgcattgtgcagcctccccgtatgaacagactgcagtgaccaaggagaggagcagaggctctcctggacatggctgcagagataccctgaggggacacaggtgccttccttgtcaagatgctgctggtcatgttctgtgttctcttacttgatgctgaatgcatcaccagtagcaaaggggaacaggggcaaccctcaggaatgtgtgtgtagagtctgagatactaagtttagaggatctcgtccatagggtggctagaaacagagaggaaatgggtatgggtaggggcagagaactaatctgaagcaactgaaaaaaaaaaaaaagaaactacatcatctgtctagaaagtaaaacgccatatagatttgattaattcacaagcaaacatacttttctctgaaagatgggcagatgtagatgagaaagggagagaaaaacgagaagaaagaagtaggattcagtaatgtgcaaaatatgttagtgactgtgtgtgcggatgtgtgcgtggatgaatggtgtgacacaggtcagcaggaagctgcaattcacacctggtgatgaggacatctggtccttgtcttgaacatcacctgggcctatgggtgagctggggcagacagtcctcaacaatgtacggagagggccctgtgtggccctgggcacagcccttcagcactgggtgagctggggcagacagtcctcaacgatgtacggagagggccctgtgtggccctgggcacagcccttcagtacagcaggaagatgaggagggcttcccctcacattaccatcccccaaaaaagttacaataaatttctgacaaacgagagcaattgtttcaagtagctctgtgtctcccttctcctaccactcccatctgtcacccatgcgcatgtcagagaggacaattctggtttaatttcctgcagtagcatataaaacagattaaggaaatataaaattggagcaggctggtgttgggaaaagcttatctctttccattaaattttattttttttaatggtagcatttaaaaagagcctgcacataatctttcacagagcactcatttgaagcctccaaggagggtgcctgctacacccacatccagactcgaaatgtcacatgagaaaagcagcatagcttgtctgccacattacaggcatacagttaactcagtaatagagaaagggtccccagaattgatttcaatctcatctgtttttttaagtaattttagaattgtggtcatatattaaataaaatgaatttaaatcaaatcataaagttggaaacaatatacctctcctattaattttaatatgaatatattaagcttatcaaggatctcaaacagtttctaccatgagcttgaggaatctagtaagtgacttcccaagtatgatttaaatatggatataaaatcagagggaaaagaaatgtatgcatgataagaacccctggaatcaaatcacgacgggaaaaaataaagcaggttttcttattctgcccaactcagaatgaaagaaaagcagagggtggggcacagggaggaggaagctggtctggggcattcaaaggaggaaatgcaagaagcaagaggtacaacacattaagcagctctggaggcacaaaaagccctttgcaaggacagcagagaatcccaaagactttgatgatccacctcagctcagcagcacccctggagaccccactccactctacatcttggataacttcaagtgtgtattccgctggaggaatatgtccttttgggaggcagaatttccttagagataacatctacccattcattcactcaatactgtctgagcagctttaatgaataaaacttggcccttgccctgggagaagctctggcatagtcagagggacagaatgtaaataccagatcattgcagtggaacagtgtgtgttcaacagagatgcaaagtgctggggcgcccagaggaaggaggaaccaggtggccccacggcaccctcaggaggggttacagatgtggtgagctcaggtctgtgctttccagtggtagtagccattccagaaaaagcatggctgttgtatcactgtttaatcaatcaatcagtacatattaattgaactctgagagactctgaagaagttatgtttcctcagctaaataatgagactggacaatataaattctaagggcaacccaagtcccaatgtgttgtacaatgtgccatgccagacacagctacaaggcgtggatttggttttgtttccaaatattgttactgatttctaatttaattccattgtggtcagataatttactttgtattaacttgaatctttttatgtttattgatatctgttttgtggcataaaatggtctcttttggtattatagttacttaaaaatgtgcattctgttattgctgggtgaagtgttttctaaatgtcaggtcccattggttgatggtgttatggaattattttgtatccctcctcagtttctgtctagttgttctaccaactgttgacagaggaggtctgatgttcccagctgtgcttgtctatttgctcatttctcctttcagttctatcagtttttgtttctcatgttttgcaactgtgttgtttggtgcatacatatttagtactactatgtctttttggtagactgacctttttttcattatacaatgtccctctctgtctctcataacattttctttgctctgaagtctactttacttaatattgatatagctactccagctttcttttgattgtgtttttataatgtatctttttccatcattttgctttcaacctatttgtatcattctatttaaaaagaattcttacagacaacatatgcttgagtcatttgttaaaaatctgttctactaatctctgtcttttaattggtatatttaggcaatttacatcttttacatagactactgacataatttacaatgttattattaatacatcagggcttaaatctgccatttaattttttgttttctgtttgctctctttttctttctttttcctgcctttctgtgggttaaacttttttttagaatttcattctctagtgcttttgagtgtattactttatatagttttgtggttgctccacgtcttattatttatatatattttatatatatatacacacacatatatatgtatatataacttgtatataatatacatgtgtatgcatattatatatgtatatatacagatatatatgtatataacttatcatactttactagtgtcatcattttacccattgaactcaagtgtagaaaccttccctttacattttaccctcccccactcccccatttgtaatacaattgccctaaatatttctactacatacatttagaatcatatcagatagtgttataatttttgcttcaactatcaaacaatctagaaaactcaaggggagaaggaaagatcattttacttacccacacttttgctgaccatattctttcttctttcctgatgttccaagagctttcttttatcattttctttctgtttagagaacttctttagccattcttttacagtaagtctgctagcgataagttcttttagttttccttcatctgaaaatgtcttgatttcttcttcattcctgaaggatattcttgctggacaacatacattctaagggcaacccaagctttgggttaacagttcttttctttcagtacttgaaaaaaatatgctactttcatctggcttctgtggtttctgatgagaaaatcactgtcattcaaattgtttttcctgtacaggtaagttgtcatttttctcttgctgcttttaggactttttttttttttgtctttagttttcagaagtttgagtatgatccacagtcttggtgtgaactgctttcggtttatactgttcggggtttgcttagcttcttaaatctacaggtttatgtcgcctgccaaatttgcaaagttttccactattaattctttttttaaaaacaatatggtaaagtacacaaaacactaatagttaccattttaactatttttaactcttgagtagcattaagtacattcacattgttgtgcaaccattactactatccatatagccataacttttgcatcatcttgtactgaaactgtgtacccattaaacaatagcttcccatcccctcctcccttcacactctggtaaccactgttctacttctgtctctaggtatttcactattctaggtacctcatataagtggaataatatgatatttgttcttctctgtcaggcttatttcactttgcataatgccttcaaggttcatttatgtgtagcatgtgtcacaattttattcctttttaaggctgaataatattcccttgtatgtatatatcccattctatgggttgctttttattttgttgatggtatcctttgatgcccaaaagtgtttaattttggtgaagtccaatttgtttatattttcttttgttgcctgtagctttggtgccatatccaagaaatcatcactatgcccaatgtcatgaggctttttccttaatgtgttcttctaagagtctagtagaagcttttgctcatatgtttaggtctttgatccattttgagttactttatatggtgttaagaaagggtctaactttattcttttgcatgtggatatgcagcttccccaacactatttgttgaagagactgtcatttttccattgagtggtcttggcatccatgttgaaaatcatttgatcatatatgcgagggtttatttctgggctctctattctattccattggtctatatgtccatctattccagtatcaccctgttttgactactgtagctttctcgtaaattttaaaatcaagaactgtgagttctccatatttcttcttctttttcaagactgcttttggctatttgggattccttgaggttccatatatatttcaagatgtatttttctacttcttccccaaaaaagccattgggattttgatagagattgcattgaatctgaagattattttgggtaatattgacatcttaataatactaagtcttcgaacctatgaacatgagatgtcattctccttatttatgccttcttcatggagaataacttattcagttattctcagataataacttacttggttttgtgttattgcaaatagcattattctcttaattttgtttttgaattgttcatttttagcgtttagaaatacaactgatttttgtgtgttgatctgtatcctgctaccttgcttaattcacttattagttctaacattttttggtgtgtgtgtgtaatcttcagagctttctccatatgagatcatgtcatctgtatatagagataattttatttcttcctttccaatttggatgcctccaccattatttcttcaagcactttttccacctcaccctctttttcttttctttctgggactccaatgttagatcttttgttactgattcataggtcccctgaggcactgttcaattttactttttcttcagtatttttttctgtttttcagcttgggcagtttcaattgtcttatcttcacattcaccaattcattcctctgtttcctccattctgttgtggagctcccttctgtttattttgattattatatttatcagttgttaaatttctatttgtgtcttctttacggcttctacttcttaactgagattttctattttttccatttattttgagggtgtttgtaattccttgatgaagcatttttatcatggctgctttaaaatctgtcagactattctaacatctctgttatcttggaattggcatctactgattgcttttattttcattaagattgagatattcctggttcttggcatagtgagtgatttttaactgaagcacaaacattttgagtattctgttatgagactctgaattttacctcaacctgctttagccggctttctctgacatcactccagcaagagaatgaagtgatgacaccctgttactgccaggcgggagtacaagttcaggttccctatctggctccttgttactactgaactcatacttcctggaaggtaaatttctgcttatttcccataatacgacttaatcactgtgtttgcattttatccattattttcttatcttttctcttttttggttcaaaaacacactcttggaactattattctctatttggaggtcagtaggaatcactcataaatattagagccaggggcttccaaacaactctttgaaggtattagtgacaattacgggacatccttccgcatgccctcttactccccctctttccctcccacctccccacacggtaacgtatgatgttaagtgtttagaggagggctttttaacctaggcaccatggatactaagtccatggaagggcttcagggagcctctgaagctgccatccccaccaaatatacaaaaggttgtgtatatttaacttttctctggttagtcagtggccctcatcagattcctaaatagggacacaaccaaagaggttaagaatcactgtagcggattaagacatgggaacaacagaactgcatgctctaaatcagccattgctggggctgaaaatcagggcagccgatgcaggaatacaaggagcaatctctaggacttgcggcctggtgctgtctgttgagatgcagaaaaagctaaaaagatgctcaatgggtaaaatactgcaataaaatcaaatgagaagggaaaaattgtaatacaaaaagtttaaatacagatttttttaaaaaaatggatgccgaggggaaagaagtctaacttttgcaaccagatttttgctgaaaagcaactacactagggccagggtgagggagcctgcagcatgcagggttcacaggaaaaaaaacaactctgattaacaagacagcccagatgggttgtccttgaggtccaagaagtcaaattagtagcaaacaaaagccttctaagaaataaatggaaagaaataaaagtagattagtgacaggagagggcaggagggaagcactgggaagggaccccaggactgtcctgtggcagcaatcacaagaatttcagctgagcccagtggaaatggaagactaaaccaaatcagagctgggctaagtggattcctttcctggaggaggctggagcctaactgaatctgtaataaatttctgtttctgaagctcctctgatttctattcaaactcagtcttcaaaaaccttattcaagtgatttcattccattatttccagggtttctaagacaagaaagagcatcccgagggtgcccgtctgaagatgacatcagtttcaaaaggcaaagagtatagcctcccttttccctctccaggttacccgagtcctgagaaagctcaggaaagaaagactttcttcaggaagaaactgacctgcttctagactcacaggtcacgtgagctttcctagggatggatacattcaggccatccctctgctagcaaatgctcagcaaaggtcatgagaagatctggtccattaactgtaaacagctaaccagcaggcccagggggaggcttttaaagacttctatccattaaaaaaatccattcattcaagcatgtatttaacagaacttgccgtattgggggcatgtgtgtctatgttaggtggcaccagaagacacaaaaggaatgtaaggtcccttgagggattcccactcaccttggggagcaaaacactgctggggagcagtcatagaacataattgttcaccagaggaaccaccgtgtaccccaaactacaaacacaagtactgaacagaccagctagtgggagagtgatcagaacaagagttcctgtaacaatacccatctttaatagtttcagaatgcttgagattggcaagcacactctcccgcattgcctcgcttactcctcaaaacaagtctatgggatagctatcagcttccttttacaaatgaaattatattcagagattaacgcaaatggtgggactggaacctgaacctactgactctaaatccttgcactctttctacaactctgccaggagtgcatgtttgctccttggttgatcatcagaccttggcaagagactcaatgacttttgtagagacacacagcaagtttgggtaaggccaccatttaaccccaggcctcatgacagataatctgatgctgctcccagaatacctttcatttggcatctatcagggtgtatgcctgagcttcaccttggtaccaagaataggaaaagctaacatgattacgaagagaagcttctgaaagaggcgatgcaacctcatcagaagggtgtgagggcagcagaacagacctgggcatgagggatgtaaagggcagtaagagggtcatctgaagggctggtgatggtcagtaccatcagcccaggccacattatcctgaaaatccatagcgagatgtctgtctgggtttgttcaggcttgtccttatagttgagggtattagatgtctccttcagaagttctgtatgcaatagcaatgactaaagcttcacataagaagcaatctaaatcttctctgatttctctcccatatttttccctgagttggcatcatgggttcggttagatcttaagggatttctgcacactgatcttactagagagcctcatctatttaactggaccagtctagaggaaaagagcagagccttggtttctggcctggatttaatgacttgtacatgtctatctcctccattaaattgtacacaccatattgagtctttttttttttttttttttgagacagtctcactctgtcgcccaggctggagtgcaatggtgcaatcttggctcactgtaacctctgccgcctgggttaaagcgattctctcacctcagcctcctgagcagctaggatttcaggcacccgttatcatgctcagctaatttttgtatttttgtagagacgggatttcaccatgttggccagactggtcttgaacccctgacctcaggtgatcctcctgcctcagcctcccaaagtgctgggattatagatgtgagccaccgcgcccagcctgagtcttattcaaagtagtagaagtatttgatcaccatgttgaattaaattgaacaaatacacctggctctgcctctgtgcgactttaggtgagctcttgcatgtctccaaacctgagcgccttcactttccaaataggaatgaaaatgcctgtcccattgacctcacacagctgtcacctgtcatggggactgagtatgatcacggatcacgtacgtacgagcagtattcatagtttctagtcccatataaacacaaaggtctagtctgatcacttacgaacatctacttgcaggtgaccctgtgttgggtgcatcgcacattaggaaatttcctgcacgttgtttttctgtcaggactttcacacagtaggcccttgataaggatttgctgtaccttgctgattcgactggctgacaagtacccccagaccagaaaaggaaagttctccctgaggctgcaacagacggtgcggtgttcttcccccgcctgggtaaacatgccagacatgataaaaagaacagaatagctgagtgccctcagggaatcctagtgttactcccgttggccacacgctgactttatttagagatcaagtaaaggcgctatggctagcattcggcgaaaatgagcactgtggaatctggcttttaagaatcccttcggcatttgtcatttctcttaggtccatgtgggcggctgccagtgttttgggatcagccggcccctggacacgccctgagcaaccctgacgcccgatccttccaccgtcactcttctgcacacaagggcatggcggcccagagggtcctgttaaagtgtcaagcgcttcctatgatacccgcacgccaggtctccatacaacccaccagtgcctggccaggtgagcatgtgagctctcctttggaagggtcacggactagaggagaggaagttctgctgaggtgggaaggcctgggccagacagcagagagccctgggctcctccgggcagaggagactccctgagcgggtgaaactaaccatcgtgttttaacaagctattccaaccctaaaccagttctcccaattagtttcttgacacttattgccagaaccgtattcactgacctccttcgcttcctccctcctccttccctcaataatgaatacttcctaagttccagatcccttgcatggcactgagctggttgccaagataaccacgaagccctcacactctcctgggggcaggggtaagggtggtcatcgggtatgcctactgcaatgtgaaaagggctctcctggcagggtgggcagagagctgtaggggtaggaccacaaagtaacactggaattgggccttaaaggatcagcagagtcctgccaagcccagggggttgtgatgcggagagcacttaaggcagaggaaaaaatagctgtgtgaagatggaggagtgagaagttcagggtcacagtgggtcctggtgaacagcagtgatcactgggtgggtggaaaggaagagaggaagggcggggagaagtggctgcaaaggtgaactgccacacagatggtcaagggcttgccacgcgagggacacggactgtgttccgtgggcaatggggaggaggcacaaacaaggtcaacttgctaaacgtggagagggcacaggagcagtggtgttctcagactggtttgtaccagtggcaagagtaattgttaatattatttttataagaaggttgattttacatttaaaatcagccatggtgggcatgcctgcatcacagaaataggcaaatgtcatgaagcaggttttttccagagtggttgttaaacatttaccagcacacactgggcatgcgtgtgtatgcgtgcacacatacatagagctgctaacaaatcacaaagaggcccagcaacagcagaaaaaaaggatgccaggcagaactatgtgagatcttggcacactcaccagtctcagattcttcattgcttggggaaacatgccttgatgtagctgcagtttgccaactttcatcacttgaacccctctgacgggatggcttcctgggaaaaaaatcctggaagaaaccaaacggcaaacagtgtcagcagccctcacctttgcagtcagcatttcatcaggagactacgaaagtggaagcagacactagctgtgaatgttaatgagctactgaaaggaaatcagctttgcaatccaggagaatgcagtactgaggggaattgacacaggactggtctccagctcctcagaatgtgttttgtgttagggaaaaaaaatgacaggactagaaggtctccctcataaacactagagaagagaaacaaaagtttggagctctgcgttgatatttgggaggggtggggcggggagaacaggtgctaatctcctcctccaagctcttccatgaagcatcagcatcagcactagcacagccctggaacagcagattgcctctcaatatatatttgttgaataaacaaagttttcatcatcccccaactagatcctaccacaccccccttttaaccgcaaagccctttgattgaatctcagctgtggagtccatcatggtacacctttcttatgagcacgtgtgtatttatttatcatctcactggattatagtgctttttattcaggcaccccatctgcgttctccatgatgtctgacatgcaggaggaactcaatccatactggaccctttcacatagaacagaatagaatacggtgttgtcgtggaccaaagaaagaggacgcacacgactccggctatgggctgtttcagaccctgtgaagagctgtattacttcaattcaacaagaatttaccatattggatttaaccaaatatgagcagtttggcctcttctggccccaataccccctacccctactcttagagaatactgagcccccgctgtatatgcagaattgtctctggtggaaatgcctacacacacacacacacacacacacacacacacaaaaccacagtttaaatgagcttttcaggacaggtgcgatggctcacacctgtaatcccagcactttggaggccgaggcaggcggattgcttgagcttaggagtttgagaccaccctgggtaacaaggcaaaaccctttctctattaaaaaaaaaaaaaaaatacaaaaatgagccaggtgtagtggagcatgcctgtagtcccagctacctaggacgctgaggtgggaggatcacttgagccctggaggctgaggctgcagtttcacaccactgcactccaccctgggtgacagagtgagaccctgtttcaaaaaaaaaaaaagttttttccttgaggctgaatcatcccattagacacaagataaacattcctgcaggagttaaaacaatgttacaggacggagcatgatttagcgcccaaataaggcataacttagtataccctagatgtccagttcaagtttgttgaattgaactgagaaaatgatacaagtattgtgaagacaaagaggtgactgatggttggttggactggggaaggcttcctggaggtgggaaattggacttacactggctcccaaggatttggagaggcttggctgggtaggagaagggaagcatatcccaaccgtcagagagaacgagcaagggcacactctaaatgctgcttctccagggacggaggtgcctgcccacagacatcactaagatgacctagaatccatcactcacgcagggcctgccatgtgccaggcgctgttccaactgcttttcatccatgaacccagagaaccccatctaagctctattatataacagtgatgaggcggatttaccaggagagacaggtatgttctctgaaaatgcacacatatctgcaaaccattccctctcgctgaatcttaactcttcctcccatgaaatgtgatatagaaacactttttttttcattcatgctcttaagaagtagaaagcagtacctgggaggaaagtatttaaaccgacagaaagttgggcatgcctcttttaaaaagctgaaaaggggctgggcgcggcggctcacacctgtaatcccagcactttgggagggcgaggtgggcagatcacaaggtcaggagtttgagaccagcttggtgaatatggtgaaaccccgcctctactaaaaatacaaaatttagctggacgtggtggcaggcgcctgtagtcccagctactcgggaggctgaggcagaaatgcttgaatccaggaggcagaggctgcagtgagccgagattgcagcactgcactccagcctgggcaacaagagcgagactctgtcttaaaaaaaaaaaaaaaaaaaaaaaggctgaaaagggagcggaagggggaacaacaaaggagacactgggtcctggatttttcttcatctcttcagtatgccaaggggtcaatcactttacctctcaccccttacgaaatgaacatcattatctatttgtgtagaaatgactttaagatccccagacaaaaggcataagggcaggacgccatcatcagagggtaactgccctggacactttccttgaaaagcacgcctggatttggggtgttatattattactacgaatgtagcatcattaaacttaaaggccaaaaagtgatcttacactaatcatcactccactaagtagatgtctgtcatgtcagttagcagaaggaaagacaatcttcagttctacgatggcagagaaagcggtgtgtcattacgccatgacaggtacctgccccggtagctcagatatttcaaaatgaagtagagcttacaaaggagagcatgaggaagcgcttgtccaggggcacttccaaataaatatttccagggcagcctcacagctctatggggctgctgattgcgggcctggttggtttctggaggcctcccagctgacatagagaataaaaatcatgattccttgctggagtataactccaaggaaagctggtcaagctcactcctgctgggagacattcttcaaaggtgtggccttccatccacttcatggtgtagagcagggatggggagagaagagggcctggaggtagtagtcttgacaggacaaaaagacggtcatcttttgataggattgtcaaaaataaagaccgggattaagagtccaaagtgaagcagcaatcaggtgtgtccaaggaccgtgaggactaaagcaggagtctgagtgagaaggtgaggggaagatgcacctacaagatactggattccgggtccggccccataagcaatctgcagaagtccaaagtgagtccctgcccttggttagcatgtagtttgcaggtgaggcaaatgaaatcatgatatagaaaggcatgtgacagccacctgaccagggcacagtcctggtcaatatggtgaaaccccgtcaatatgtgtgaaaccacacaatgtgtgctctgggagcagccgggaccacagtgatcaggggagtggcagagcctgagtgtgtttccactggagatgatgatgggatcctgggacaagggaagggatggatggttgctctggtgatgggataggaagctgaatgccaaagggcagtgagcatgctggtccggccagcagaggaggggagtgggaagggaggtgcactcaaggccaggctgtgcagaggcacacacacgtgcaaagctaggaactctggacttctcttgccagcagtgaggccaggctgtgcagacacacacgcgcaaagctaggaactctggacttaccttgccagcagtgaggcactaccaaagggggctgaagatattttatcacaatagaaaaccaagaaaattggaaaacagaccctagaggcaaaaatacttgaggtaggatagcagcaatatcaacagaaaagaaggacttggtacaagaaaggttatgcagctgatttaacagaatctggggatccaagggggtgcagtggagtctgagttgactccatgattcagaaatagaaacgcttccacaaaaacatacaagcaaactacataacaacaaaatcattcaacaaggcagtttacttgtttgggtgatataaattttcctttcacaggtataatgctagcaatcacatgttccagaatgcttggcctagattggaaaaaaatgtttttggtgtttctatggtgaataagtgcataagaagaaatgggtttaaacaagcagagaaaagaaggaaatgtacacaccagctttaactcagacccacaagcaccaagatcttactgatatattttacagggaggctgaaagtcagggaactgggatctgaagtcaaaaggacatggagaagaaatatctgatgccaggatctctatcagtctggctgaggttgctgatctctattggtcctacgtgacacaattaccaatcacattattccgttacagatggcagctttggcattcacagggtaggaaaaggcctttgttattcagggctactgctttggtttgaatgtgttccctccaaaattcagatgctgaaacttaatggccaatgtggtagtgtttggaggtccggcctttaagaggtgattaggtcatcaaggctcctccccttgtgaatgggattaaagcccttataacacaggtttcacgaagtgttcagcttgtttgccttccactgtgtaaggacacagtgttccttccctccagaggatgtagcaacaagacatcatgttggaaatggaaagcagccctcaccagacaacctgctggcaccttcatcttggatttcatgacttgaacttcccagcctccggaactgtgagaaaaaaaaaaattctgttcttggtgaattaccgtctatggtattttggtgtagcagcacaaactaagttaatacaattattttttaaaaactgatgcaaaacatattactgaacctgaaaggagaacttaacctgcctatttaaattgtatcttagagtaactaaatagctccagttgtatgaattttagctgataaatgtggaatgatgacagaattagaaaaatcattttgcaactcctggagaattattggactgaggggagaaaatatcacttgatgaaaccattagataaaaggatggtaaagaattttacagtgggtggattaacttgtcaccatctaaatccactgatcaatcttagcaccaccgaaggaggacaactagacactaagtgccatccgacgcagaaggaattatttttgaccacccctcaacgatccttgtgaaacaaaacagaaccccacacactgaagctgaatctaaccaaggctgcaaagtcaaatcccatttcatgcaaaaaacaagggacagagggacaagtagagcagtcagctgaatctggggtacgggaaattctacaaaagcccggacccgggatcttcaacaagtcaatcacatcgaaagaaaaagatggtagcgggagaagaatactgtagattaaaagagatgtaagagatgtaacagccaaatacgaggtgcagaccttgtgtatccttactcagccaagacaactgtaaaaacatatttctgggataatccaggaaatctgagcatgaaatggcattgcgcatggaagaaaaaatgtcctcatttttcagagatacaaaactgaggtacgtatgaattaaatgacctaatatctgagatttcacttaaatatagtcagtcctctgtatgcacaagacgttagttccaggatccccacaaataccaacatctgtggatgtttaagtctcttacagtcagcccatggtatcgctgggttataaatccccaggtccagcatctgcaggttccaacaactgcagatcaaaaacacagctggccctgcatatccacatgttctgcatccagttcaatccagcagagatcactcaacgcagaagccatgaatttagagggccaactgtatcttcagcagattttcagcttccagcaatggtggagtagcttatttcagaccaagcagcttatctgctgctgaaaacacgaaatgctgtaaacaggaaaacatagacaaaaaagtatttttaagaatctgtttgaaggtatcaaggagccactgaggcagcaagatcttgaaaagtcaagatcatggaaagagtggaaggtgaaccttgtattcattggtacttttccctttgatgatcttagagacagagaggctcaccagctgagcaatatttttggcagtctcatagaaaaggagacacagaaactggaattcagggatcaacaatgataacaaggagctccagtaaacattcctggctttcgactctgaccaccaaaggactacaatctatctaggtatagtaaattagaaataaagcagccattacaaagaatgaatcacttcaaatcctgattggattaaggtacgaactctttctatcctgattcccagaagcaaaagtaaacatgtctgaaggagataacatcatcctcagcctcaacttatctcaaattttctgtataatgttctgcatttggtaaaattataacccggcatacaaaaagacaagaactctctgaaaaccaagaagaacaatatagacagtgacataagacctacaggtactgaaatggtaaggttctcatacacagactttaaaatagctcataaatatgtttgagaacttaaataatatgtaagaattttagcagaaaaatcagaaattatgtaaaaaataaccagtggaaattttagaactgaaaaatagaaaactaaaattaagaacttaacagtctaacattagattagtcagagctgaggaaagaattagtgaactgcaaggtaggtcaaatgaacatatccatcaaagatacagagacaatgtaacagaaataaacaggagcagaggtctcatatgtgtcaactggaatctcaaatgagagaaaggagagaatggggcagaagctatatatatacacacacacacacatacacacatatacatacatacatatatatacccacatatatacatacatatatacacatacatatatatacatgtatatatacatacatacatacatacatatggctgtaatggcggaacattttcaaaactaaagacagcaagtcacagattaaaaaatgctaagaattgcacagaaactacaataattcagcaaagggaaaaagaagaaggatgagggataaggtaggcgtggcaaaatcttgataagaattactgaagctggatgatagacatatgaaagttcatattattctatttttgtgtacatttgaaaattttcataatcagggcactggattttactttttcacttttagaaatgatggacttcaggagatagcctcaagtttcaaaagatttggaattttactaaattttgagccttctgtagaaataaaatgatacattcaatgaacagtatataacagccttccaatgctgtttcaagacattagacagacatagacttgatagctagaataatagcagagggagcaacagcccacagtgaacattaaaaggcttcgctttaggtcttaaagcaaatgtagaaactcagtgtcatatgccaggagtaaacgggacaaagaggcatgaagaggcacatagagtcagtcttctgatgttccttaggctctgtttaatttaaagcagctgttttatggaagttatttatgcctttgtggtaggataactttattagtaatatgatatatttttgttgctgggagggaaaaaaaaggtcctaacatcaggaaacaaaaccaaaggggaaaaaaaaagatgggccccacagtcatgaaaccacctcagaacacggagaactacttcttaccatgaccttaattcacccaggctgctactctggagaggtgctgtttcccaagtgggtgatgaatcactgcttctccatcacctctactgctgtgctttgttggtgacagggagatcagggccgtgaattcttgtttccaaaagaaaaagaacttgggttccagcccagactgaaccctcagctcttgtttggtttctgatatgtactattggcctcatatcattaagatggatctgcactcccccatctctatgtgagtaacagaaagaaaattcgtggtgtcacacaggatttgacaacatcacagtgagattttatctaatgcaatgaaatttttcttgcatttcttttacttcataaactgagatacatttctacttctcttaaaaccttccaccaaataggtccttcactcaaaaggtggggtttaggccaggcgccatggctcacacccttaatcccagtgctttgggaggccaaggagagaagactgctccagggcaggagttcaagtgcagcctgggtaacatagtgagatgccatctctacaaaaggaaaaaaaaacaatttaactagtcagccatgcttggtgttgcacagctgtggtcccagctgcttgggaggctgaggtgggaggatcacttgagctcaggagtttgaggctgtagtgagctatgatggtgctactgtacttcagcctaagtgacagacaagactatctctacaaataaatacatattttttttagaagtagggttttcttactcttattagtttgacaattaagagttactttgcacatgatccattattagaatctttaatcagataagaataaaagagactttcaattatctgaaatgtccatgttattcagactcaggagcacagagggtaggaaagcagtagataaattagaatgaaggagatacaagatttgggctgaagacatggctcttccagttagttgaatgactatttcacaactaatgtgataagagattggagagcatctggaaatgtatacaactccatacgaacacaaactagtattattaagtttccagggctagtaaatgtatggtaattagtggaatgcactgttgcacccacatggagattacacactgggttgggggtggggagaatcactaaaaaaaaaaaaaaaaaaaagcatgatagcatcaaaatggtcattttccacagccaaaaacaaacaaacaaaaaaacagaaaaccacttgaactactgctacatttgcctgtttcttttaaaatacaaggggcttgggcagcaacacacaggaaagcctggagtagttgagatgattctgggtgagtgtcctcattaagggaaagacttatgttgcagataggactaagcatccaataatgaaccaaactggggttttggtctttccttctagaaaacacactgagaaactcttgcctatatttgtaacttttatattaagtgtgttcaattattttcacttcacactggacttaaaaatttcctcactctcatgcccgcgagcagcctggctggcagcagggaaacctcaggggctgtgtggatggccctcagtgtggcgcaggggtgaggactggccagcatcttccaggcaggcaggacagtcctccacttcatgtaaacagtttcctcttgaagactcctaacagtgataatgctgtccttttgcctgtctcatatatgacagcactatttttttagagtgtgaaacatttgatgacatcttgaaggatttcaaaaaggctggctagcacaactgaagtataaaataaccataatttagtttaatacatccttgagaaaaaatggtaatgagatattccctacaaaaactgcatttattctgtatagtctatccttgtgtgggataaagttctgaatgtacacactcaagccctccaaagatggtcatatcattcagatcattcctcaagaaacttaacagcagaaagtttaaaattttcagaaaattttaaatttatttgaacgttttagttcaagtttataaaagttggtttatattctactcctagaaatgcagcaggcatggtagctataccgattcaatgggagcatactgaaaacaatgtagaacgctcgatgaaatattctaaaaagcagtaagatgctggcaagataggaaggcattgtcaggccagaatgtgagtgaagaaggactcctgacaaataagcagaatagctgaactgctggtctgctggagtctctgtcctcctctgctctgtgggacttgggggacaaaagagcaagcccactgtctccccagcaggatggggtctagtaggaaatccttcctttcgttcaacttatttggaatggtaagtaagacatgattgccggtaacagaaggaaacagattacatgcaagagtcccagagagctgacaagcagttgcagagtggaagctgaaagaaagccagtggaatgacatcttccatgttctgaggaaaacaaactcctcctctagaattctacatcccaaaagacatctttcaagaataagattgaagagctgaagggtgcagggcttctgatgatgatgaaaatcttctgaaattgactgtagtcatggttgcacatatattaaaatatattgaaaaccactgaagtatacactttaaatggataaatccctctccctctccccacagtctccctctccctctctttccaccgtctccctctccctttcccacggtctccctctccctctccacggtctccctctccctctctttccacggtctccctctgatgctgagccgaagctggactgtactgctgccatctcggctcactgcaacctccctgcctgattctcctgcctcagcctgccgagtgcctgcgattgcaggggtgcaccgccacgcctgacgggttttcgtatttttttggtggagacggggtttcactgtgttggccgggctggtctccagctcctaaccgcgagtgatccgccagcctcggcctcccggaggtgcagggattgcagacggagtctcgttcactcagtggtcaatggtgcccaggctggagtgcagtggcgtgatctcggctggctacaacctccacctcccagccgcctgccttggcctcccaaagagccgagattgcagcctctgccccgccgccccgtctgggaggtgaggagcatctccgcccggcagccgccccctccaagaggtgggggacacccccacccggccagccgccctgtccgggaggtgtacgcagcaggtcattgagaacgggccatgatgacgatggcggttttgtcgagtggaaggggggaagtgtggggaaaggaaagagaaatcagattgttgctgtgtctgtgtagaaagtagacatgggagactccagtttgttctgtactaagaaaaattcttctgccttgggatcctgttgatctgtgaccttacccccaaccctgtgctctctgaaacatgtgctgtgtcaactcagggttaaatggattaagggcggtgcaagatgtgctttgttaaacagatgcttgaaggcagcaggctcgttaagagtcatcaccactccctaatctcaagtacccagggacacaaacactgcggaaggccgcagggtcctctgcctaggaaaaccagagacctttgttcacctgtttatctgccgaccttccctccactattgtcctatgaccctgccaaatccccctctccgagaaacacccaagaatgatcaataaatactaaaaaaaaaaaaaaataaaaaaaataaatggataaattgtaagctgtataaactgtctctcaataaatctcttaaaaaggataaagatgaaataaaaatatctttagacaaagaaaaattgaaaatttgtcaccagatcttcacaaaaggaatttctaacattttagttgaaaggaaaatcatcccagatggatggtctaagatacaagaaaaaatggacaaagagaatgcttaatatgggcaaatctatgaatactgacaaaataatttttgtgggttaaaatatggtaaaaattaaaatacacaacaattatagcatatgtatcagtaggagaaacagtagtattcaagcgttttaaagcctctctacatccacgaagaccgtaagaaagtaacatactttctttacaattctttaaacagttcatctgtgacttatatatccttcacaatatgtgatttatttaataattttaaaagtcttaattaagactttttaatgttctgtttaatgtaactgatttaatgttctgttttaatttctgagtacaaagccagtttgcggagagcagtcaggttaataggtaatctagggatttaacgatctcaaagattgagtgttacatcagtaagaaaggagcattgtcgttaaaaaaaacccataccttttccttgtttggaaagaaaagaggagagtcataaaaattaaatatgaataaaaagctgcacaatttactttaaaatagaagatgaaatatagtttggcatcaatgagcttaccaagccgtatgtatctgtatctacaatgttgtttaacaaccctatactcatgtgatgttgttgacatagatttcagtagtgttactggtactttattgaaatcaatcactacagatgccaagtactcagagcccacagaccttgaagaagtcataggatgggtttccatagcacaggtgttggaaggtgccgtattgtggtgctgggaagcagagatgttctcttctttgaagattttcaaagaaaaaatatagcctgttgtagcagagcagctagcactgcttagatgcagaatcatgagaaagtgaggcgatagcagaggctggtaaactccacctcacaagccaaatcccatgagcaacatgcttttgtaaataaggtttcgttgggacacagccgtgtctattcatttacatattgtccacagctgctttcaagctacaagagcagaattaagtaggaggatgtatggcttgcaaagctgaaaatatttactacctggctcttcacagaacagttgctgacacttgctctacgacaaaggagttactaaaaataagaggccaggaagaggatcccttaaaaaaatgatcgtaatggacaaccatgaataggtctgggaggtggggctgcctagttgtctgcatcactagtaagaataatggtaattacagtaacagcagttcatacagttagtgcctttgcctcatgtcaggcactgtcctaaggactttgagttgaatttattctaaaaaaaaaatcttattcaagcagactctggtaatgatggtgtaaagtaattagtagttcttgtccatagaaaatgagtacaaaactagtcaaaattgccaaaggcaaccactttagggcatcagaaattgatctaaggtagacaaaaaattgagaagtgtttatttttttaaaaataactatattttaaggtaagaaaatcaggattctatggtcttcttgcctgaggctattcccatctaccattcacccccaagtcagccttagaaggaatgagaccaactctccgtatcacctggataactgggaaattgcatgtacacaagggagacccaaaagaacctcatcaaaagtaaaaatcagaggagatttgaggaccttaaatgtatcttctcacacacaagtgaccagcagagtggaagccttataggctcaaggtatttcctagaggtccccctgtgtcttctgcatagcttaatggtctgcccacatcacaaaaaagaagaaaaagaataagacactaagcaaagacaatactgatgagctccactgcgtactccacactctgcagctgaagtccaagcaagttacaaaacaatacaccacaaaatgctcaccaactactctcagaacaaaacagaatgcagttataacacattatttaaaatgttcagttcccaaaccaaaaccaccagatatactgtctctacaccctgcccccaccccccaaagaaataaagacagagggcaggaaaatgatacaaagtgtcaaaagaaacaaactattaaccgagatacctatatccggagaaactaccatttaaaaatgaaggtgaatatagtaaagatgatgagtctctttaaattgacttagtgaaactgtaataaaaatccaagcttgatatttgtagatatagacaaactgtttccaaaatttatatggaaacacaaaggaattacaagagtctaagcaattctaaaaaataataaaattggagggctcacacaatccaattttcagatttactagaaagccacagtaatcaagacagtgtggcactggcaaagagatagacacaaaatgaatggagcacaatagaaattcaagaaattgattcacacaaatgtagccaattattttttttttcccaaaggcataagaacaattcaatggagtaaggatggcatttttaaccatcttcaacaacacctgttatctaccttttctattatatccatcccagtgggtgtgaagtgctatctcactgtggttttgatttgcatttccctaatggttaataatgttgaacatcttttcatgtgtttatcagccatttgtatatcttctttggaaaatgtatagtctagtctaggaagaaaaacgaacttcaacctgaacttcataacttatatatcaaggtcaatgatgaggccatgaactcaaatagatcattgacctaaatacaaactcgtaaaaattttagaagacgtaggggaaaatcttcatgaccctgagttaggcaagagttcttaaatatgacaccaaaaatatgattcataaaagaaaaaaatggaaaaatttcatcaaaattaaaaacatctactctgtaaaagatacatttaaaaaatggaggcctggcgtggtggctcacacctgtaatcccagcactttgggaggccgaggcgggtcgatcacttgaggccaggagttcgagaccagcctggccaacatggtgaaatcctgtctctactaaaaatacaaatattagctgggtgtggtggcatgcgcttgtagtcccagctaattgagaggatgaagcacaagaatcacttgaacccagaaggaggagggtgcaatgagccaagattgggccactgcactccagcttgggtgacagagtgagacactgtcccaaggggaaaaaaaaaaaaaaaagaaaaagaaaaagaaaatggaaagacagcttacagagtgaaattatttgcaaaatatacatcagattgaaggcttgtatccaaaatatatcaagaactcaataaaacaaagccaaaaagaaaaggaaaagaaaaaatggtcaagagacttgaatagacatttctacagagacaatatatgaatgccaaatatgtacaggaaaaaatgatcaacataattaggtaccaggaaaatgttttccaatgagcaccaccacgtaccctttaccacaggtcaacaggctagttctccatcctccctctaaaccaaatatatatgacttctcccagattgtggaagtatatatgcatttcctatgcttaattagataatcaaatccctacttagagctcaaattactcaaattactcaaattacaagttcctttagtcttgttcctagaggtgcctctgcagctatgaatcttgttttatacttatcaacttatcaacttgtaagattttgacagtttttggctaaaatcaaacaaactatcaatactattcttttgtgtttgtgaagatgtggaagaactggaaccctcatatattgttaataggaatataaaatggtaaagcactttggaaaacattttggcaattacctaaaaagttaaacagaagactcgagtgagatggtcaaaagatctgactagatatttttccaaagaagatacacaaatggctcataaacacctgaaacgatgctcaacatgattagccatcagggaaacgtgactcgaagccagtgtagtaccacctcacacccactaggatggggataaccaaaaagacagataataacaagtgttggtgagcatgtggagaaatgagaaccctcataccctgctggtgggagtgtaaaatagtacagccactttggaaaatgatctgtcagttcctcaaaacattaaacgacagagttatcatatgacctagcaattctacctctaggtgtgttcccatgaaaaatgaaaacacaagtccatgcaaaaacatgtatacgaatgtttatagcagtgctattcataatggcccagaaatggaaacaatccaaatgcctatcattttataaataaacaaagttgatatctccgtatggtggaatattattcagccatgaaaaggaatgaagtgtttatacatgctacaacatggatgaactttaaaaacattatgctaagtaaaagaagccagacacacaaggccacaaattatatgattccatttatgtgaaatggtatatgacaaatcccgaataggcaaatccacagagacacaaactagattagtagtttccatgggatgtggccaaagggggttggagatgactgctaacaagcatgaggctttttttttgcatgaggcaatgttctggaattaaattatggtgatggttgtacaaccttgtaaatatgctaaaaaacccactgaaatgtacacttttaaagtggattttatggtatgcaagcgctatctcaatttttttaaagattaaacattatgcccctgaattccattattaggaatcaatctacttatgagaaataaaaatatatgtccatacaaggtcttatatgtgaatgtttacagcagcattactcatcatagccaaaaaagtggaaataacccaaataatcaactgggagtagataaatatgatgtactatatccatacaatgtaaactactcagcaataaaaagtaacaaagtactaatacatgttacaacatgaatgaaccttagtaacatgctgagtgaaagaaagcagtaaagtaaggctacatatatgattccattgataggaaatttgtagaaaaagctgaactatggagacagtaagcagaaatgtggttacctggagctgggtatgggtatgaactgactgcaaacaggcctcaggaaaactttggagatactagaaatattctaaaaatggattgtgagaatttttgcacaaccataaaaacttctaaaactcagaactgtacaacttataatggttgaattttatgatatgtaaattatgcttcaataaagctgttaaaaattaaacaaccttatgagacagatactattattgttgccattttagcaatcaggaaactgaagcatagacagattaagtaacttgctagaaaatggcagagctattatttgattccaggcaaaatgattacggaattcttaaccactaaatcaaatccagtgtaatttgctaactataaagtatagtactgggaaaattgagaaaaatgccaccttcttccaagagtcaaagaatgatcacacattgagggcactatttatatacctaactctctgcaagtaaccccatttccatcctctcttattagcacaccaatttgcaaggtagttgctattacattaaaaatatacaatttaaaacagttcagcacatgtgtcttataatggtctcctccaaattccatagcgaccattaaagaaaatatgtctgggccaggtgcgctggctcacacctgtaatcccagcactttgggaggccgagcactggggtcaggaggtggagacaatcctggctaatacggtgaaaccccgtctccactaaaagtccaaatttagctgagcgtggtggcatgcatctgtaatcccagctacttgggaagctgaagcaggagaatcacttgaacctgggaggcagaagttatagcgagacaagattgtgccactgcactctggcctggatgacagagtgagactatgtctcaaaaaaaaaatattaactaatcaaaattttttttaaaaaagaaactatgtctgatacctacgcattcagagctttctttgctcaggcaccctctcctctcacagtctctgaaggccaggcaaaaaggctagttctttaccctccctctaaaccaaatatgtatcactccttctacattgtggaagggtatatgcatttcctatgcttaattagagaatcaaatccctacttagaggtcaaattactgtagttcctttaatcttgtctccagaggagcccctgcagccatgaataatcttattccattcatacttatcaacttgtaagattttgacagtttttggtaaagcacaaacacatagccataagtactgctcaagcagtatttttcaaagggaggaagaaagggaaaaagatgagggaagagtaaacgttcatgaaaagaaagatttctcccctttgggaatctgtttattttgccattgtcaaagtgaggcaggaattcaaacacctgacggcatggaagtggcaaaaccatgtgggtttgacttgatggtcctgagaagctgctggcaatgctttttaaattctgcaaatataattaatggcttgtttgctattttggcaacttaaagcaggggctatgactgcctgtgacaaaatcagtaattgaatgattaaactagatactcacagtcaaaacggcatctaacaatttacctctaatacaacattcccaattaatttttaaatacctattaagatataaaaagatttaaatataaaaaaattaaattcaacttaaaacactttaaaactagggccaatgcctgagtctagaaagagactacctaatgccagagtctaggagttcttctgagccacaattttgctgagggcaatgcatagtgaaacgctatgagggtaagactgcctggctgaaaagagtgacaaggacccttcacactgtcagaatcatggatcagaaatcaagtctgcaccaagcaagaatctgcacaactgtctgtgcaccatgtggggctggcttctacagcagacatacgcagtcattttggtccctctctcctcagccaatatgtttattccatatacagactttaacttctgggaaaatgcagggtagagagtggagagaagtggcaggaatggtgtcacattgaatacgggcataagcaggtatcatacataacgtgataagagaaggctgagatatgaggagccttcacagaagtacattctacagtattcagttttcaaggtactttgtttcatgtaccagaaaagcaagctaagagaagatgccatttcagtcaaccagttcccaatagataaaaatacactggattgtgagaaccagctgtagactgagcatatccatctgttgtccagttacagatctgatgagggaatccaaagagcactaagccaagggcaacttgtgtaccatttccaccagcaaacattaatgctgaatgctttcacactaaaatgggagaaaaagcaaggatggctgtcatccatactcatattgaacataatagtggaagtactagccagtgtaataaggcaaaaaaaaaataacaggatatagaatagaaaggaaaaaataagctgcccctatttacaggtaacatgattgcctatgtagaaaatcccaaggaattttcaaaaacatttctagatctaataagtgaattaagtaaagcagcaggacaaactcaacccacgtaaattaattatatatctacagactagcaagacatacatgaaaaccaaaataaaaaacacagtaacacaaaattacttaggtatgaatgtaaaattgaatacttagatacacacctaaaaataccatgtacagtatctgtatgctaaaacatacgaaacacagatgaaagatctaaataaataaagagccacactgtgttcatgcattggaagactcaacacagtgaagttgtcaattctctccaaattgatatataggccaaacaatttctatcaaaaccccaggaagagtttttgtagctatagacaagagtattgtaaaattagcatgcaaaggcaaaggaactagagcagctagcacaattttggaaaaggagcaaaactagaggattgatgtgatctgatttcaaatgtttctagagaagtacactactgaagaccagaagtagcaagcactagttctcatgctaattctgcgatgttcacttaccacactgctgccctgtttccagttttccactgtactttggaaaagctagtttggaagtgttgcaggagaggtatctaagcatctatgtatggcaaatggttgttctagtcatctactgctgtgtaagaaaccaccccaaaatgtagtggtataaaataataaccattttcttatggtcacatattctgtgggtcagaaattcacgaaggatacagcagggatatctcccctctgttctattatatctgggcctcagctaggatgacttaaatggccaagggtgtctcaaaacagctgcagctcaaagatctatttccaagatggcttcttcattttcacctctggcacctgagctcaagtgaccaaaaaatgaactcaagcagggactatcaacaagagtacttaagtggcctctccttttaggttctcaaaacatggcagcttggttctaagagggaatgtcacaagaatgacctttctggaaagccaagtgttgccaaggaccaaggcagaagctgcaggggttcatccaccctagccttggaagtcgcattgattcacttctgctgcattctagcagttacaagagcttcatttagggaaaaccagattcaaggggagggaatttagactgaatttttttttttttttttttttttgagatggagtcttactcttgttgcccaggctggagtgtagtggcacaattttggctcactgcaacctccgcctcccgggttcaagggatcctctggcctcagtctcctgagtagctgggattacaggcatgtaccatcgtgcccagctaattgttttgggttttagtaaagatggggtttcactatgttggccaggctgacctcaaggttggatcgggtggatcacttgaggctcaaactcctgacctcaagtgatccacccgcctcggcctcccaaagtgctggaattacaggcatgagccattacgccaggccagactcaattttttgatggggaaatggtaatgttacattacggagaatgtggaggaggagatattgtagtggacatcttttgaaaataccaattgtcacaatggttacagtaaaaaaatacaggagcatttaaaaaaaatcctccactaaagtaatttccactttatccaggtattatgttataacctcagaggctctctaagtcctttcaatcaacagactaagtttttatcactcacatggaaggttctattatacttgcagatgcaatactgtgcctttcacatgctgcccgctaggtgctcaaaaggccaaagaagcattaatttacactcacttgcctactcccaccttttgggtgggtgattcctcaccataaggatccctttgcccaacccctccccatccccttggtgttttctttcaagagacagggcacctctcccccagagagagagcgagcgagagagagagagagagtgcgtgagagagtgagaaagcgagcaagagagagagcaagagagagcgagagacaggcagacaaggtcttgctctgccaccggctgcagtgtagtgctgtgactatagctccctgtaacctcaaactccttggctcaagagatcctcctgcctcatcctcccaagtagctaggactacaggtgtatgccaccatgcctggctaattttattttttttattttttgtagagatggagtctccctatattgcccaggctggtctcaaattcctggcctcaagcaatcctcccatcttggtcttccaaagtactgagattacaggtgtgagccatggtgcccagccagaattttctaagagccttttaggatgcagctataccacggttacatttattttaacttgtagaagttttgctttttttttttttttttaaaaagcaatcactcttggagatactagatactacaactattacctaaaaacttaccatgataactagttgagaacaaagctttgtaaggataagcactgagttgagttggggtgtggacgggggggggatggtggcaacagaatattaagaagaaaaagaagcctacggaaacctgggtatgatatcaaaacaacaaagattatactacctaataaatgtaagtacagtaagtatggcatctttatacaccacaagccaaattcacatccactacttcattgattaaaactgtacagtttatcatgttgctaacgcaatgtagaacccaaagttccaagaggcgaggtgatttggccaagtcttcacggcgtgaaagggctgagatcggaactcagcctgtgcttcctgaacccagctctctccagccatctcattgcctcactgaacctcacctaacagtcatgtacgttgttaacttcttaactgaaatatttccaatcaatgcaagaaccctaacacactctgagaccactgagtacaaacaagctggcagcccagcatcacccgtcccacagcgcccaccaggagttcacacgtgaagcctaattcatcccttaaaaaaaaaaaaaaagtgttagaaaaatgtgaaaccaatgaatctgccagcatggttgtttcacatagaaaatctggaatccagcatctaaataaacggtagaatactgttgctaccagctgtgattccatttaagacaccatttgtggaaaatatttattatggtcttccattttctcagcacaaaatcaaagaaaattgagaaatatgaaattacattgtcttcaaaaatcctgtcatagagtaactcagctctcacagctatcctctgaagatgttattgatgttctaccaagttgatggagtaatataatttgctagcaggaaaaaatgctggcaaacagaattgtgttcattagagcggtatctttacaacgccttcttccactttcattacttttcaagatcacacatcatgtcacagggccgaaccacagccttgctatgccctggatatttcagtatttttttacagttggaagcagattcttaacgcttgtgcaaattacagctatttttgctaaaatgggctcatttatgctgctggggaaaagaagcctctctgtctccctctctctgaaggtctatgaggcagctctttacatgtagctcccattacttcaggctcgtaagttcccgcgggggcagtctcttccataaccaatcatcagacctagcgctggaccagttcacatccacactgtgaagtaagcatcgtttgtctttactccctttccatccctcttagttctgacaagttttctctttcacttgggctgaaggactcaccaacggccttcttagtgtggcctcacaaatgctgccttctccagagcagctttctccagaagttccctctttacccagtcaaaacttccaagcctcctttagaaaagtctgatcccatcagggtgttaaaaaaaaaaaaaggcaaccttattagatgaaattacaggtgttaatgattaataatttcatagatgagtttagattttgagggagaaattcttatcaactcaaaacaatttttaataggtaaaatttgaaacaacacaactacgtgctgcattttcatccgtgggaaggaaaaggatttttgggcacaagcgactcccagattcctcaaaagcaaaccacggagagttgagcttcatgtgtgtggtagaggttcaagcacggtatagggagtcgactttcgaactgggcattgtactggtcacatgctcaaccttgctgctgaagtgtcctttaaatcacttagtcctgggaagcaaatgcaagatgcatggatgggacctgaccagattagcacagggaacagggcaaggagaatggtgagcagattaacacagggaacagcgcaaggagaatggagtctagattagcacagggaacagggcaaggagaatggagtccagattaacacagggaacagggcaaggggaatggtgaccagactagcacagggaacagggcaaggagaatggtgaccagattaacacagggaacagggcaaggagaatggagtccagattagcacagggaacagggcaagaagaatggtgaccagattagcacagggaacagggcgaggagaatggtgtccagggcacctatgaagcattgcttctactttctgagctgctggaatagactacaagctttgtggtctgcattcctctacttctactaagcgttcacatgactcgggaggccagatgttattcctggctcatgcctactaggttaaaggagtgggggatgctttacttccaattattgaaatgaatcacagactgtttagagccagaaggaagcagagatcacctgcttcaaccctgtcaccttaaagatgatgaaatagcctagaaaagttgccctaggcccactcaggccatgcagcaagctctaagcccctcagctctatcaagttgggtacacaaaaggtgcttaataagtgttggctagcctagtggctggattcctgaggtctgcttcctagttccatgctcctttcattataactccctcccatgcccaccatccccactcccacattcttcgttccagtctctggtggaaaacaatcacagaccatgccagagtccagaataagaccccaaagtgagttaggggacggtccacttactcagttacttatgactctaattatgtgccaagtggtgccagtgtgccactgctaattattactacacaggcttcagaaactgggccaattctttcttccttccaggaggaggtttggactaggggaccgagaaggtggctctcaggaaagcattccgaaagtttctctatcacggagtatcctttgaaggtgaagtcaagaactcctcttggaacacggcaccaggagcttttggagtcccggatgcttgcggatgactccccttaatgaaatgtaggtatgacaaggtgtacgtggcactaggttcagaccatgataatgtgccatttcggggacctgaattcctattatgatgtaagtcctttcagagagactttcataggcagctccctaatgaggcaaaggtctccgtagctcctcacgtataaatggaaagttgttgcacagaggaacagggccctttctaaccaagctagcagggacaggaatggcactagaacccagtatatttctgcacagactcaggatttttaatagtctgcaatacggcaagctgtaagcaaggaaatattccaataaaaaaataaaatacagactaagaagaaagccacagtcaatatttgattatagaattcaatgaatgattggggtaatataaacaggggatgacccccaaattcttgatgttggcctgaaagtattgtttttatttatatttaagtacaattgtgtggtctgtattctggaaatttccttgaaactaaatattggtgccaaatgaagtccacagagaattttataagctctatattttacctatttccaccattttccaattctcctcaacacgaatagctgacttctttcactgctcccaaaacattgttgggacaaagatggtctatgggttaatggatttccctgctcaggctttgtactttctagctggcaattatagctccttacatactattgattaaagaaaaattccatctctggtgttgcatccacctttggaaaagtgaaactagaattcattgaccagtttgttcatttatttgttcattcattcattcatgcattcacattacagattccacatttactgagcacccattatgggccagacactacagggataagctgggaaataagggagaccacggttcctgtcctcatggatcttacatcactgtggaagggccagatactggaaagtattaacaagtctggtgagtactgggcaggcttcaaaagggacctacagtagtcagagctgctctagagagtcaggaaaaacttagaagagacactttcattgggggctggtagatgagtaaaaattaggctgatgaaaaaacagtaggtggaaaacccccaggggcacaaaacagcaacactgagaattcaacgaactgatggaaagtcaagagtgtcccaactatagaaggagagctgcagtgaggaatgaatgaatgaatgaccctacttgctagattagtggaatcaaccccagtgatgaatggggcaacacgggcagagcccactcttatctacccactggggcactaggtccaagtgaggggagaacccccagagtcagggtcggcaaagcttttcgagggcagcatctgcaccttgagggcaattgtactttctatacttggctccaaaccaggcacacagtcagcacctaaaaaatgtggatgcttttagaaaagacagagtcacaagcacataattagagaaagcctcttttggtcagagggagagcctcatttctgaagcaggaatttctgccacagataagccacaatgggggatgagtgtactctgtgattctttggctaactgaaccatttgcatggacactgctaattttgggaaagatgactgaacagctttatgggtcaaatttgagactgagttgtagagccagatttgaatccaagactggatgactctgttccatctaatcatcaggctcattcatttccagataaaatgattttttttctgcttactctgctttcctgagcaaactgtacttttcagttgcaaaatattacatttacctcaaagcccagggaaaataaaggtaggtgatacaaatgacccttttttgtgactgtggatgtgaatttggtctctgtcctaagaaatgatgtgcaggaactggggagaaaggaggaggccatggtgaagctcaccacccaggctgcatgtcttcaataagctacaccatgaaaaagctacatccctaccagacaagcaattcctcccctggtatccaaggtctcagtgatttcatcaagctggccactttcttcttcatccacatgggatacctatactaaactactctgggcatcttatggggaataaaatcagttgggggaaagagagcctattatgttacctaggaaaagagatctggcaagtatgagatgctttccaaattcctcttgggcactaaagtactacttgcaacacttattaatgcaacggatcagtttatcctgctaacaccatgaggataaattgcaaaacagcatatggaaatggcaggagtctcaaactcagggcatggtgacactgtgtctctgctagtaatcaaggtttacgtgctcactgtctgtgtttttcttgaacagagctgtggagcacgggtcagccagacagattatcattttctgtaagtaacaagtttatctacctcttaggaaaggaatggggggagaggacgggagaaagagagaggggggcagacagggggcctgtgcatgctcatgagtacatcagtcggtatttgttctgtagaaattcaatttattcaacaaaaattctggtctttttagccttcagctagattgtgtctgatacgcagaggtcacatgtgtttggaagccactgaaaacctcctcctcttgccttctctgatttctgtctctagaattatcgctgcctttcttttctctgggccactcccttccccattatcagctctcctctcatgctttctggtagttctcactgtcatgccaatgacagaccatctgattagactgttttaaacattctaattttaaacttgtgtgtgtgtgtgtgtgtgtgtgtgtgtgtgtaagcggtatacgtattcccaaaaggctgttcgatgaaatttgatttatgtcctctttctgggcttactctcaaatatatatgaaagagtgctgactttgtacctagagggtttacaactgagccaactcattcattcattcactcattcatttattcattctcttcaaggaatatttattgagaacccacaatcagccaagcactcttctagatgctgggtaccgctctagatgagtgttacctcaattaatcctcacagtaaggtaaacattattactctcattttacagatgacaaaattgcatctcacagaacttaaatataataattggcctaagccacatagctagtacactgcaaaactgctctgtatctaacttggatctttttaagatgctctcaactgctagcagatagggattctcttggtaatcagattttgtaaattaccatgcctaattctttatgccacaatagactccaaaaacagacttattaatgatgacagactatgggcaagattctgatcactttgagaaaaagacagaaaaaaaatttttttattccacaacttctcagttagcatggaattctgacattccatttgtttatccactttgggggtgtcatgataatggggaacatagtccatcaacatatctgtaagctaggacttcattaatatttgttacaatgaacagataaagttgtctatcgctaacatatagcttctttacaaacagtagctctaatcacagttaagggtgcagacatgatctgcagggtttgggtggacgaagggagagggcatgagggacgacgtcgaagttcaaagacaacgaagtctcctcgggattttatgctggctcagctcggtcatctcagtggctgctgccatccagtaccataatgatgacaaaatatgctctcctaagttataaaacactgtgctgaaagtaagaatctctgataaagccttgagtttcagaagacttgcctcctgccccttactgcatttctagttagaaatatcttccatataggccaggcacagtggctcatgcctgtaatcccagcactttgggaggccgaggcgggtgatcacgaaatcaggagatcaagaccatcctggctaacacggtgaaaccccgtctctactaaaaatacaaaaaatgagccgggcatggtggcgggtgcctgtagtcccagctactcgggaggctgaggcaggagaatcgcttgaacccaggagacggagcttgaagtgagccgagatcgtgccactgcactccagcttgggcgagactccgtcccaaaaaaaaaaacaacaaaaaaagaaatatcttccatttaaagtttcacttgcatacttgcatgttttcccgctggcagacagagtgtaacaacactaatttgaccatgctttccagagcatggcggggcaggaatgaaaaccgttgtagccacttcctccctactgccaaggctccggcttgcttcgtctctcaaatctccacctgtcactctgtaatgaatgccacccagaggtccacatctcattttacccatcagtagcacacactactgtttaccatcactttcttcaaaacaggcccctcttggtctctcaatccctgccctcccctgctctgcccagtgcccccccaactgccctcacctctatgctgtacccgccacacctctcaaaccttgccctcccatccatatagctattttctgcagggaccaaccatattagcttaggctaacgtgcaaatccctgaccatggcccacagccccacatgacctggttcatgctttcctctcttttataaagagttttatctccacaaatgcttcatctgccctaaagtctatattgtttgataatgacagttaacccagctttcctctgattaatgtggtcttgatatatctctatttcatctcattatttttaaccccttggtgcagttttcttcttaagcagcatgcaactgggcttaaaaaaaaccaaacaaaaaacctgtctcttaatatttaaatttcatcttaatcatttacatgtatggtgatatatgtggatttatactctccttatcatttttacctagtattttagtttcatctttcagtctcaacacagggaaagcagttgtgttcacattcattagtaaattctattttctgacatttcagcaatttctatactcaacactgttctacgcattctacaacttctctctgggtttacttttcttgtaatacacattctttttaaaaaattattttaacaagattccttgtacctcttaaaatatctttatttcattttcacttttgagagacagtttaactatagacagaattcttgacaattctttgctttcgcacattgaagacattccacgtgacctgacgtcactggctgttgagatgttctctcaatcaaattgaaatcaggttgtaagattctctgccagcgatgttctgaagattcactagtgtgtgtgtatttacatttctttgtattgataccactcagtacttgggggtatgctttgaatttgagggttcatgccttttaaaaactctgtcaaattgaaaatttgctggtcattcgttctactctttcttaaagaacttcttattagaaacttattggatagtctcaaaatatccctcctgcctcagctgcttttgcataattttaaaaaatgtctttttcctctgagctgcattctgggtaaattcctcaccactatctcttaattcaatgtatctttgtgggtttttttatttcaatgactatagttttcatttctgagatttctgattggttctgttcctattctcctgttcttgtttcacatatgtttgtcccccaatcccagtggatattatccatttttttctctttaaggatttggaataaattgaaaacttttattctataattttatttccatatggagtgaatttctgattgtgaatctcagtggttctctttttgatgctctatttctttatgtgttttggcatttaggtgtgcatgttcatttcagtggcaggttctctcccatctgtctctgtccctgtctccatttgcatcctacccccacaagtgcctacgccctcatcttgaacaggatcttaaatgctagctcaaggatcctatccccagtgatagggacattgcaaatccagtcactgaaccagcaggtggcttggctcaggccctggtcaggatcctgtgtctgggatcttatacctccatagactcacaagcttcatgtcgaccatcattccaggcataggtcagcagttacttttatcagcctcccatcatagtgaggatgtcctctctcatttatcaacatccccggttttcagtagtgagcctgactccacttcccatttcacagagtacatatctagtccctgttacattccaggagccaaattcccagccattttgcctcctttatccgagagccaggtagccagtggcttcagctccatcacttctttgcatttctcttctttttcagattcactcgctttgagcctagctatatctttttaatttcccattgttatattttgtctcttgtggcctaaagcatgatctaaccatgccagctcaccaaggagttccctgactttctctacaacctcacctcatgccacgggcccatgcgctccagtcacctcctttgctatctcttcagttctctggtcaatcaagatttctcccacctcaagaccagacacatgcatgaagagaaagagccaagcactgaacgctcttgtcccctctctccctaaatactattctcggccttttaatttcagcttaaatacagtctctctccctaaatactattctcagccttttaatttcagcttaaatacagtctcagaaggcacttttctgatcactctatcttagtaaccctatctcccaattgtttattaattggatccagttagttgtcttcagagcaaagttgcaaacagtcacaagatcgcccaaaccacagcttacaggccacacttctttttggtaagatgtacctacaccactaacattgacagtggtgctgcctacaaatataaaggtcaaggatatgtacaggtatggcccaatgtgaaagacagcagacttcttgggttgggaagtctgagtttcttttcaggactcagatgatgaaattacctggaacttaaggtattatgtccaataatcaaatagtctcttgtttcaatattttatcaaaaataaaatataataaaaccttattgggacgaattgggatgatgaaacatccaaattaatggagatttggaattctagattttttttttaataaaatggagactgatttcttgtaaccctgtacaacagcacagagtaatggtttacaggacactgccaaatagagaccctgccaggacctactttaatgaacagtaaagaactgtctatgatcaactatctttttagcggggatagcatgctgtaaaggcagcatgaatgggctagcatttcccctataatttcctacatatttatgattttcacaggaaacaatttttttccatctacagacactggaaatgtgagtatcagctctctctctacagtaccataaattcaaaatcagtgaggccagatcaatgaaatttgatacgcacaaaactcttgcatattctcatgtgagtgtggaggagagcagagtgtcatcaagactccactccacagccatagtctccgcatctgcagttagctcttttaggacagctagatcactgctccattctattagctccaaacatactgcaaccacctgttgaagctgggaaggctcagcatttttttctctttctcccactggctctgcagaaagcatcacaattccaattagtctgtcaaaaacgaaaggccatgacttaaggtgcaaaacacctatgaaataatgaatttggaaggacaggaggagacatatctgtaccggttagtgtactcaagaatcaggctatagaggaaattgcttctttggtagtgtaaatacaaagttttcaagaatagttactacaaggcactttctattcaagtaccaaattgtgagatacagaatatgaggggatttggtgaatgttttcctttgaacagggctttacttcaggtccatacccaaaggaatatcaatcatgctgctataaagacacatgcacacgtatgtttattgcagcagtactcacaatagcaaagacttggaaccaacccaaatgtccaacaatgatagactggattaagaaaatgtggcatatatacaccatggaatactatgcagccacaaaaaaggatatttcatgtcctttgtagggacatggatgaagctggaaaccatcattctcaacaaactatcacaaggacaaaaaaccaaacaccacatgttctcactgataggtgggaactgaacaatgagaacgcttggacacaggaaggggaacatcacacactggggcctgtggtggggtggggggagggggtaggatagcattaggagatatacctaatgtaaatgacaagttaatgggtgcagcacaccaacatggcacatgtatacatatgtaacaaacctgcacgttgtgcacatgtaccctagaacttaaagtataattatatatagatagatagatagatataaagaaaagaaaagaaaagaaaaagaaacggccaactctaaggagatttcaggtccactgcagacgccccctactggccggttttcaaagctatgccaagacatgtcctctcaattgcttccgggttccaaaaaaaaaaaaaaaaaaaaggtggatcaagacaccagcgaggctcattgcttgtggtctgcttcttatgtgttctagggaattttattttcaaaagctacaaagcttttcacaatatgggtttgaggatgctcagtacgtgagaattttgggttgaggtacagaaaccagataaagccttgttcatttgctcattcggcatcaacgtccagtgtgtcccaatgtaaatgaatcactgtctagaaagtagaaacattcttatttttttttttaaaatatgcaactcttggctattactggctatttcatattccaggaaagcacagaggattctgcactgagctgctgcaggcgagctcactcctacccagctccttagcctggcctgcgccatcacccagtagtgcctgtgtcgagctggtctgcagtccctgagccccttccctaccctcaaaagaggaagcaatttccagtgggagccagagcggccccggcccatggggaagggcagactgagaagccttctgagggaaggatcttgacctgtcaacacacacacgcgcacacacacacacacatacacacacatacacacccccacacacatacacacacataaaaatatgcacacacatacacacacatacacaacacaccacacacacacacacacacaccttgagccttccccatgcttaagagccacccagcttcttaatctgcccaccccagaaccaggaagaaagagggaaatttcaagagccttgggctccattctttgtgatgcccagatgtgttttctcaggctgggcttgtactggacgaggctgaacaggagcggggcagctacccctccgctaccactgctggcttttcctgtgcctcctgttgctcccttattagatgaccactcaaagcttaattcctctcttatgttgtttgaatctcttcagatcacccttctggccttcactacctattttcttcttcctcccactttctctcattcttttccccctagaacaccatcaacccctcagcccagccttgctcaggcccctcagaccatgccttagtgttcccggcaggccctgcttccaactggactcactgcagcctgatgatgtccttgttactttttcacacagcaaatatccatccaacaggcactcttctcttttcactcctgtctgcaccctcgatactcttcacagaacaagctctagccctctccatagcagagaacctgcctactcctctgagagatgataaatgctcccagagaggaatcagagctataggtgacagctccttattcctattaggtacagagaggttgaagggagagggctgggcatccagccttccctggtcctcctacacagctgtgcaaggagcacagcaacaagagcaacatcacagagagagaggggccgaggggaggggttgcagcagctcagcaggaaggtctgccatgtcccaccatgtctgatgcactcagttctctcaattctgattcctacactcagccctgctctcaactgtgtaggaccccaaaaactgggttctctaaagggtctgaaaacagccaatccaccacaatcaccagcaagtgctgttatagtccctctcttctcctttccaattaaatgaacactaaatggactcgaatgcgtgaagtctgagatatcatgacaagaagtaaatttagttactctgaagcaagctaggcaatgtgtgagtttatgcaaacaaacatttttatgttttattataaagtgtaacgaatgttagtcatgtgagtaaactgggtacagcacattgttctctttgtattttggctgctgacgctggtagaggaggcatctgtctgccctggattaacttctctgtggtatctgctaatgaatcagtgaggcagagaagcttcctgcaggatctcccgacctcggcacacctgtccacctgtccatctgcccacctcatgctgcagcgctggaattcacaccaatgaaccagtaaggcagagaagcttcctgcaggatctcccgacctaggcacacctgtccacctgtccatctgcccacctcatgctgcagcactggaattcacaccaatgtgcaaacagttggcatcactttgaagccactccaaggtggcatctgcacttaataacaaacaccctgcaaaaaccgctgtgcagccgtgggcctaaggtatgtgcccacttcatcagcctcattctgggccacttgtcctgtcccgcttccttcatctccccatgcctgtcaccaccctagctgttgtgcaggttcttgagtgtggtattttccctcctgctaccgggtcagggagagctcttctctgaggctggccagcccctccggtagttcactttactctcacaactgggctcccttcccatcacctcctgtttctacctaaaagcaggtccttccatcggaagctcttctaacagtgtatctttccttcctagctcttcatgcagttcataactatacactatattttggtaatgatgtcattgtctctcatgctagagtgtaaactgtctagtgatagggttatatatgctgggttttttttttaaataatgctatatctaatagtgcttggcacataggaggtactcaatacatatttaaatatttgtgacattaatgaacaaatggtattaaggatacagaccaagagagctcaagcagaaaacagaacacagccctgtcatgcagatgtccctacgtaaataagccattaacttctctagatcaagctggttgggaaaaatgacatctgtggataacaaatgatgaaaactttgttcttaaagactgttttgtacaaatgcataagaaaagactaagttttttttcctaaagcaagtagtggacatcccaacaccatccatgggagaatgagagacatctgtcacagggccccaggaacttggggaaggattcgggctggctgacaatgactcttttcttggccagtgtggctaaagagtaataccaccttcctgatgacaaagaaacagaaactaatagcagggcatactcatggttagttggacataattgtgtagaatgaattttatacagttttcattacagaatgtggggtgtagtaattctctgcaaattctttgttcattacataaaatcctgggttgaaacagccctctagatactattatgcaggggggccagaactgactacgtcttatttgacttttaaagtcaagtttctggtggacaagccaaataaacagccccacttaagagaattcaatcctaaagaagtttatttttgtctgggtgtgctacgtattatactagagccaattacaaatgtttaaaatagctaaacttttaaaaatgtgtttgatgcttttatatgcaaaagtgttttcaaaaacaataatagtgtcaataaacagagtatcggatttgacaaggtggattgttaagtggttgcaaactgttcccacaagacgctgatgagtgcatccctctggcctggagggcatggaatcaggccatcatttctagccacggtaactaaacttacttcttgtcataaatatctcagacttcaggcattcaagtctaagtccatgatttagatgaagatatttaagacatgtttatcaaacctgcagctgctacgaagctcagaggaagggataagagctcttataatcttggccatggtagttaatccagcagactctccatttcttcatctataaagtgtgacaatgatttcgattttgtagggttattgtaaagaattaatgagccaaggtatataaagtgaaccagtaaagttagttatcttcttttacacaaagaatagcagaatcaggatttgttaaaaaaaaaaaaaaaatcacaaaaactcaagttggaaaaatgggctaaagctaataattgtatcaataaaaaagggaaacccagcatgtagctttaaaaaaacaaaacaaaacaaaactctgtggaaggatctacaaaaacaacgacacatgaataaaacaagtaagttgtttaaaaaaacaccaaaacaccaaaaaaaaaaacctttgagtaatgtcaccaaatcgtgttcttccaaaatataataacgccatttgtagactcttaagacttgttatatataatcaatcagtcctactgattaaaggaaggttgcatgttttacaaccttagggcagagattcctggtggactgacgttaggaatgcgtaaacaacattgtcaccaatgtattccactgagttctattttataattacttatttaaaataatttgagttgctctcatagtaaacctgcatttaagcaacaaaattactgaatacccacagaatggggagatttgacttggtagtgttcctggcatggagttctagaagttctcagtggccacaagctcagcaggagacaactgctgtgaagccattgaagtcttcacctcaactacactagtcctagggccagagagccaaacgctgacctccccctctccccaagtcataagacaactctctttttcctttactacaaattatgaaaatagctacttgatatcaaggtcacaactaatttcattttattcaacttaatctcttgaaaaatgattggttttttaaaaagatacattttgcattgcatacctccccaaagcaggagtattgcagtactagagatggaatcaaccatgcttcagctacccctggttagtggcttcaggctatagcctagggcctggctttgggctccagagctttctggataataaggtggctccagtttccaatgttccctcatggtgcctgttggtggcctaaaattctgtgatttcttttaaaacaacaaaagtcaagctatgaagagagtgaggaatgaatctgccaggccagcattgctcttcaagataatggaataatcggaagacagaaccagactggaaaccttgggcctcgtcttaagctcttatcttgggcaaatctcttaagtcattgagacttgttgaggggctgccatcagatcacctttaaagtcttctctagttctgaaattctatcagctgccaactgccttggcacacaggcaacattggcctttatgaatctgtggacaccacttgcctctcaaaactgccagaaatgagttaaaaagcatgaatgttcaagactcacagggctggcagagaagctctacagcttctaaaaatacttcttctctttcttcattatctgattcacaggacctaatttaatggtgaaattccggaatggcgtgccgaaacctctgactgtgacatgaaagatggtcatcttgcacctgggattcagttatgaatggcttgccgtatgtgcaagcactctgtcatttgcctccagctgtttattcgtcacactggggcacaggagaggtgctaggagcaaaccaacagcaaaataaaaacattaatttatgcaaagctttctagacacaactgctgttgctgagaaacaattaccactacaaacctggtgttttaggttgaaccatatgaactggccaatttcacgtatgaactggccaatttcacaggtcaacaatggtgactgtcaacagtttcatatggttaaatacacacaaagccccccagtggctggggaaagtggtattctacaggtttttctctgagtgcaatgatggtgggaagaagatggacgacaactcaaatgcaaaccccagccacgtggaggctaaaaagttattatgtaacaaaacgacattatagaaatgccttctggaactactagaattaggtgggaattcttaaggaaaggaaaatcattatttctagagttaacaaaagctggaaggaaaatgacaaacacacaaacctatcagcttaagaaaatttctaaaatttgatgtgcctgattttgaagccaacagaagagggaacagagagatgcagagaaacaatgtcctattggatcctttgagccctggatccaaccaggcttgaggccagatatccctggactttccagttacgtaagtcagtattttttttttttttttttgagacagagtctctctctgtcgcccaggctggagtggagtggcacaatctcggctcactgcaacctccgcctcccgggttcaaggattctcctgcctcagacttccaagcagctgggaccacaggcgcccaccaccacactcgggtaatttttgtatttttagtagagacagggtttcaacatattggccaggctggtcttgaactcctgtccttgtgatctgcccatctcggcctcccaaagtgttgggattacaggcgtgaggcaccgcgcccagctgagtcagtatctttcttattaaagcacatactcatgcatacacacacaatagcactcactgccgtggtctggatgttctcccaaattaatgtgttaaaacttaattcccggccgggcgcagtggcactttgggaggccaaggcaggcggatcacgaagtcaggagatccagaccatcctggctaatgtggtgaaaccccatctctactaaaaatacgggcgcctgtagtcccagctactcgggaggctgaggcaggagaatggcatggacctgggaggcggagcttgcattgagctgagattgcaccactgcactccagcctgggtgacaaagcgagactccgtctcaaaacaaaaacaaaaacaaaaaaacttaattcccactgtagtggtagtaagagtggggcctttgggaactgattaagccatgagggctctgctcttataaatgaattagtaccttataaaagagctagagggaactaacttaggccccttttttgcccttttgcattctgccacgtgaggacacagagttcatcccctctggaggccacagcaacaaggaaccatcttgaagttggagcgagcagccctcaccaggcgctgaacctgccagtgcctggatcttggtgtctcagcctctccaactgtgctgagtaactttctgttgtttataaattacccagtctgtggtattttgttgtggcagcacaaagatacccaccacatacacaaaagcttatgatgctggaccaacccatctcaaaatgttgaactgaatcacaacaagcaagacccatttcatatcaaaacttcaaaaaagctttggcttctagtctgattcacaagtacatgcgttcaaggcccaagcagttaaaaccctgcacagataaattgtaagagcctgggtaaaagaaaatagaatttcctggtaagtgagaatgaaaaaaaaaaaaaaagtttaccacatgtgtagatttaaccagtacgttactaatgcagagaagggaagaatcaggctatttcataatcaaatgttgataatataagagaggggcaagtttattatgtcctcatcagaagcaagaagctggatgtcaggtatactgtgaaaaattgcacaagccaagacctaagactggattaaaattatcaaattgttattagatgaaagttactagaatattgtcagattatcctaaccataagagtagcagaacagtactcaatgtttctaatcagttttgtctattttctgagctggttaaacatttgctgatgtgcaatttgtaaagtcacagccatctgttcatttgtgtcttaagtcttcctgcataaattctgctcttttacctgttttggggaaataaaagtttattttaatttactgccaaaatttgtggcacaggaaagggataggttgaaaccaaaaactattttgcttttttaccatctattagtcatcctttgaaaaatcaatattcagtgctcaccccgtctgtggctccaggcaatcaaaagaaaattgtgtactgtccccattcagactgatgatgcattgtgccattatcctgtgagctaatatgagattcagtatctgctgtcttacctgacaaataagccttcagaatccaggcttgggcacattatttgaagaatctgcagctttaatataatttatattcccaagttccttctactgcttcagtatatgcagcatatgacttgagatagaaggataaagaaaccagaatgattctcttctttcctaccccatcatctgatcaattctggacattcctttcaaccctgtggccatctattacaagttgagtgcctactatgtgtcagagaatatgttagctgctgggaagacagttatgaagaagacggggtctttccagttgttcaactttttttgctactcataaagaggataaaagaaagagaaagaagagaaagaattccagtctgttaggaaatattataaaattactccaaagtggggatgcagaattaaaatataccagaagtaaaaaagagaaatgctgatgttctatttcatgatcaataataaaaacagtaacagcttatatttgttgaatgcttattttttgccatccatattgctaggatttgtcttacttaatccttatcacaacgctgtgaggtaggtactgtaaataaatccattttagaaatgggaaaactgaggctcagggaagttaaattccatgtctacaataaaatatctcaaagcaatggagttgccgcagaaacctacctgcctccgatacctgaacccttccttgctatgctatattgcaggaacttggccctaaactgacaccttgccaacttgggatacgtgttatttctaaagatgaactttcaaagtgggttaaaagagggagaaggccgggcgcggtggctcacgcctgtaatcccagcactttgggaggccgaggcgggtggatcatgaggtcaggagatggagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagatcgcgccactgcagtccgcaatccggcctgggcgacagagcgagactccgtctcaaaaaaaaaaaaaaaaaaaaaaaaaaaaagagggagaaaaatggtaagacatatcttcctaacagttagaaatgaacagagaaatgagtcaggattgaggacagggctgaaggtgtcttctgggaccagtcaagagtggggtgtggtcaggctgctgctgctcactcctcctcccacgcagcacccacaggctgcatggtgcaactgggaggcttgctggaaaatggcaagtcctgctgcaggcgggctacagtgggcagccctcacctccactcctggccaaactgaccagggccactctccttacacagagaccatgctgctgaccaggtctctctggggccatcagcctcaggtcagcaaaaggtcttacaaaagtcaagaaattgcttatgattacagctctgcaatgcaaacgcgtttttaccaacaaagaaaaaaaaaaggttggagaggaagaagaagagagaaaaagaaacatttggccaaggccagaaagggtccaccgaagtcagcctccgaacttccggtccaatgttgacaccttgttcactggtgacaactcaggactgtaccccaaattacacaatgctacttgagggaagcaggcctggcagcagagagagaattaccggcacacattagtgagagcaatcgcagccaactcaaaaccgcactcgaaaacggccttgcattcatggactggtagttacttcctggtttctaagaaaccaaataaaattaaaactcaccattaataacaaaacaacactttacagtccccccttccctttcagagacgcatcaagtgacggcacctgatcaaagctgaattattaaaagtctatagattaatcctgtaactctcaagagcccagagtttgtaatttcccagggaaaaaaaaaaaaaacaaaaaacaaaaaaacagaagcaatctacaccgtgaaaaatttaattgcactttaattaccagttaagctgaatagcatgagatatgggtgcctttaatttttaatagtcgttatgattccaagagaattttaaagggaaataatttaatctcttgagagtattctcctcttctgccactgccaaaatcaaaatgaggacagaaaaaaatgtaaagggcgattcaaattcttccagatcataacccaggacggcccccagcaataataaactggctgttcccaggcagctgcactgcacattttcatgatatgctaatatagaaatgggtttcctgcagttgagttctggtacattaagcagataaacgcccttggctggggtgtttcttttttaaaatcagatctaaagatggcatacttgtttctttgtctctcagagcctggcaccaatatgggcatgcatacccccacctacgtaacacacatacacaaacctgggcacccatatacacatactcttccacatgctgccatgatgccccaaaacatccttttgaaaggaaaaagggaagagggtaacacaatcacacaaggctccaacaaaaatggaaatcagcaggtctgagaattcaaaaggaaataagcgtagcctccactttcactttatctgagaaccacctgactcaggaaggagctggcctcttgagagctggtgcaggagggagccgcctggaccgggtgaggctggccactttcccctttctcaagcacacactggccttctcaacttgctgaggctcttgaggtttgcctgttgtgcaggtgtagttgtctccattgaggctgcagtgtgcctcagcctcttcttggggatgctgtcccatcccaggacagtgcttttttttggaaataaattaggttgtgatttcttttttttttagtttttatttgtgagacagagtctcattttgttgcccaggctggagtgcaatggcacgatctcagctcattggaaccactacctcctgggttcaagcgattctcgtgcctcagcctcccgaacagctgagattacaggcatgcaccaccacacctggctaatgtttgtatttttagaagagatggggtttcaccatgttggccaggctggtcttggactcctgacctccgcccgcctcggcctcccaaagtgctgggattacaggcgtgagccactgctcctggccggttgtgattttaagaagtcagactgggctcaaaaggcttttcatgaggtctccaaataactcagggctctgtactgcctctggttcctgctgctcactactatcaaacacataacaagtatgggccttgttattagtgatcatttggtaaatcaattacaatttcatctgtcaggcaaataagagaagaaaaaacctgcagaaccatctgccacttttctcttctccaactgtgcacccatttcctttctccaaccctctgtatgaaacctgcactgacagacagtgctatgccaggctttcggggatttgtctgtgtctccctcagggaccaatagcacccacctcagttgggacccacagagaaagcaggagaggcgctttcttcccaagcccagtgagttcaaaaggaggaaggagtagagttctaactttgtgaaccaaagaagtgcccctccctgagaaccctgctgttgttcctttgtgtggcagctggtcatacagacaaaaacactcaggtgagagagaacaaggagtgcaacgtcaggaaggcattgtttagattcccaagtaaaggctgaaagcttggcgtggttaggaggcaagacgcagaaaacatcctagtgcgggcacaattgtgcctgaccaggacaaaaaggggacaatgaaaagaggatcctggccaggccagcacagaggagcttcccagggccacactgctcagggacaattccctagtgagacagaactgcagactggtggcagaagtttctctgtattatccttgacaacttattattgtaaagatttggaattagctgtactgagtcttcatcatagatgacaggttctctctcattgtcattttcacaaagtcccaagataaagagaccctccaggtagctgaaatgcaggtacccaatttaccactggagccaagattttggtttcagaggggacaaacgaggtaagtagtactcattgggtaccatccatttcaccaccagaaaccaatttcaccaagtttaacagttcttcctgctgcctgggcaggaggcggccttgtctctttccgcagtactctgggagtctaccacaaggcagcagagccttcgagttagagcagctctttggaacaaacatcacctctcttgctaggtgaggcctctcacccaacaggctgggagaggctgtcacagaactcagaactaagagcctacaactcattctgcagctcaagtatgagacaggctcactgtacagcaatttgtactggtgatccctcccctggggatgacccccatgactctggcgccctgaggcagggcacctgtttcagaatcccccgctaatcctccttactcccttcccagaactctaagcatccttgtacagatggcattggtactggcaagactgtggtctgtgagtagtcaggaagccagtcgacagcacctactctgttattcacccaaagcctctgtctccactgcagccacggagttgaaggctggtgggggcagggtttggggagtgattcaagaactgatcatccctctgacctgcgctatggacctgagcagcagtttcaggtgtgaggagcgtggaaaagggaaagcctcttagagcttatgtgtctagcctgggtaagccccaggaccagcatcagaattctgtaatttgaatgagaactgagctgagaactgcagagaaagacgcacttttcaaagaattccccaacagcaaattgaaatatgggcacgatgctgaaaagagatgaggctgccaaagccacgtggccgagcagacggagggagtgcagtctccacactgaggctgactgaaaacataaataactaggcaagatttttcagtagctagtgaggttatcacatactctggacaaaatccctagtgctcattacacttctgatatgattttctcacctctctccaggctcactgatgcatcttccaattcaacatggcttcttgcctctgaaaggagagctagtccctcctggaatttgtaagtgtgaaggctgtgtttcagctgtcacgtctggtgtatcactgatgcctattcctgtggcctttccagtttcccagggtgatgcaaatgaacaccgtgcagcaggtaaacagagcgctgaagtgcaaagtacagctcttatttatagatcaaacacctgccatcaatttaaacagtagttatctctaacttgaaagtttagcaagatactgaatgcccccttgaagcaaataattttgaagcagttcaggtatacagatgtgtttccagcctacttaagaatgctataattatcatcaaaaagacagattccattaactatctgttatgctttctgtatgtgtactcccagacagatttgaaatgttgaaagtcttgggtttcttagcactatacttttaacattatttttttaaaggactgggcttaggatcttctgaatttggaaaaacatctgatgagaggtttttggaacagttaatgatctaatgtggccgttcttgtcattttgcctttacaaccacagttccatttccaccctctctctaccagacacataaaaatttcatatttggaaaaagctatcttcctaaacacagatcagtgaggagtgaacacatctctaatcacaaatggccaataaccactatttcttgaaagttaaaaatcaggtgatgtgctgtacaggtgctctatggatactgttccattaatctttttgatgaattcttgaaaggttatcttcattttactgatgatataaactgaggctctgaaaggttaagcatgctgcctgaaatcacccacctagtaaatggaagaatttacatttgaacatgggtctgtgtccactccgaagcccgttcttcctactgcatacaacacactagcacagaagatggtcctctttctttgcttagattgtttcaaaattgattttccattttcagggatatggaatgtcattctggaagtaggtgataattatgttcggtggcttgagattggcatgatctccgggatacgagtctgcaggccacatcagccagtcacgtgtgtgggcaactcactttacctcggtggacctttttctctcccagaaaaccataaggatggattgaaggactaaagtccaacagttaaaactgttccttttaattctaaaatcctctgagtgtatgaactgcttcacctttgcatagaggacaagcttgtgctcaggagggcctgaattatttcagttccctgaatgtgctggccctcctcatgcaggagctgccccagggtttgtaaaccttcccctactaccaggcaccaccactgctatctgatggccgcacaaaggaatgagtgaacaccgtcaggaagacattggtcctgtgctctacgagagggtgtgcccaaccaccactgtcctctcagcatcctccattgtgaccaacgtcaccagggctgcccgaggaaaccctaagagagggaggggtattttccgtgaaaacacacctggatgcaggtctaggaaaccaacccctggtcagagtagcccaagagagaacaggcccatgcccagtgctttggtaagaatgacaaattcttacttctaaacaacagttccaaaaaaaaaaaaaaagagaaagagcgagcgagagagacagagaaactcactcagtagcaggaactgagaagaaaggggtcactcactcactcagagtgggctgggagggaaggcttcatcatttatcaggatatagtcatgaatacctctttttcttctttggaaaaatacagactactgtgggtgagtaaatctcatctagtgggcaagccggagtttgatttgagcaaagaatagaggggtagttggggtgaggaggtgaggaggagaggaaggcatggagccatggtcatgagacagcttctttttttttttttttttttttttttttgagacggagtctcgctctgttgcccaggctggagtgcagtggcgcgatctcagctcattgtaacctccgcctcccaggttcaagtgattctcctgcctcagcctcccaagtagctgggactacaggcgcccgccaccacgcccggctaatttttgtatttttaggagagacggcgtttcactatgttggccagcctggtctcgaactcctgactttgggatccacctgcctgggtctctcaaagtgctgggattacaggcatgagccaccgcaccaggcctagacagcttctttcatttgaaaatgttctcttagataaaatgtataagggtcaacatgcagcacacaagcaaacctccttcccccaggtgcaagcacagcagctggcctgaagataagagttaaatgaatccagccccctgaaaggaaggttgtctatgctacagaatcaaatcaggaagaaaggaagctattctctcacctaagggcattgagaaaggtacatgaatagtaattatctaaaaagagataatcaacaaggagtcagaagggcaaaaccctgtctaactaatctacttcacctttacagcaaggctgaagactaggtgggcaacagcgctgcatgtcaaagggtttactgtgatttcacaaagctccatagaaagcctccaaatgaagactggcaggctgggaaagtctctgaaaccatgaagaaaagggactagtggaggagctgccctcaagagaaaggcaagatgttgagtttagatggcctcagaatattaagcacctaacctgctctgtcatttaggttaattcatggagccctatatatatatatatatatatatatatatatatatatatatatacagatgaatcactggcatgagatcagctaaaatattcattgtagttgcttttaggtgattgtagatttcttcattgtttcaccttttccgtatatttttaaatgacagcaaaattttataataaagtttttataataaatttatttttataataaagaaaaataaacagaaggcaaattgatatcctcacataatgtgggagctacaaaagggatcctaagtcaaagttagtgcccttcctgtctagcctgggaggaaaacgtgactattaaattaattactgaatatgatgtgaactgcagttctgaggacaaggacctgcatttctggtctactcctgttttgaaggtaaacaatttaataatttcagtgtatagctacctccaattatccaaaccactgtcttcataggaatataagaaaattaaggtagatacctgaagcagcaccaggaatcaggacagatagagctcagttttttaaaagaagattctttcctggtcttcttcaactgggggcaaaaaaaaaataaaaacgaaaaaataaacaataaaaataaataaataaaataaaaagaatgctactgttacaccacatacttgttttaaagtcttgcccttctagtactgactacacgcggccccagggacctgtgaaatggatgctgctgcaagattttatttaaacaacatcttgatcttctgtgccatgtgactggcattgcggagaagctgctctttctaaaggcttcaaggtcacttaagcttgtgccggctctgctaagagctccgatgaggaataaactttaagatcttctactagacagaattttggaattcccagcagacctgtttcccttggcttccagatcctctcaaatgaccttatcccttatcccaccatgcacacacacacacgcacgcacacacgcacacacatgcacgcacacacacgcaagcacacacacacgcacgcacacacgcatgcacacacacacactctatcttcactgaaggctcccaagacatcttcctcacaaaacacacaaaacaaagacagctgtccattggtgctcaaaataaatgaagggtaaactaagcccacagacaccatgaggtgaggtgatatcagaaagccagagcaggacaatggtcttgatccatccgctaaatctttaggtacaacctccaaggaaaatgactttcagtcaagccaggcaactattgctaccaacaataaaacagaagatgcttttacactcatggccccagcattgtttctcacaactaaaagaggccaaacatcccaaccagaaaaaaacacaaacacacacaggaagcaactgttaacaaatggaacgtgatagtggcagagcccagaagagctgttggttaactcaacacgaaggagtccttgcctctcattcaggggtgcacacagacatgaccctaccatgcttttccttccatcccaatctccatggtcatctagtccaagctgtacgctctagtttttctcaaagtggagcttatgggtaacctccatcagaatagctggggagctaatgacacatggatcccagatcaaccaaggggattttagagacatggggcctagcccccaagtgactctgatgcatattaagacttgagcatcacaggtcaagaagtacacagatcccagttatcaacatagccagatggctggtggtagaagcaaccctgtccctgtagcacctctctgtgtcctgctcaaaagcattaaaacatcattcttagataagaacagagacaaaggatatgtctttaacactttacagtctataaagtttttccacagccactgtctcactgaatcaacccctaagagacagaaatgaaaatcgctgtttttacaaactgagaaattacgggcctttgaagtgtttcacagccttcacagcctgctggtaagaagcagagatcaggccttggacctgggtcttgtgattccaaagcccatgatccttcggattcatcaaagctccactccaagtgcctactgggactgccttgcagcactcaccttctgtaggtgagtaggtaagttgcggcatgccattctttcaaaagaacagtgcacctctgtgaccgaatatgggccacagtatctcaaggatattttggtcaaagccctggggtgtggggcagaagataatgtattcaatgaagcttctagagaaaagcataataaataaagaagctcctacctgtcgctagccttcctaaatatcccaagaaatcaagaattttctcccaatggattacagctgagcatctactcagaagagaaaatcaagtccatttcagtttagacggcagcagcaaactccccacagagagtactcccggggtggctagggggtggacagtgccattactgtatcaatcaggccaaggagtggggcttgcactactgtttgctagaatggagcttggctctaaaacaggattctcagacacatttcagaataggacgactggaacaatgcaatactcatctaagcaactgcaaaagccagctacaacccaactcaaggtgccatctattatgagaggtccccttcatctatgtaaaaaaaaaaaaaaaaaaaaaagaggagccaagatggccgaataggaacagctccagtctacagctcccagcgtgagtgacatagaagacggtgatttctgcatttccatctgaggtaccgggttcatctcactagggagtgccagacagtgggcacaggtcagtgggtgcgcgcaccgtgcgcgagccgaagcagggtaaggcaatgcctcactcgggaagcgccaggggtcagggagttccctttcctagtcaaagaaaggggtgacggacgcacctggaaaatcgggtcactcccacccgaatattgcgcttttcggaccggcctaaaaaacggcgcaccacgagattatatcccgcatctggctcggagggtcctacccgacggagtctcgctgattgccagcacagcagtctgagatcaaactgcaaggcggcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaacacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacatggcagggtattccaacagccctgcagctgagggtcctgcctgttagaaggaaaactaacaaacagaaagcacatccacaccaaaaacccatctgtacatcaccatcatcaaagaccaaaagtagataaaaccacaaagatggggaaaaaacagaacagaaaaactggaaactctaaaaagcagagcacctctcctcctccaaaggaacgcagttcctcaccagcaacggaacaaagctggacggagaatgactttgatgacctgagagaagaaggcttcagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactatgtgaagaatgcagaagcctcaggagccgatgtgatcaactggaagaaagggtatcagtgatggaagatgaaatgaatgaaatgaagtgagaagggaagtttagagaaaaaagaataaaaagaaatgagcaacgcctccaagaaatatgggactatgtgaaaagaccaaatctacgtctgattggtgtacctgaaagtgatggggagaatggaaacaagttggaaagcactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaagatcgggttaccctcaaagggaagcccatcagactaacagcggatctctcagcagaaaccctacaagccagaagagagtggggagcaatattcaacattcttaaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatcgaaaggaacaaccggtaccagccactgcaaaatcatgccaaaatgtaaagaccattgagactaggaagaaactgcatcaactaacgagcaaaataaccagctaacatcataatgacaggatcaaattcacacataacaatattaactttaaacgtaaatggactaaatgctccaattaaaagacacagactggcaaattggataaagagtcaagacccatcagtgtgctgtattcaggaaacccatctcacgagcagagacacacataggctcaaaataaaaggatggaggaagatctaccaagcaaatggaaaacaaaaaaaaggcaggggttgcaatcctagtctgataaaacagactttaaaccaacaaagatcaaaagagacaaagaaggccattacataatggtaaagggatgaattcaacaagaagagctaactatcctaaatatatatgcatccaatacaggagcacccagattcataaagcaagtcctgagtgacctgcaaagagacttagactcccacacattaataatgggagactttaacaccccactgtcaacatcagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgatcacatagttggaagtaaagctctcctcagcaaatgtaaaagaacagaaattataacaaactatctctcagaccacagtgcaatcaaactagaactcaggattaagaatctcactcaaaaccactcaactacatggaaactgaacaacctgctcctgaatgactactggatacataacgaaatgaaggcagaaataaagatgttctttgaaaccaacaagaacaaagacacaacataccagaatctctgggacgcattcaaagcagtgtgtagagggaaatttatagcactaaatgcccacaagagaaagcaggaaagatctaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctatgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaacaaatccagcagcacatcaaaaagcttatccaccatgatcaagtgggtttcatccctgggatgcaaggctggttcaatatacgcaaatcaataaatgtaatccagcatataaacagagccaaagacaaaaaccaaatgactatctcaatagatgcagaaaaggcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagacaagtcaaattgtccctgtttgcagacgacatgattgtatatctagaaaaccccatcgtctgagcccaaaatctccttaagctgataagcaacttcagcaaagtctcagggtacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggatctcttcaaggagaactacaaaccactgctcaatgaaataaaagaggatacaaacaaatggaagaacattccatgctcatgggtaggaagaatcaatatcgtgaaaatggccatactgcccaaggtaatttacagattcaatgccatccccatgaagctaccaatgcctttcttcacagaattggaaaaaaactactttaaagttcatatggaaccaaaaaagagcctgcatctccaagtcaatcctaagccaaaagaacaaagctggaggcatcatgctacctgacttcaaactatactacaaggctacagtaaccaaaacagcatggtactggtaccaaaacagagatatagatcaatggaacagaacagagtcctcagaaataacgccacatatctacaactatctgatctttgacaaacctgacaaaagaagcaatggggaaaggattccctatttaataaatggtgctgcgaaaactggctagccatatgtagaaagctgaaactggatccctttcttacaccttatagaaaaatcaattcaagattgattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaacaccatcaaaaagtgggcaaaggacatgaacagacacttctcaaaagaagacatttatgcagccaaaagacacatgaaaacatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctcgaactagaaataccatttgacccagtcatgccattactgggtatatacccaaaggattataaatcatgctgctataaagacacatgcacacgtatgtttattgcggcattattcacaatagcaaagacttggaaccaacccaaatgtccaacaatgatagatcggattaagaaaatgtggcacatatacaccatggaatactatgcagccatacaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaacatcacactctggggactgttgtggggtagggggaggggggagggatagcactgggagatatacctaatgctagatgacgagttagtgggtgcagcacaccagcatggcacatgtatacatatgtaactaacctgcacaatgtgcacatgtaccctaaaacttaaagtataataataaaagaaaaaaaaaaaaagccaccgccagcatgcctctagttgctgcctcagtctgaggagctcggctgttttactgctgacaccatcttatggtatcctttgcacgatgctaacttcctccgctgagggtgaagcctcacttaccattctctgcagcaatcccaccaacctctcatccagtgactctagtggggccctttcactgggcccactttgtacttggctctccatagttcctcttaactccgtgatcaaaagacatttttacatgtgttataagcctcttttaaaaaaatcttcctaggaaagactctcttcaaatctctactagaacagggctgcatccaagtgagtccttaataaatagaatttgatcatggtaagaagacatgtcccctgctcgtgttcttgtcagtcctgaatgggtgaggcaaagtgctcagacactgtgctagcaaagggattttcagtctctgcctccctaattatgacattctttttctgcctcccacaggcacaagggccctgacgagggagtgctcagttctttggtgtgaaatatagtaagatagaggccattggcttcagaggaatagagctggataaaaaagtacaaaaggaatgtgaccagtaacaggaatggcatttagaggacctgattcatctcttctacattgttcaggacgattgcaaaatccatttctccttctctgtccctgcttctctgcccttcccccaagctttcttgctctctgccacacgtgcgtgtgcacacacacacgcgcgctcgtgcttgctcgctctcgctctctctctctcttttctaaggctccaggcatccgtccctggagaagtgcaccttgggaaggcgatgaaatgaaagaagggcacatcctcctttaaccccaaacatctgaagtcagcgccgcgcactactgcgatttcctgggccaaatgcattgttcaggcaaagctcccattcatgtcaacagtctcagcaggatttaccaaattcagccatatggacaatattcacagatactcattcaagaagctctcacagttccaacttccaccttgttgactctctctcatctgtttttcccacaagtcgttcaattcagttgttgggcaaccgttcagggaagcctttaagtagagatttctgctctctcattgggcagaagagaggacaggcaaaacagtgagaccgccaaatgaggaaagaaaattggaagcacttctctgatttagtaccaaacttgctccaggataaaactgcactataccaaaaactctggcagggtatcaggtactatggggtgggcaaagttcccaggttttacttccagagctgactgcaccagggagacccacgtgctcccgaaggcaccgcacgcagggcagggcatggccagaatgacagcagatgtcagctctggactcttaaggacccaaaggtccagggtcacattttttgttacataccagcttcctcccctactcacgactggagagttgtggcttctgcccccttcagtcacagctacttggggtgtctgaaagcatcagggccatgccatctagcaatcttccccaaagtagggaaacagcggtaccctgcacaagcttggcatagaggtgttccctcaaaattatctttgcacacagttggaggatgaccaaaatataggttgccatttaggcaaatgacacgaaggaagagatgctttgtagctaagtatcttttccatactgggcacccactaaaggttagctgtatacatgaatggatcgatgattggatgaaacgacacatgaaaggaaggcattgttttctcaaccaagccaagtactaagtaatctttgaaaatgaaaactcaggccgggcgcagtggctcacgcctgtaatcccagcactttgggaggccaaggcgggtggatcacttgaggtcaggagttcgagaccagcctggccaacatggtgaaacccccaactctactaaaaatataaaaattagcagccaggcacgttggctcacgcctgtaatcccagcactttgggacgtcaaggcaggcggatcacctgaggttgggagttggagaccagcctgatcaacatggagaaaccctgtttctactaaaaatacaaaaattagccaggtgtggtggtgcatgcctgtagtcccagctacttgggcggctgaggcgggagaattgcttgaacccaggagatggaggttgcagtgggccgagatcgcaccattgcactccagcctgggcaacaagaacgaaactccgtctcaaaaaaaaaaaaacaaaaaaaaaaattagtcgggtgtggcggcgtgtacctgcaatcccagctactcaggaggctgaagcaggaaaattgcttgaacccgagaggcagaggttgcagtcagccgagatcgtgccactgcactccagcctgggcaacagaacaagactctgtctcaaaagaaaaaaaccaaaacaaaacaggaaaatgtaaactcgccaagagctcagcaggaatggacgtgttactctcagagtagaccccataacagccacccagacacgtgagaatgcagctttgccttaagacagacattaaaggaagaaattccaccacctctccctgtaatctttgccagcgtgtgtcagccatcactcttgggaagctttttccatctccctacgttctcttagatttggaaacccacaacggctcccaacaagctcctctagatggctccacaccttcggcttgtggtttaagtccctcttcagttgttcctgagtctcatatctagaggaaactactacgggggaagttactgggatgagattggcaagcggcccctccacctgggatgagattgacaggcggcccctctatctggcctgcttctctgtcttcaggctggaaaggggctcactaggtgggcggagggcttctgtgtcttcaggctggaaggggctcactaggcgggccgaggccatgcgtggccctccctgggcatcttgtccccctctctgttcagcttttaaaaatgcctttgtgggctttgttgtgggtagggctttctcctacctgttccatgagtctggaagcccctgtgagagaggaattgatgagcacagcaagaaacagaacttcactgagcatgctgaacatgtgtcattattctaaatacatttttctttaattcctatgacaatctgtgagacagatactaattattcctattttacatctacagaaatctaaagtttagaagaattaagtaacttgcccaaggtcactgcctgagtaatgacgtatctgggtctagaattgaagtcactctacgaaaactccacgtcattttctcctaaacgaccttcctatgaaggcaaagacctcctctgccttaatcatctatctctgctcctacatctagtacctagcatctgctttctatgttgtatttaattaaatatttgttaaataaaaatggaagaatatgcatcatgtatttgtgccactaggttttaaggtgtacagttcagtactattaagtatattcacactgttgtataacagtcatccagaactttttcatcttgcaaaactgaaactctatacccattgaacaattccccatttctcctccctccagtctctggcaaccacctttttacgttgaatttgcctgctttagatacttcatataactggaatcaaatagtgtttatctttttgtggctgacttcacttagcgtagtgtctgcaagcttcatccatgttgtagcatgtgacaggatttccttgtttttgttttgttttggtttttaaatagagaaggggtctcactatgttgcccaggctggtctcaaactcctgggctcaagcgatcctcctgcctcagcctcccaaagtgctaggattacagccatgagccgctgcatccagccaaaatttccttgtttattaaggctggaaacactacattttatttcccacgccaagtttcttaaatgacccatttcatcaagttgcttccttaaaactctctccttatattagttcgttttcacactgctatgaagaactgcctgagactgtgtaatttataagggaaaggggtttaattgactcacagttccgcatggctggggaggcctcaggaaacttaagatcacggcaaaggtgaaggcgaagtggaagcaaggcagcttcctcacagggcggcaggaaggagaatgaatgcaggaggaactaccaaacgcttacaaaaccatcagatctcaagagaactcactcactatcatgagaagagcatggagcaaactgcccccatgatccaactaccaccacccagtctcttccttgacacatggggattatggggattataattcaagatgagatttgggtggggacacaaaacctaaccatatcactcctttaattcagcttcactctcggaagagctttaatacaatgacagccaccgctgctacctgttgagcactcacactgcgctaacggagcctctcacacgttttcacagaaacttcagggttatgactgtgatctgtagatgagaaagttgaggcccagggagattaaacggcacgttcaaggccacactgcttccaagtgcagcaatctggacctctgaccttccccagctccctctgactctacagcctgttgtcagtcactaatctttactgccttccagtgagccttagagatgatcaacacaacagagagcgacactgaggcccagatacatgaggtgacacctgtggctgcgctgcccattagctacagagctggggtgatgcctcgaactcacgatgcctggcccagggctctctgctccattccacttgcctccggcccacgtgacctctcccccaatccacatcccatggtttcctcaagatgcagctcaaggctcacttcttccagacagtaaaatcctcccacacgcactcccggtatttcgcttctcctttgctctgctggctgaattcggttggacacacactctcatagcagcatcatgtcctactctatgatcttccaaggaggaaagtgtgttccccttcccatcccaccacctaagagtgtcctggaatttggcagggcacttgatgaatgctttttgactggctatgccataaatttatgcaatctaagagctgggtgggccctgccttatcacacttattttccaggtgagaaactgagacccagagatgtgaggtcactcatgtggttacagagctaattaatgaggagccgagtccagaacccagtcttctgtcttctaatctgtcctctcctgctgctgagcccatctaaccaggattctttatcattttgcagcacagagttgtgccctaaagcctgaagtgggcagacacgaggaaagaaaggttaaattctacatttagtcattttaaggagatatgaaagtactacctttttatttccatagggaaaaaaagatgaaaaggaatactgaacagaaagaaaggaataaaaagcaatgcaaattcctagtctttatccacatattaaataaagacactctgtccttctccctctgtcccctcccacctcaatattgcttgctccttaagacgggccagggaaaatgcaattctctccagagtaaagtgtgaaagactagagaggtgcattaacattttataacctcaaaattcttcaataaattaacattattaaaggatatctggttcttcagtaccttgaaaatgaaatgacaccttctagaaaatatagattcacctcatttgcaggtttgctgtattgttagagccatctacatgtccctttccaataaaaagaaaggaagtcatacacctctgaagcattttatagttaatgaaacacttgaacacattatttttttttgatgataggtcattatgtgcttattttttgacattttaaaagttttattgtatgtttaatagacaaataataattgtacaaatttatagggcatggtgtaatgtttgggtacatgtacacatttttatcccagtaagatgtaaatctttggagaaaacctgatgcagatagaagaggcttctgatacatattaggacatggatgtcagtttttctgatttttttttttttgagacagggtctcatgtcgcccaggctggagtgcagtggcatgatctcgggctcactgcaacctccgcttcccgggttcaagcatttcttgtgcctcagcctcccaagtaactgggattacaggcatgagcccccacgcccagctaatctttgtatttttagtagagatggggtttcgccatgttggccaggctggtctcgaactcctgaccccaggtgatctgcctgactcggcctcccaaagtgctggggttagaggcatgagccaccacgcccggccagtttttctgattctacttactaactcacacttacccaagagttgtcctcttcaccttcttagcctggcttttttttttttttttctgtactgccctccagaaggaagacaatcacttttttttttttaagataggtcaacagattttaatgtgagatagtatgaaaagttcacttatatggtttcagaacaccttataactaacctataagaagctaacttaattctagggattaaataatggaagtattgaatatttaatcaatcaacaagtatttattgggagcctattgtacactgggcactattctaggccctagggatataagattaaacacagcagggggagtttccattctcctgaggttccacactagggccctttcacggatgagacaacaggcaaattcaaattgaaaccacagtgagatactaccgcccatccactaaaatggctaaaatcaagaagacatgtaataacaagtggtagcaaagatatggagaggtactctccgtattactctcatatattactggtgggaatgtaaaattatgcacccactttggaaagcagtttggcagttcctcaaaatattaattgcatacttaccatatgatctggtaattccactctagatatacacttgaaaaaaattaaaatatatttctatataaaaacttgtgcacacatgttcacagcattattcttaatagctaaaaagtagaaagagcccaaatgtccatcacttgatagataaatatgcaacattcataaaatattacttggcaaaaaaagaaaatactgatacatgccacaacatgcatgaaccttgaaactatgctaagtgaaataagtcagccacaaaaaagcaaatattttataattccatttatataaactgtctagaataggcaaatctagataaatagcagattaatggttatctagggactggggggctggggagatggggtatgactaatgagtatggggtttctttgggggtgataaaaatgttctaaaattgattgtggtgatgattgcagaactctgtaaatatgctaaaagccactgagtagtacactttaaatgagtaattatatgttatatgaattacatgtcaaaaaagattgtacataacatagtatgaagatatactgagaactagtggaagatgatctcagcagtttgttctcatgctgctaataaagacatacctgagactgggtaatttttaaaggaaagaagtttaatggactcagttccacatggctggggaggcctcacaatcatggcggaaggcaaaggagaagcaaaggcacgtcctacatggcggcaggcaagggagcttgttgaggtgaactcccacttataaaaccattagatcttgtgaaacttattcacttccaggagaacagtatgggggaaactgcctccatgattcaattatctccacctggccctgcccttgacatgtggggattattataattcaaggtgagatttgggtggggacacaaccaaaccttatcagtgtgtgggtaggcaactggcctgggcaccatgttgctgtttttcttctgtaactctatagagaatacccctctggggaagtttctgggccaaaaattggtgacagatagtaatcaacagatattgctcagactactgtaggaagtagaaagcttagcgataacagattttcctggcaacacccacccactaataagatttacagtttgctagagtggcaccagctgtatgaagattcactaaaatctcacttgagataggcaacacctatctctaaaccagaagagacaggtatttctttcttcttcctctcctcatgtcacctcctaacctccacagtgcccatgttgagttttagaattggcatttagagcaagacatagattcttggtgggtggcctcttgccagctggtcctgcccccctcctcgctacagatcacaagtgttggcctggtttctctcaccacaaacagcagtatcaacaacctcatccaaacttcacgtacctctttaccaaactagagctaatcccaagtaaacagcatttggacttcagaaatccggttccacgtttgtgtgaatgacagattccccaatattttagcagggcctcaccctcagttattcttttccatgatgacagttctgtatcttactgagactaataaattactgtccttcacaacagaggtacacaaaaggcctcaaacgatgagctggctaaaatgtagctgctctgttaacaatgatggaatgctagccatgacatatgcatagcaagcaatttttcctcatcttcaccaatgggaaggagctagcatttggccaagacctttgataagtgccatgggtcctctcacaccctcagacatgaatatttcggggtaaaccaggtacctgggtaactttctcatgtgctattctgccacagcaggggcaactgcccttacagtcttgtcccagaagaaccactaacaacttgaagtttccatcagtgagaaacgcacctgccacacagaccactttctagcatcactcacacaaaggttgtcgatgtttggaccaagttcgccagagtattttttcatttggttgaagttgttttcaatgttttccagtgactggaggtcaagtctggagcagtggcttgtattaatagatcctttgtgagggcagccgctgaaacgacacttcaactcatcactgacaagggaacagaaaacacggccaagtcaggttttgtggccacccctcaaactggccctgaaaatggcactgattctggagatggccaaatgatttaagtgtgcatgcacgtgtgtgagggataatcttggttcctaatttgggcgttttgaattggaaactttgccggacattgcctaaatcaacggtcaaagagtacagtttgttttttctctgagtaacagatatcagtttcctaaagctcactgcctttcttggaggagggaggggaggcctttgccaactttgtctacctccacgctttttgggcttactttctaatgaatgggcaggtctggggcatcttttaccacattcagtccagaaaggatctgtctgtctcatctaacctaaagcctggctcaataatgcctggtcaagaggctgggtctcacccttcggggctcgtttatataatgagtgtctctgggttcagatcttctcaataaaagatgtctgcctagcacaatccttctgaaatttaatggctgcaaccctgacagccttcaggctgggaatttatccgacatcaaatgaacaggcagcaaacaggatggagcaatctttcccaaagtgtgttccatggaactccagggttccatgggcagttaagtttgggacaatgcattccacccctgtcttatttctaagattctaagacatcatcagttttaagctcctcatcgatttaatgttttttttgtttttttttttttgagagttgaggagaagacgacacctgattataagtaatatagttttgtttttaacacacagtaagagcctacatttatctagatgagcactcaggatttcttctttagtatctcagttacagtttgcatctaatcactctttgccatctgagtctaagggttcactgagtcacttttgaccattagaagttatatggaatcttagagggacaagttgcttttcataaacttatgatcttggtctcctttgtatccttagaataaacaacataatgttgaatcctgtaaagaaatattcaagtttcatgtgcctttttttataagcttattgtttcatattttccttaattgaataacgtgactgaaaggtattgactttgctaagtgtcagctggaagctcttgacagattcttggagatggagtgatagttcttcataatgggggaatcagcattccaagaactgtcaaaccaccttctccgcacagtgaagcttccacgatccattcctagacatttggcaatctctgttgcctttaattactgcccggaatatgtgacaaaaaaaaaaaaaaaacctgcttttataatgctgattcataacaatgtttttaaaatacacattttggaataattttagatttacagaaaagttgcaaagatagtagagtgttcctatacaccctttacccagtcctctgttgctaacatcttacattaccaaggaacatttgtcaaaactaagaagcaaatgttggtatgtgactattaactaaaccccaggctttacttagatttcacccgtgcatctacccacgtctcttttatgttctgttctgacaacaatgcattcagttgtcatgttgcctcagtctcctctgctctgtggcagtttctcaatcttttcttgacagtcttgaagcgtcctggccaaatgtactgtacaatgtactctgatctgtgtttctctcttgcttttctcaagactaaatggaggtatttttgtaaaaaatgccacagaagtaaagtacccttctcattacatcctatcacaggggacgtggcagccacatggcctcacttgtgaagctaacctgatcccttagttaaggtagtgtttgccaagtttttccactgcaaggtgtagcaaatgaagggatctaagttaaattcaactttggtggactccctattttaagaactcacctgaggtgccatcaaatgggcaagcatgtacaaagactggctaggtccctgcatcttgtgcaggcagggacaacctcagcgtcctggccagggccgggagctcattggcgtgagaagccagacacactcactctcagggtctcacccgcatgaatcttgcaccccatgcacctcatttaacttgctctatgcccatccccgcttctgacactgattccaaagtttactctaattttagaaacattgaagtataaaaacatgggctttttattttagaatcaagtgtactgtaaaggttctgggacatcctgcagtaaccttatttaacctacagtttcccaaactaatttgatcacagagtcctcttttcacttaaggccctttcttcacctgaacctatgaatagaggggaaggaacagggctgagccagctgaatctgctttgagtcccagctgcctgactgtggcaagcttcctcataaaggaatgctcttcagagcctctgacatcctcagtcacaattctgatgcatttaaatgcatttctttgacctctcatacacccctgggaaggctctgcttgcacgtctgtgagctatgcacggatatactgacagtcctatggaagtggctgacctttgtcacgatatccgggagtaaaaatggtccagacaggcaggtaagcatgcgaacactgagttccaaaatcgtatcagagctgcctgctcattggaccactgtgaatgaggatgggctcaccccagccccctactaacctttgcatcctttaactgccaggactcatacctgactctaatagaatgaacttctgttctctgatactacatcttaacgtcctctgaggaacactgtagtggcaggtgggtaagctgaaaatttaggaagcaaattataatagacatcctagccaacctcatttcacagttctgagcagccccagtggagcaatcttcctgttcggaggatcacggcaacacagggagtaatcaccatttcagcccgtacatgggaggccagaaagggagatcctagtgtcatttaggcccaggctctgccttggctattgacaaggtcttttagggtatggggttacatttttgtcccactaaatgacagcagcatttggtgggtaacatgcatacataagcgcatagggccatccatcaaatcaacaattcatatagtgagtctcttggggaagacattcccacgttataggaacatgggccttttccattatatgagaaagtgaacttacagatacataagggcaactattcctttcatttttaaaaatttgtcaccttttaccaaaagaagagtggcacggtagaaaatgcatgagacttggagttggatatgcttgggctcaaatcctagttcctggggcaggtttccttttttttttttttttgagagggagtcttgctctgtcaccaggctagagtgcaacagcgcaatcttggctcactgcaacctctgcctcccaggttcaagtgattctcctgcctcagcctcctgagtagctgggaccacagacttgcgccaccacacccagctaatttttgtatttttagtagagacggagtttcaccatgttggccaagatggtctcgatctcttgacctcgtgatctgcccacctcagcctcccaaagtgctgggattacaggcgtgagccaccgtgcccggcccctgaggcaggtttcttaatttctctgagcttcagttttctcatgggtaaaatggggataaaaatacatacttgacaaggatattatagagctcaaatgagacaatctgctgaaatatttttagcctggcacagagaaaattagtaacaaacatggaattccctttcactccaagctccctttacactagggactgtctcatggttgataccagatggcccggtctcgattctgcacaagcttggtactctaacaccccagttttaggaaggcctcaagaacaatctgcaggggcaggggacctttctaatgatcccacacactctctggactgtatgggatcattaggaaaaacaggtatcagcgccctgatgcaagtccttctgaacaatccagggtttagcaggaggccaaggtgtttgatcctctctggacattatcatggctggtcttccttctgttctccgtcgacgtgacttgttagcgttaacagtgcctgtgggcaggaattaagaggacagcgaaaacttgctttgctagttaatgctctctctgctctcagagagggtcgagagacaacaaaggctcattcctgccagaaccaagaacccccacctcaactcccaactcctaccaaacattagccacccatctgaccctcatagacgtctccaagatcgaaaaatatcctttggcaaaaacgaatcattggcaatttggttattttaactacttctgtggccaggagagaaggatgagagtttcagctggatataaacagaagcaggagcttgaagaggatgagagaaaatgaagccagtgctatgatacagtccaagacagcctggtttcagttgagctgaggagaaactgaagctgatttcaaacgagtctgaaaacccgcatccctgtgctcccctcgcatagccactggccttcccatcctccgtgcggtcctgaactgaccatgcactcacaatagcacattcagggctggccatagggagccgtcttcgtgcaaggcaagttcttgagagaggagtctgtgtttatgaaggttaattccaggctcagccaaaggccacctaaggcacaaatgctccgagtcggttggggtttgtgtgttccatccgctgctgggcacctctctaggatgcgtatttctagtcagtggaccgtcctaaacatgtgaagctgctgacagatgaaagctggccttgcttgtggcatccattcttcagggcttgtacctgctcttataaggaagtagaactcagagagcactcactggcagcaggggactggtcctacactcacagcaatgtcccgactcggtttcagtgatggcttcaatgtctcattttgtgtcaccagtgttgatgaaaccttgacaaggcaaagcaaaacgacaagcacgccctgagcagagccccgggaattcaacctttaagtggataacttggcttctggtttgccaaggaaccagggcatcaaacagatgaaacagcctattgtccatttcaacaggatttttcaggagtggggatgatctttcaaattatccacaacttaattatttaatattttgatagtcaattacctaagacacggcatcgtcactgaccaatcagaagagatgccagtagttgggcgcagtggcagcactttgggaggctgagtggacagatcacctgaggtcaggagttcgagaccagcctggcctacatggtgaaaccccatctctactaaaaatacaaaaatgagccaggcatggtgggcacctgtaatcccagctacttgacagagtgagcctctgtctcaaaaaaaaaaaaaagaagaagaagaagaaggagaggaagaagatgaagaagagatggcagccacagctgggagacgggtcctagaaatcccccgtagtgcagggcatcctccctgtttgcttcttggattctgggaaagtcctcggtggcaagcctgagaggctgggcaaaggggctagagcagtggctattgacctccagggaagaggcattctatggcctgaacaagcagcaggcagcaccaggtctgggtgattctctgtcctgcagtcgtgggagatgagggcacgtacacgagggaagaagcacagaaaagaagcctctgcaaccttcgcattttttatcacactgtgttagtacccaggagactttagccttcccaaatctcactggatcaataacttcaggaaaaagaatttccaggagccaatttccacattagtttaggtgccgggaggtctttggaaactcagcccgagacacccggagacttctagtccacccccggggaattcagttcaatcctctgaaacactcagactatctcctctaggcaccgccagctcaggtttctactcagaacacatacatttgtgtctggggaaaggcaaggcatgaaatatacttcactgaaaggttgaaaagcatggagggtaaagttaattttcaaagaagaaaggaagtcaacggcataacacaatggaatgtgtgattcacctctgcagggcagacattgattttcccaccagggagtatcatcgaattagttggcagttgaaaatatgatctctgacttttttttccattccccttaggtcctacattttattttaaggccatgaaacaacatgagattaaaagtgtcatccagaaacagaagtggaaaagatgcagtatttcttttgttcaaagaaaatatttttgaagttatttcacaactaaaattgcaatgacaggtgtgtgggtggggtgcatgggctctcctcgcttggttcatattggacagaggggaagcctgtgggcttagggggcacagacccctcccatgaagagtcagcatcagggctgctctgggtgtaacccaggtcctgcaccgtttccagtggctggtgtcctgggaataggcatcagttggaagccacaccttcaccctgcgggggatgaggagggctaatggtgggagaaatcattcaggtaagaaatgttctcccacctcctagatgtgtggctttgggtgaggtgctcaactctctgagccacagctttcagagctctaaatggggactcataatttctgctatatctagatacatgtaggtctaggtttaggtgttctgatgcctaacattttgtataccttctttaagaatgccaagttgacaaatgcagaaatgggaacagagttttcaaaggggctcctgcaagtggaaggccctacagtttaagtctcgttagtgtcatggtgaatctaactttgcacacctgcctatctcaaataagaggtacgtatataaatgtacatctcaaactataattatataaatacatgatgttgaattactctataaatctgtaatacttaatgtatgctatgtgaggtgcaggaaataaagctgtgcaggagacatacaatcccacccgtatgaaacctaaaatctagaggcgttgcattatcatctatgggaggacatctattcagaatgtcctctgaatcctgaacttggaagtgaggcagatcacagtggaatggcttgattgctcgtctgcagcactagcccctctcagggctctctgaggtcctgatgccacacctggctttctgggcggtgagctctgcttgacctctgtctctgccctctccttgccaatcactgccttctcactcactctcattttgaaaccctcacagcaccaggccagcctttttattttattttaatttttattattttgagacattctcgctctttcgcccaggccggactgcagtggtgctatctcagctcactgcaagctccgcctcccgggttcacgccattctcctgcctcagcctcccacgtagctgggactacaggtgcctgccacagcgcccagctaagtttttgtatttttagtagagacggggtttcaccgtgttagccaggatggtctcgatctcctgacctcgtgatccgcccacctcggcctcccaaagtgctgggattacaggcatgagccactgtgcccagcccaggccagcctttctaacctttattttcaaacaggaatggatagcggtttcctggggaggcgggggcgacagtaagagaatgagggggtgacagccaaggagcatagttttctgggggagggtaattaaaatgttccgaaattgattgtgatgatggatacgcaactatgtgactacagtaaaacccagtgatttgtgtactttcagtgggtcagttatgtggtatatgaatgatagctcaataaagttgttaaaaatatgaacggacaaccaagaagcatctaaaattcaagaaaagcttggagcaagagaaagcagaattaataagcagggggaaaaatgaagaacactcagttcattcagaaaaaaaaaacaattttttaaatgaccaattatcctttgagagactcaagaagatgctgcatccacaaaataagaatagggagccatgaaaaaggaactatccaaaaacaagaaagagttcttgtgaattattaaaacaataagtttcctaagagataaaattttgattaaatgtctgcacaatgaagtcagggataatccctagagcataaagcaaaaggcccagacactagaaaaagagaagtttaacatgtgataaccagcactttcagagtgaaagaacagaaaaacagaggaaataaaattaaaaaggaaaaaatagggaaaacttttcccagagctaaaggaagacaagaatgtttaaaataaaagggtcttgtaggaatgaaaaagatacccatgccgaatacatcagtgtgaactttcagaacatcaaagagcagagcagagcctaaaaccttacagaaaagataaaacgggtgattgacaaaggatccagaagccaagaagcatcagaaataacagatcttacgagaccgtgtaataggcttttgaaattttcattgaaaattattttgaatggagaattttatattctaattctccaccaagaacaagagtactaaatctcaatctaatagtgggaaatcaagagatactgcctgaagttgatggaacaagaaatagaaatttcaatatagtgtttgaggtgtcacaggttgccaataaaagaattaaagtactattaccttcatggaaaaagagatgtagaatagagaaaagaacataataaaagctagatctttatttttcatacctaggaatggaccacttcttcagttgtaagaaacttaaatctaaaaatactacatagaggtaataaatataactctgagaagtattgaaaacagacatggttaaaaaaaaaaaacaaagttgcagctaaggagcaggtctgaaaggaaaagggagggatcccagggggagaagaaacccactgctttttattttaaaaatgagatataaggccaaactttttttttcaactaattaacgggacttttaaatacagatcctagaagcagtgcagagagccaaggcttggcatttgggtagctgcgcacttccaaactatactgcatgaaagcatttcacagaccgtgagttgtccagttacttaactttgggagatactgtcattcttgatgtcccttttacagattcaaaacatacattaagttattaaaagctctgagaagttctgtagaatataaaccattttgacttcatttaaatacaggtcaatttgctgaaagaccaatttgatgaactgttaatttgccgatgttactaaatttaccaacttttttaaaataaagatttaatactcacaatgggattgttttcaaagttttgataggaatgtgcaagttgcaaaagaaaattaaatagccaaaaagtgagtagagcacacattaatataaacagagaagattttacaaatgagatttttagactacttctggtttcttttggacatttctggatatcatttttaactttgcttaaaattttaagcattctaaggtttactttccctcatttcctccatgacctactggcctttattgtgtatttctaacaattaaacatttaagttaaatgtaaattcaaatgcatctcaaggacatcagaattttaaattaacttagatctaattcaaattctaaacggacggaaacacaaaattaaggttaaactatttacaaattggtgaaagaacattaaaaattctttacaaaataaaataacatttttaaagcatataaaaaaataaaatgtagttgaaacaatcctgtcacatatgaaatgccaaaacttcaggtagaaaaattgtatttcatataggaattgttcaaatgatgccgaattctgttgtcagccttccagcattttagaattttcttttctactgatacctcagacaggaaacatcttaatattagttaatacagtcatgtgccacataacatttcagtcaatggactgcatatgtgataatagttgttccacaagattatactggagctgccctatgcacctatataattttaaattttatgacatatttttgccctattttttctatgtttacatacacaaatacctgccactgtgttacaactggctacagcattcagtacaataatgtcctgtacaggtttgtagccaaggagcaccatatagtctagttgtgtagtaggatttcacaatctaggtttgtgtaaatacatttcatgacgattgcgtgacaacaaaatcatctaatgacgcatttctccgaacgtatccccattattaaacaatgcatgactatattcagaaaagcatctttcattgtcagcaaaacaggatcaaacacttagtagacagggctactaaatcgtcatgggtaaatgtgcatatctgaaaactaggctcttcgtggacttggtgtacagtgaactggcttttgatgaattggctttccataattgattttcggccaactgacctgaagccattttacttaacctagcttttcccaaattcatttgaccaggattctcttttcatttcaagtcaatggaacaattatcctgacagaacacactctggaaaccactactcaacaggaaggaagtcatatgcttgtactacaggccctggggaacagcaagccgactttgataataataattagcaactgctaacaggggaattaatgagaaaagaaacttaacttatatccagatgccatacttctataaatcggcagactatatattctattcactcatctccactggtgaaaagttccacgttttatattaatttttattttacttttttttagagatggggtcttgttctgttgcccaggctggagtgcagtggtacaatcaaagctaactgttacctcgaactcctggggtcaaaagtgatcattccacctcagcctcccgatgagctgggactaaaggtgcaccctaccatgcccagctaattttctaattttttgtaagacaaggtcttcctatgttaccccaggttgatctcaaacttcttgcctcgagggatcctcccactttggcctcccaaagcactgagattacaggtgtgagccaccacacccagcttatatgtatttttttaaaataaaaacattttaatagaaaattcatgggtgggaatgaagtgtttgtgttttttctctctcatgttctttgggtctgagaaagccttacacagcatgcttccatgtcttaatactctcccactcatgatggctgctgtgggaactgccagcagtgagggctggtagggaagaaagcaacacaggccagggatcacacacttacgagcccactggggtagacaggatgtggacgagtaaagccagcctggtggggaactagtggagactttggcaaactgacagagaatacgccaggtttaagaaggcagctgctacccagcatagctacagctgctttggggatgtggatccactgtaccagtcttctgattccccaggcaaaactagaaatctaagttaaaaaaataaaataaaatctcctgctttttagaagttagcaaatatttcattaaaatatccaccatgtggctaatcagaaatgtttcatatacatgaatgtgtatatatatatgtgtgtgtgtgtgtgtgtgtgtgtgtgtgtgtgtgtgtatgtgcatatacatatatgtgaaacaaagtaacatcagttgtattaccttaaaccaccaagttacacaaaaaattataagcaaccaaagctatactaactcctcaggatgttgtcttggaaccagtcggaggaaggaaagggtatgtgtggtcctaaccttatggaccacatgataactcatgacaagagaggcagtgagaattggagctgagttagtttgttttgtactttatttgtggctgagactaaagaagttttggaggattttgaaactcagaatctgaaagctagaagggacattacagtcatgtgggcaacctcctattcaataaaggaattatttgggtacaattccaacaggttgtcaactagttgttatgtaaacacttccaacgatggagtgttggatgctccattattgggtacctgaggtgttacaaactgttcttcctaatttgctggcatgaaatgtgtctttcctcaattccaagtaacaagtcctagttcctcctcctctggccaggaggaaaactcttcttccttcctacaagacagccttttaaaatgtttggaaatttacagcaggtatccctctccttcacagtcttttaaccttgtgatgaaatacctccagttctcatcagccatttctcatcatatggctacagaattcttctcatgatggtcatcctcagctagaaactgtctagacggggtgatggatacatgtaccccatcctttgatgttgatactatacttaaaataatgcagcctaaggttggattagctttactgcactgcactgttctctctggaccccccagatatatgttatgatttttatgttgtatgaacgaagaaatccaattcaaataggctgacgaagtaaaaataaagtttatcagcctaattgcttatgcaactcaacagtacaggagtaaatgcggtctgaggcagtgtttaaacaatgtgatcaggatccggttttcctctttccatttctcacctctacttccttggtttctttttttttttcttctgatctcttttagtcccaagaacgctaacggcctgcagtcttagggttctatgctcccttagttatgagcagtagtaaaggagaagtcttctttcttaatagttcgaatgaaaggccaagaacggacgaccatcacggctccaacatgaagccacctggctaacatgggtcacatgaccagggaaacatgacttttctagctttagccaatcacagacagactgcctctgtggtcaatcacatacacacgacatggctaggacccatttgaagttatattaagaaagaatgcagaaattaatgttattggaaaaaccaaaaataatctactaaacactagaaaaatttctccagcctattattgaattttacttccaaatgaagacttttccgtgtacccctactcactttgatgccaaatgcttctgattaaggaattaatttgaactttggttcagctctccaaaagattcttctctgctttgaatcccttccatatttgatatacataacttctacgtattcttctcattaagtctttgattaatgagaaccattaagaccaaaaaaacactgagctttgaggcatataccccactgcgtatttccccaaaggggtctatcaatctgtgaaagactatggttcagaaatagctatttaaaaggtataaattaacctcactaactcctatttttccatccataggaaatgtgccaggagacactatcaaatgccttgctgatatcaaggtgcactgtttctgtagcatttccaaaataaatgctacattttgtagcattctggctatattacttaatgcctgtagccagaaggagatagcacacaggggaactggagaacctccatagagtatgtcacacactgccatcaggtacatcaggtcctgacataatttctttgctccaggtaggacctcagctgctttctagagatccatcttttccttttccagctctcagacttcctcctaaatggctggcttgtgctctggtccaagtgggtcctgctgttcccttggaaattctaagaacctgctcttgcaaagctcaatccccagtgcataacataatggcggagagctgctgcttccttctctctcatgtaattgtcctttcatcagtctttttattggattctctttaccatctttgagtcgttttctatctgaaatgtttattagactatttctgagtggaatagtacagtggacatctattcttctggtttgtccagagttcacccaccctcctaggttttcaagaatgtctgtcccatttcaaacctgcatttttggcagggctgccagcacctcatctccctcggtccaggcagggttgggtgtgagacccacaaaggccaaagccatccatcccaaatacacagtttttaaatctggagctggagggaatagaactttttcttttgttatacagatagcagaacatgaatggggtgggggggaagaagctgctggaagccatctgtctcaccacgctgtggacaagactgtgaggaagaatgaggacagcatccaggaagggaaggaaggagggagagaaaaagaacgcaagagcaagaaagcaaaggagccagacgtcagtccgacggcccagactgcatccctgaattccatcgcagtagatctgtggctggctgtgcagtgtgtaggcaacagattctactctgcgtgaaggtgctcaggtggatttctgttacttgtattaaaattagcatcacagagtcatatggtaggaaaacagaatggtatagtggaaagaccactagagccctctgtagtgtagtaatagtttatacttttctaacaaagccaatctgggttcaggctgactcaaatgctttaaaaaattatagccaaaataaaataaatgaatccatggcctgagtttgaatcttggctccgtcatggagtgtgcaagttactaagtctcagcctcagcttctgccacagaggacaagagaggttaacatccttctcactctggctgtgaggattagaaggacaagcaagttgcttggtccacagtagcctcttaataaataacagcaattacttttcagttaaagaaagttgaaaggtagagtccttaaagtcctttcacctactcccctagaaagatgatgctaaccaatagctggcagatgcttttatgattgttgaatccagtttatctcacgttgggaggacattacggtgctatttccaattacaggtgagagcagatttgttcctctttcatactgaagggcagtgttattatgattggtgtcctttatgcaggaagagcaatttccatcatctgtttccctctttgcagagcagggcactgtctccactcctctcactactcccaagcccctgctctctccctgttcaaaggctatggctggccacccttgctacttcagttccccagaacctggctgggccatttcccttaacacatctaacaataagaatagtacacatttttccattctatctcacgagctcaagagctttatactaaccagcccagaagatattttccttgctctaaataactgtaattttgggggtcatttataccccactttttatttctttcaaggacctcttactgctcattataaatgccattatccttctctacaagcgatcaaatattataaggtctgacaagttagttttatgtttgcattgtaactgaagtcccatccatctatccttcgggagtttctgaaaactctatatgaacttcactcaaaatacacaagtagcatgtaagcgtgctgatcatattttcaaaattatgaagtgtgtcctttacataaaattaaaatgggttttaatgtgtttgagtcattcaaagttttatccttcattacccatttttcaggcccacctgatttcttttggctccctacaggggaaatgggatttctttttttcctactttctcttccacgaggtgagaaaaagaaaagagagcagcttggtagctgcacggaagccaaacaagagactgattcaacaggagaaattcaatgcatcccaaaagattccctaggaatttggtatcctgctgcttagagtacaatttgttgtaataagaaactgaaaatttttctatcaggaaagtcaaagtgctcagtgatggcttgttcaagttaaaaaaaaattgaactacaatggaaaatgtcttattctggaaatgctttcacaacataggaagcctaaacacaatttctcaaatcatatatattgctcatacacactggtcaacacaaacaaatgttttcctgttcaggtgacctagccccatacatactggtgaaccacaaacaattaaatgttttcctgttcaggtgacctagtcccaggagtggagtgtggcttccatcttattccacaaggaagttgtttatactgaaagtcaggcaaatgcaacagagataaagtctttttttttttttggagacagggtctcatgctgttgcccaagctggaatacagtggtatgaacatggttcactgtagcctcgacctccatgggctcaagtgatccttccttccacctcagcctctgagtagctggaactataggcttgagccaccatgccgagttatttttttctgtgtgtgtgtgtgtgtatttcttggtagagatagggtttcatcatgttgcccaggctggtcccaatcctgggctcaagtgatctgcccaccttggcctcccaaagtgctaaggcctacaggcatgagccaccttgactggattttttgttgttgttaagagacagagactgactcttaacccaagttggagcatgtggtggttccctgcagcctcgaactcctgggctcgagggatcctcctgcctcagcctctcaaatagctgggactacaggcaccaaccaccaccacgcccatctactttttttatgtttagtagagatgaagtcttgctgtgtcacccaggtctgtcttgaactcctgggctcaagttatcttcccaccttagcctcccaaagtgctgggattacaggtgtgagccactgtgctaggcccacaaaaggtatttcttatgtcctggcctgggttggtggctcaagagccaagcaaggtagacggggaataagtggggttggtccacagctgtgggattttggagtaaagggaaacaggtatccttgctgcaggtagggaggagcagcagaggagaatgtagaaggtagacagtgagcagagagaaagtatatgagccagaatgaaatatctccaaggaggataggccagacagaaaaacaaatggattctgaagacagatcctggaattagtatctaaaacattagagttcaggaagccttttaggaccacgagcatctatgggctgggtgaaagctatagctgggaacttctgttttccttggatactgcaaccaaggaggcacaggactggggtccctccaggttggacaaaaactttcactaggaagttatccaaaggtacaaagtagattctagtggctccctcctggtctgaacttttcccagtagactactgctacctagaatgactcatgctgttacaggaaatccagcagctccccttagcacatggttcttgactgggagcttgagtgttaaaagaggggattggattatcagaaagagcaggatttggtgaaagtcaaatggaggaatttggcatcgggaggatattttacaccgtgctttaagataaaggtttgaagacctccagttaccttgagggggtttggggggcagatcttccaacttccagcagagatgagttatgtgtatggaccaaaaggggagtcaggtggcactgccacttaggagagttctctagaacccagtgttgatcagtgtacttcttaccagaacttgggcctctctaaggtggtaatagtgcaggattatcacttctgatttgaaattaggagctctgctatttaccatctttattttatttattttattttatattatttattttattttgagacagggtctcgctcagtcacccaggttagagtgcaacgacgtgatcacagctcactgcagccttgacctcccagactcaagcgatcctctcacctcatcctccctggtggctgggactacaggcacatgccacctctcccagctaatcttcacatttttagtagagatggggtttcaccatgttgcccaggctggtcttgaactccaggactcaagcaatatgcctgccttggcctcccaaagtgctgggattgcaagcgtgagccactgtgtccggcctattcactgtcttgatgacagagagaaaaggtatgggtttccagggtcctggcatagccagggaagagtataaaaatgggtaggaattatgtataacttggggtttggggggaaaaaggaattgatatccttgtcccaggtaaggatgggaggcaaaggaggggcagaaatgagaaatgcaagtggaatcatgctgtcacaggtcgccctggccagatgtaaagccactaacttcatattacaggctttcttggctccaccccacacggtcctggggctctcagaaatgccactgcacaatttttgttgatacttaatcacttggtcagctgtaactgtgtataaagaacccgaaagtgttttaggcagattatttctcagggcagaacctctattttacacattattttatagtaaaggtaggtgagagtttaagtttgattctaaagctatcccaggctgggttcagtggctcacacctgtaatcccagaactttgggaggccaaggtgcgaggatcacttgggcccaggagttcaagactagcctgggcaacattacaagaccctgcctctacaaaaaaaaatttctttaattagcttggtgtcagggtgtgtgcctgtggtcccccctcatctactcgagaggctgaggtgggaggaacacttgagcccaggaagtaaacactgcagtgagaagtgtttgcaccactacactccagcctggacaacagagcaagaccctgtgtctcaaaaaacaaaataaaaacaaaatgaggctaccctaaaatagctgcataaacaaagccatgtcaaatgatgatattcccccatcagtgtcccctggactgctggcttctgggagaaggcatcctctggtggccaactagcacccatcaagctggtcatgagcacagcctccagctttacgccagtcactccaaggcctgagcatgctggccctggcttctgggtacccttccagctcagaggatgacagtgtggagctaaacaggggtttagccatagggagggctttgggaaatcagaggcactagattctctatatgaggctttaaaatagtagaatgatgaatgaaatcctgaaaatcaatcggggacctccaagagagataagtacttgatccactgcagggcctcctactctagcactctaaaaaccttgtccatcactggccaggccggatttggtccagcaattcctcctcaggttgtcaaaggcctggttttctggagatgctcacaggtgcccctcagctggctgttgaaggctatctgtaagctccaccagaatgaggactttgtattgcctgtttcgtttaccacagtgcatttaagtaggtaggtctccataaatatttttgttgaaaaggatgagtaaaagtgcctgacccaggaatgtgagatgtacccattcaaatcaactatgatctatacatccaggaggccatgcagtaagctgagaatcaggtagagaagatgggcaggcttctttagtccaaatgatatctcttgctctgtctcctaccggccaaggcatatctaaaggccatattcgacttcttgcatacaaataagatggaggttcctacagagatctgatttcctaaagccccatgcctgctagcattgatgtggaaagacacacacagacttggggcaggacgacagctgcacagtggagctcataacggggacaggggaggaacaagcagcttctcaattctcttgtctgaaagtggctgtggactatatctagcactcttgctacagggagagttaccagaataaagttcagcagcaggttctggcaatgctgtccagagtgaaacagaagatggggtcctctgaaagatggttgagtagtggcctctactagccaggagtgaaacactatagagatgtatggccaggaggtgacggaaagcacaggctttatgcatgttctgccatgtgcagcagcatgttggaagcaatgaatgggtcacctccccttcccagtaggggctacacatacatcagcagcacccaatcattttgtttcatccttaagacagatgggaaataggcaagctggatgaaggcatggtatgtgaagctgccagatcacctaagcctgtctgctgtcatccaaagctctgtcagaatgtgcaacacttgttcaaatgcctgaggtgacagcaatggtcagaagagctgctacattcaggagaaggagtaggcccaaggcaccctgcctcctctttttcagaggtgttgaagggccagagcttatgccagttccatgcacagagtgtcctagatttttcttccagaagtaagactacaaggctgggtcattctcacaccaaccagtaggttcagtgctggaaccactccacaaagctgggcaatgaaggtctttacccaaacgtacaggtggcatctcaagcaaggtgattagggctaaaggaagtcaaggtactttagaggagtagatggctgaagcagagatgttctcatttctcttgttccaagaaaagaagagccagagaaatcggtcataatgttctccattacctcctacctaaaccctcatattagccttggattatccataaaagtaaaacataagtaatgaggcctaagcgcaagtcagtggtgtaataaatatctactagtcattgtcatatcttctttccttcttcttcatcttccctctttctctattttcccctctttcacctcctttttcattggattttatgtctagattctgcattaagaaagtctttcagaattaaattaaaaggcttatatttaaaagtttttaaaaatgcttgggtcttgacggacccttcgcccatcactgtgcaggtgatcacggccccagtgtcccagtaagaaataaaccttacaaaatggacagcaaacagaaagaggccctgattaggcatgccagataattcagtatttcacacatacgaacacacgcacatacagagctcagagtcttgtatcgagggtcttccactaaagatactttaattgaaaactacagcatggaaaacatgattaagtggctacaagattactgttcactttaataagcagagaagaaaacatttattcatttatcaggtgaaataattctctaaatctcatcagagacaataaatggcaaacaacatacgtggaaagaatgttggatgaagttcagatagttatttcttcttctggggtgagaactggctctgagttgttctctaggtcctactccatgagcatggattaggaaaagttctaaactagatacaacagccaaggacccagcctgccctctaggaatgagcttcgttgtcagagacaatgacacaagcgtcctcagagagcaagctaacaacatctgagcaacaaggagagatgcgggattgggagaggcagacccaaagcaagcgctgggtatgtgacggcatcgaacgcgcgctcaggtcctcccactgtaatacgcacctgggatgcggggtcaggaaggcaggcccaaagcaagcgctgggcgcgtggctgcaccaaacgtgcgctcaggtcttcccactataacatgtacccggcaagctctgcagactcctgtaccagaatgtcacactgacaaaaacccatgaaagaacaactggagttcttcagaaaagcctgcttgaaaacagtagaaggtactgttatgaggaaatctcatagtttatcaacctatcttccaaaccttctcaaaaaaaggagaaaaaaaaaatcccccgcaaaattaaaaacgaatggggctgctatgtaattaactgacaatctctcagttacaaacccctgatttgtaaccatggcaggtacacaaactaccagctgcattatacttccactctctccacctgcccccattttttctgacaacaaagcacagaaaactatctgagctgaaatctcactcttatcagctttcttctccttgatggagatttcatagcccacctcccttgcctctttctctgatcacaacttaagtctcttcatcattcttgttcttctgcctttttcccaggtacgtcacaaaagtgtcattcccaccagcacaaaaatactatttatggacaacaaaattaatatcaacaaatcttaccctataatgtgggctttgatgaaagaagagatgaaggccctaatacgttttgaaatggctttagatcagaaacaacggaagtcaacgtcatctcttctcatattttcttgaggaaagagtgacattttagtgtgtgtggtgggggaggtacaatttggaaatggttatccaaatttaaaataaatataactttcactttaagagcagggggacctaacttttgatgtaccaagttaccacttaggaatttctcatgtggatttaccctatggattcaattaatcatggcactgtttgacacagtacacataaatggaaacgacagagattgatctaaaaattatggcatatccatgagatgaaatactatgtatctgttaaaaagaataaggtagctaatctggagctaatctagacagatgtctacactctcttgtaaagtgaaaaaagttacagaacatgggctagggagttatccttttctctctctctctctctttttcccgcacactaaggaggacctttggcttggcttcccttccttttctctaatccccactcctccatacaccacctcagcaggcatatttaaaagacctattggaaatgagtctttcccccagcaagacaagcaggaaaaacgcagaagtgcaggagaaagtggaagagcccacgtgaacagttctgaagggaagagagttgagagtaactgggaaagcagaataaaaggaatgggggaagcagggctttaaaaaaacattctgtgtattatgatggaaccattgttcatgttttctggcgaaggttaggattactgtttactttcaatcctctgacaccatgctaagacggaggtctatctggctctggaatatattcagaccggccactctcacacggaacatttccagaaggaaacttttagccatgtttatctttaaggagtgggacaacagtttgaagatgaggctgatttttacctttctgtcctcttaaattgtccttccctacaagcatatgttaatctcgcaacagaaatgaacagaacgggcgaatgtcctgaaagtcctcttcaaagccggaaacaccctctatatctccttatcactctctagttccgaaagaaaagtcaaatttaattaatattcgacgcacaaaaattttaaaacaatgtgctcaattttgtatttttctctccgtttttaggggctggggggggaatttatagcccatacagtggtgctatcaaaggctgagtagactttcatgggttagtctggagacatcaccataatctgtaaccatctttaataggaaaatgcatcccaagttctgaactactaattggcgaattaacattagactaagttaaacttttaaataaaatttatgaagtattttaaaattatcttcattctacttcctgtttacaatgctaagggacagatgagtttccatattagtcacatatatatgccgatactatcagaagacatactatgggctaatactaaacattatacattttgttgtatgtgatttctaacttgttttatgaaacatgaaggatgtaatgttgagttgcgtcataaaaactgagtaaaatctattgagtaaaaataaatgagagtagcaagaagggagctgaaggccataatttggattaaaatggaatagcagcactttctcctctaaggtcagcaattaaaatttagccaaggtcaggagtgacaaaatcatcaagaaagacttgacctccatctagttgttgcaaacaatatattaacattgtaaaactgttacagcagatggcaatgcaatcatcccttggtaactcatgcctagctaactgtctgtgtccttggctaaaggtgagcaaaaggcccacctcctgcgtctgcagggagccgatgcggggggctgagagcactcagtgtgaattccctcatgcacatgtgagaggtgaaaaccactgccaacttctccattcctgcctttgttccaaaattgctaacagggttgcagggtacctgacctatttgcatacattccttatttttacctctgcctgagctaaaggggaaaaaggcaaagtatgacaacatctaacctgcccatttctctcaactttgttggttctggtttatttatagccttttcctcaactacagctttaaaagcaaatgattcgtacctcactcatgtgaagtggatcaatgcagattggatttcttgaaataccaccaaaaagcaactcaacacacgccagggaagagaaaccaagggaggcttggaaatttgtcacccagcataagaacacagcacacacttaaagagattgtgacctgccaaacaccatgtaaatataaccaaacgtttcccaaacataatggactgtattctggtggaggacttggcctcacttacaagaaaggcctctttgtttaaagtcagtcaaactgccagctacttaaggtgtaagttagtgcctcaaagaggccctggtagatgtggggaagagaaggttgcaaaatacgtgcagaacagacacccgtgtaggtgtgtggtcttctttatggatgtggtggacccatgtaaagtttctgtgcttaagagtggcccgagcagggcagcctgagtgtcgaaagggaggatgaggcagaagaatcagtgcagcgctagccaagagtgaggaaccagcagctgctgttgggggcctggagaaagaagggtatttttcagtctgcatcttttggatggagtttatccactcacccagaggctgtttggcttcctcagagcaagccctggagttcagagaggtaacgccaaccatctgacctgcctctttttgcaacactaaggctcagagaggaagccttatctctttgaatgcgattcgtattttccgagaacccacaagatcgatcactctgagcaggcatttcactgctcatgggaaagtctacagtctcagccctcaagccaatccctcatacatttgattaaagctgactcacagtctggattccaaagctgttcacccacaggcagtggaggaaaccatctacagaagtcccgaaaacatgctcagggtcaggctggtggcactggctggccagggacctctgccatccgcctggctggtggagcctctgccgtcttcggggtccttgtggactgcaccaagctcctggctcacgcctggcttcctgaccaaacacctcatttctggtttactacctttgtccaaacaaatatcctagaccctggactcacttctgttcttatgttgaccctgggaaattcctctccctctagcgggaacaggaagtaccctggactctcacgtttccacctgctcctcttcgcttacagccattccctgcctgttgtcctacgttgcccctttgggctgacatggtatttgcacagtctgcaaagctgggaaattaaagatctgcccaggttggagcccctgttctccagggacctcctccctctgccatcgctcctggtcacaggtgctttcgaggtaccttcccgccagcaaccttgttctgtgctagagactgagccattcccacctcagattatggtccacatgtctccgtgcccttccccttgggctgctctccgtctcaccttctagaattatgttctcagccgactgcaaatcagggtgcagcatccaccagcgcctaactctcagcagttcaacactacccccttcaatgcttttctgagttataaaaacatctcagggcaaaacacctactggtctccaggagctgagatcagtcaagaagcaattacctatagttccttcacctgactcaaggagaagctgaggcagggccgtctccctgctgtcctccctggctcacaaggtgattatgaaggcaaatgattcaactgaaagcataaatcctgagagagataaaggaccattcttactgtcagccagaccaagggccccatatggccatcctcacctggaccagcagaggctcatgacacagcctctcaagctaggtctgagcctgcgttcctctacagctcccccaccaccctgagcccgtctttgtcactgcaagcgccacatcgtattgtaatcatctgctccagatagagacagcatctaattagtttctgtacacccacggtgtctgacacatggaaggaactttacaaatgatgaatgaatgcataagtgaatgaacaagaggagtgaataaaataagacttggttttaaacaatggttgagaagcagctggaaatgctccatgcaaagtagtaatcagaatgacttcacaacatggatcctttgcccaacgtgaagacgtcctagcccttatgtcagccctctccctgggacttgcctgtatggctccatggtccgagtaccatagaacaaggcttcctccaacaggccgaggttgatgcaggcatccatggcgcagtcgagcaccttcagctggtagatgttgatatcgggaagccgttcagaattgctgcttatgattgcctggcacatggccagaacctgctcccactctgttattaaccttagttaaggattcattgtcttcatcaagaaaaaaacaaacaaaattagattctctaaaaggctaaagagctcccaagcacaggagcgagggaagcacccgttatttttcacagatgagctgcctgaaaacacacttgagaagcaaaagcacagaagaggcatctcagtgaagtgaattctgtttacatcaacaaactatctcgtaaccaggcctgtgctttggagttttaaaacttccaaagacctgttcttgcttcatactcctagatgtgttctctttaaatctagtcataaataaatgcagtcctttattaaattggactaaagattaagttaattcgattttaaattatttactctgttagcttctgtttaaaaactgtttgaaattaaagatgctttagagagattcctttttcaaaaggaagagctcatgtttgcttctgtgttacctgagttttgggcatacatgaacccaaaaactcacacaacccacaggcacacactaggtggagcaatttgaagacatagatttccactgggtctcattttttccgattataaagcaacagtgaccccagcctgtacttaaccaaatacattaaaatatgttattttaaacccccaaaataagagacagtattaggaacatggcttatgcacatcaattgctggcaagggaaacgatgctttaaaaaggatggggagaagactcaatgtccacttctcagtaactgcctttctgattaaccatgagtcagtaacttcatctcatgtagccttggagtgacttcgctttttaaaactgatattccctgtcttacagaggcagtcagaggactgaggacatggtttatggagcgtaattttaatccctccccagtgaattctctgggaaacacagcgaaggccagagtgcaggaccctgggacctcgcagtttcttcactgtgcggtgtgttaggcgagctggagaccaaggagggtgcaggactgggactggtccttctctcactcctgtctcaccttcacccagtggagctccaaattcatctgcttcatatgttgtcattccagtagggtgaaaaggtttgaagatcagaaatggcagcctagcctttgactgtagtaaagctagattcagatctaatcgagtcctgtcatttatcagagttgaggttctgaggaagtcaaagtgcttaatgataggccagaaatagaaatgactcacgtcaacgtaagaatgagtaatatattgtatgtaaaatgacacagttcatgatgtgtcctctcatgagccagggagagttccaggtgtcagagacacagtggggaacatttcgtggcatgcacaaagcacatgctacacaagcattagtgccttccaccttccctctgtgacatgacctctgagcctgactgggcttaaagaaagtggttcagtggactgagtttgactgaactcagtgcccccttcgtgcccccacacccctcccactcccacatgacctggtccctttacaatccatgctctctgtgccatcccctgcccccaattcaaaaccctcttcactgaggtcctaacagagcacgcccagccctgagcagacagctcactgtttatggtcccctctccctctctgtccagcaaaaccttcctcttcgaatgtccatacccttctcagaacacggctttctgaaacattagcaaatacttctaataaaccaatcaagccactcctgagagtggagacaaatacctttatgaactttcacagcaaatgtattttctttccagcaaaggcctcccggagacacagtatcttactccaaaagatgagttccttgatgagaatttaaagcaccccaatgcacagctgagagcctgttccatcacacccactacaatgttaggatgagtcccgtcttggaggaattgaccctgatcccagaaaaggttcatttcctgaagaaaagcgagtgcatgatttgctcttgcattcatctgacatgtatgttcaaagtttgctgaatgtatcccctagaggttgggggaagcagtatcttaggcaacgcactgattttgtaacagattgctgggctaacctccgtggcttttcattccaggattagatatttgacgaactgtcaggaggaatgactgtctcttacacattgctagacatttctgtggcaagacttgtaccttattttaacattgtgctgtttgacctccactattatttgcctgttcatttatgtatgttcccacttattctaaagaggttcgaggtgacaggccttagaagtagaagccagatgtgatgttctgcagctactcataggaatgcatttattttatcccccagcaagctggaagggactacgtgccaatttcccttcacaatgctggcaactgtctcttgccaaacaaggcaaaacctttcctgcaaaacaccccagtgagccaaaaaatggaataattttaactaagaggcttttccccccaagctactactgacatgtatttgctcaaagatttagtccctggcatctgtgtggtgtttactacaattcactctgttccagtacggagctgagctctagacctagcagggctggagagtgcacccaaagagaacagattcctagtggacagaacggatatctttttttcctgaatacttttaaatgaccataagaggatcaggggaagagaaagggaagcaaagtaaattcacttgggaattactcaacttactgagattcaatgactgtcagaccacagagcttttattcacttaatcatattactctactgcttaaaaaatcatcccatggcctcctctcacctataaagtctaaccggtgcatggcagttaaggccttgccaccttcccctcctctcatattgcacagccagcagcttctcagtagcaatgcatgttctgcgcgtctgcacaggtcattccttgtgttggatgcctcttctcttggttggtctggtgaactcccactaatcctcccagacgcagctcactggtcacctcctctgtgaaatctttcaacttcccaaagttgactattgtgtctttgatgccgccataagtctgtatctttaccaaaatatgtattaatggacattttactaccccacaatataggagagtagtgagtgcagggctgtgtcttctaacttctgtctgaaccatcaggtgaatgatgaccagcaaggtacccagcacacagtccgttttcagtaaaaccttgtccagttgaaactgaactctggctgggttatccatgggccccaataccgctgccagggaccacacagaacaggtctactcctctgcacataaaggctctttgagcccatgagcagggacctcctgcttccagagttgactgttttccgttttcctagtatcttccatctcatcatagacagcgtttcaaatccctccttaatttcagttccacccctcaaaactagtttgtttttctatatcctttttaatacttcccacctcaaactgaatagaaaattccagaaataatcagactggtactatcatctctatcattttataatcaatattaatgcagcccaagatcacagtactaagattatattatactcttaaatgttgttaaattttgctatttactaaagccctaaatttttttcacatgttcttatgcatatttacatatttgaactttttgatccgaatagaaattttatatatgttcttgttatatttcatgtctttaaaacttggataccatttaaacatttagagatcttttgaactcttttttttctttcgagatactgattctatcatcccacctctattatcctccccatctacgtcactttggagatttgataaacctgtcctctgtatcttcattcgaggtatggaattatgcattaaagaggcccgagatggaaaaacaacactccagaatgacactgaatcatgtaacatcattttttcagtgtagctattcagttagctttgctaacatctaatgtaagtttcttgattacttttcgtcaaatccctttctaaagtctcgatacaaactttaccaaagaaagctgtgactctgtggattcattcgctcttggagaaaccaggcagcactgtgatgatcacagctttcttttccattccttagtaaccaatcctagattctttacccaagactgctaataaactcagtgggctattgattcaaaattatgtccttcacctttaaaactggaaacctccctctacctccttctctggctctttacaactctttaaatagcatcgtcagcaaattggaaacctcatctgctatgttcttagtgcctgggatataaatttaccccagagcctctgaatgaccttttgcagtcttttcatccaccttgatctcttccttcttgcctgctgtttcccttcatcacagcttcactccaatgaactcctctaccaggagcggcctccttctcagccttggcctatccaaatcctgcccctgactcaggctatcttgcacagtaaaacattagtggagccttcccagatgaccttcatcctacatggtctctccttactctgaactttggtccacctgtggtcattactattcatgctgagaaaatgtgtcgtgcagcaatccccactgccattgtagtcgtggctggtttaatatgaagcttctgggtctgacggtcaatggcactgaatgataaggattctaagctactctttcctagagatgttagtggttatgggagaagaaaattgaggaatttgttaccttttacatataaagagactaattcttactttcctactactgctaggccatgagttttgattattacctaacggtagtgagttattattcacgctgattttgccacgaacttccttgtcattactcaaactgctggccagggtcggaggtgcggcctgtgaccatggaacagaatgaaaaccactggctcatggagaggtcaaaccccgcctctgacctcattacgacagggcttcaagaaaacaaggaaacaatcccaacagtccacctcaatccacaggcgaaaggatactccagtgtgccttcagttcttcaatttttttcagggattcttgaacttccttccatacttgctcatcaccagttagcatatcagcatcctgctcaggccagaaaaggaagacaaataatctaattagtaataggcaaaggacgtgaatagacctttctcccagatatacaaatggcctgcaagcccctgaaaagatgcttggcatcatttatcatcagggaaatatataaagcaaaaccacagtgagatgttacttgatacccactaccatggctataatcaaaaagacaggataacagcaaaggttagtgaagatgcagagaaacggaaaccctcatacactgcacatgagaatgcaaaatggtagctttggaaaacactctggaagttcctcaaagggttaaacgtagagttttcatgttcccaattagagttaccatattaacagtcctactcctaggtatctacccaagataaatgaacatgtatgttcaacaaaaacttgttcacaaatattcacagcagcattgttcataatagccaaaaaatggaaacaactcacacgtctatcaataaaatatccagacaatggaatatgactccacaataaagtactacatgctacaacatggatgaacctttccacaataaagtactgatacctgctacaacatggatgaggcttgaatacgttacgctaagcgagaagccaatcacaaagaccacatgtatgattccatggatatgacatgcccagaagaggcaaatccacagagacagagtcgatttgtggttgcctagggctaagaggattggagggaactggagagtcactgctaatgggtaggagtttcttctggggtgataaaaatgctctaaaattgacaccatgctagttgcacaactctgtaaagagactgaaaaccactgaactgtacactttaactgggtgaatttcatcacaggtgaattacacctcaataatgctgatattttaaaaaaacagaagaataggataaatagttatttgttaggagacctacagctaaaaccttattaagtataaagtacaactacacccatgtgacccaattctgacttccacctaaactaaaaacaaaatcccccaacactgaaaaaattcaaaagaaaattatgagctaccatgtatgaaatgtctgccctcctattcagtaagcaggtcctctgcttccggttggccagtgtacgtctggcatctagcacagtgcctggcacatagtagttgcttactcagcacttgttgaatgaatgactgaaaaccacatgtgtgcacaatgctgaaggctttactgatatttactgatattgatatttactgatatttactgatatcgtcttatcttcacatagctcttctatgtatgtaagtatcttcacatagctcttctatgtatgtaaggtcaaatcccatggggtaacacaggcagggagtggaaaaagtctaccctgggtcaggcaatgagagggcacactgtctatagaatactaaaaaataataataaaaaccaacgaaaagtaggtctgatgtttattatgtgcaacaattcagaggtgaaatattcttcttccccccaggtcagagggtgtctaacatctttctccctaatatatcactgatcatacccagtttatacatgacaaaactgagactcagattaagtgacttacctgacaatcactagcctggaaccaaaatttcaccccaggtctgtttgattccaaaaggctatcttcttgtcaaatattactctgtttgccacagatactgctatggtcttttcagcatgctcagcaagtcctgcttatttaaagctgcactaacaggtagccaccagccaggtgtggctatttcaatttaaattaattcaaacaataaaaaactcagttcctcagctgcagcagccacattccaagaagctaacagccgcatgcggctgtggctaccacactcaacaacccagatacagaacagttcactatgtcattgcagaaagtcctgttggacagtgctgctttcaggtggctagtcaaagggtaagcactcttagaagacactattcaaaaccaggtgttcactatccatgagactttcaacgggtgtcagagacaagaaccaccctaggaagttacatgaaagcagggccagtgtgaaggatgacataagggtgaggaacgagggacattttcatactctagacatccccctggagactgtcatgtgcccgttgaaggaggtttatagaacgaccccatgagaaccactgccagagtcagtctgtgtttttgggaagaagaaatatcactcaagtgtgccagggcagaaacaaagggaggggcagagcaccacgaaccacagaaaacagatcctgagactctccttctgaggctggggcagtgggtgtgtgtatgaggagataggagcacttgtgtctgcataattgggctttgtgggcctctatgtgtatgtgctgtgtgtctgtgtgatatagtagagtggattttaaaaagacaccataggtgcactttttttttttaattctaaatacatccctaactttctgtacatggaggagggaggagataaaatgcccttaagaaggtaaacaacaggctggatgcggcggctcatgcctgtaatcccaccactttgggaggccgagacaggtggatcacctgaggtcaggagtttgagaccagcctggccaacatgacaaaacctcgtctctactaaaaatataaaaactagctgggtctagtggcacacgcctgtaatcccagatacttgggaggctgaggcaggagaatggcttgaacgtgggaggcagaggttgcagtgagccaagaccacgccactgcactccagcctggacaacagagcgagactctgcctcaaaaaaagaaaagaaaagaaggtaaacaacagtctcccttcaaatgcctgctttaagcccgtattcatctcctaaagatcacctccctctcctgcaccaaagccttcagcaacttcccactgcctcccagatcaagctcacccattagaccttaacaatcatggtcattcctgattgaatgttccagttttacatttcacaactggcagcttaaaccctagatctaagcaaaatgttagtctctatggtaagcagaataatggatccccaaagatgtccacatcctgctctccaaacctgtgaatatgttaggccacattgcaaaggggaattaagttgtagatgggattaaggttgctaatcagctgaccttaaaatagctgagagtatcccggactttccaggtgggtccaatataattacaagggtccttagaagtagaagagggaggcaaaagaggaggtcagggtgatgtgctgtgagaagaacttaaccagaagctggcaaaggcaaggaaccagtcccctggagtttccagaaaggaaggcagccttgcccacaccttgattttggccttctgagacttgggtcaggcttctggcctacagaactctaaaataataaatctgagttgttttgagatgctatatttatgatcaattgttacagcagccacagaaaatgtagtccctaacataccttctgctcctctggccactggggctctttgtgcctggccctctctgtacctggaattacttagttagatcactcatttattccattaacacttactgagtacctaaccaggcactgttctaggcagtagggatagagcagtaaataaatcagataatcatggtgttcatactgaagaggcaggtggaacacacggcaagagaagatatgtgcatgcgcgtgcgtgtgcgtgcgcgcgcacacacacacacacacacactcacacacacattttgttgggagaaaaacaaggaagagggatggggaatactggcaccagggagttcattttaaacaggatgatcggggaaggtctcaccaaagtgatatttgagtaaagctcatttaaaggaggtgaaggagtaggagacagcagttccaggaagagcggagggcaagtgcggacgcagaagcgtgcctgaatgttccaggaacatgaggccagcatggccagagcttgtggactgcagtgtgtgcatgtcatatcttccccacttaactgtaagctctttagagctgaatataggtcttattcttctttgatcctgcctctcccaaatatctagcacagtcttatatttaacaaatgctctgctgaatgtctatagcatggatctggaagaagtgaactaacttggtaatgatttgatgtctcttgtgtttatttcagttattcctcacaacatctttgaaaggcaccaatacttgttatttacagatgaggtgcaagataatcctgaagcttacataattggtccaaatgtccttctacccctaattgccgaggtaggattcaaacccaggtctgtctggctccaaagcccatgctctttctagtaccttcatgcttcaatttgatttctctcctggacttgcttaaaaggtgaaactcatatctgagttaatcaattcaaaatatcttcacccttgtttcctaagctctatctagtactagcaattctaagaggagagtaaaatcctccaacatagaacccacagcagatctcgtattcttctatcaagcagggtgagaccgcagcccagggcagaacaatttcatatgggaattacagtcacaactaaatttgccaccagtgaacataacctgattagctgttcttttaggttgatcctaagcctttatttgcttaacagaagagcaagcaagctttgaaactgctcctaaacatttagaaatgatacctctgagagcattttatattggagctagacaaagctacactcactaatagctatcacctccctggagtgttccactacggtaactgcctctcaggttccaacttcccctgaccctacccatcccactgtggctgctactcacaattatgtctacactgggtctgtcacgtctcccctctctccacaccaggctggaggaaaacattcagttgcacaggtgtataaacaggacagaaacagaaaaactacttagggaagcataattttaatcttctactttcctaatttgcaaatagaagagtaaattactgttttttatcacagtccctgaggtataaaattagtaaatttatatccttatttccattatttcatatccaaacacaaagacacttgatataattcaggacaaagttattcaggaaaaaaaaaatctctttgaattttacttttaccacataaaaggagcttgaatgggtgagtcctggaatttttttttaggggatggaaacattcattttacattcatttaaacatcaaatatactattgctggattttctacaaatgctaaaaagaattcagcctagaagcagaaggattcctaagaaagctgactttcctgggaaatgatcgagagaatgaagaacctgctggttccagcgctggtggcatctctgccctgacccactgcatgaccccgggcaagtcttccttttcctggccctcaccttcctcacctgcagaaggagcagctagtctggatggctgctatgtaaccactctagtgatttcagcagtgcagaaccaatttagctccatctctggtgactgctcttttgcacagccccggagaagtccttcaaaagcctgtctttattttaaacagtacaatcgtagagctagtttatgaaagacagaactgtgccgttgttctcaggtaagaacgagtctcatttgtccattctctctctgaccgcacaagccccttgaataccgccctcccagttcactcaccccattctttcccctcacagctccaccccaaaatcctacccacgcccatctctgacttcactgcacccactcttccaactaaaatcgccatcctgtggcttctgtcaggactcagcgtgttttctgctgtttcctcggctcaccactccatttaagtctttggctttcttcccgtttgtccttttgggacacagcccctgctgtactctatcaggaaaccttctctggttctgccttctgggttagcctggccctccaggcccctctgcacagcccctagccctgaactgacacgaatggtttcctggattgcctccccaggtatcctcagaacgccctgagggaccgtgacctcatcatagctgtattcccagtgcctgcaaggtaaatcactcggtaaatatttggtgatagagtgaatgagaagtgatcttccacaacccatgggcgacagtattacaagaataaaataccttaactccaccacaacaaagagaatcccaaccaagacaacaggttgttcctttcacagcacacgtctaccttgactctaatattactacactaagatcagatacgttcccaccgcagctgtgggtatttgtcaaatactacagctggcattggtcatcatttagagcctaagtgtgacaccctcccccagcacaggaaaccccacgccggctccggacccacgctttctgacaatcgcgtcaagggttatttggggagtgggctcgcttacctctcctggcttctacctcaaacaccatcctgagattctaatggcgctcttggcccagaggtccctcgctccatctatccctgcatgaatcagtgaggccacctacattccttcatccatagctgctgaatcaataccccaggatcatttccttaactgtaaaaataggtaccagatgatatgagatcatctcaccaccacataaaagggtatcactcaacacggttacattcaattggccaaacgcttcctttgggtttcggagtgggaagtttacctgccagataccagtagtcactgtgaattacaaagctacgtttcttccatagggaaagtttggagtccagccaggctagctgagtataaacttgagaaagtgaccacgggctctgtcaggttaaacacacgaatccatccagacccaccttgcagctcgaacacttgaacagatgtgttcacttagcttgcaagcgtttgatgttgaaactcgtatgctgggccaatttcagatggttctcattaaaaagaagaggaacaggagaaaggtaatctgcttcccagtacttcctgttatccagtactcatgcaaactctaattagattgaagagagatggagtataggatgaaaaataaaaaattaatgaacacttacaaacttttccagtaattcaataattcatgtcttaaacggaagaaaggtttttagttttagtttttaaagtagaatgaggttcaaatacagtgtctgcactcaagagagagattggaaagtcttgaaattaaaaattctgaggtaatttgcagtgtctttgactgaggtagtctggttggggcaatatactgggactagattaatatacaacatcattcaaaacctttatgattaaaaggagacatctgtgctggaaccaatttccacctcctttgacaaaaacaactgaaagcagttcagatgtaacttgaggggaaaagtggctctttcataaagcggaaaaatagtggctaaaaatagagcattcactgttatatcaactacagaccagtcagtggacattataggctggggaataaggaaaaggaaggaatgttctcaggttgaagcacgatcaaattgtagtatgttctaattagcaattaatcagcaaatgtacacaacgattaacagaaattagtgaaaaagaatgccgggcttggagccataagatgtggaactgaatccctgctgcatatccctgctgccgagctgtgtagtcttggcaagtccttcaaccttccagaggcccaatttcttcagtggtaacgattctctaaggagatgcaccttctcatcttttcctctgcaccctctagagttacttacgtcctaaatgtcacagtggcctgagttttcaatccccaccctacagggcggggaccaacaggaggctgactagagtcagctttgtttggtgggaaagaaaaaaatggtggaggagggagcacattacaatgtaatcaacaaccaactatgctgtgaccccacatctctgcacatcccattccctttgccgggaaggctcttcctcaacgtagtcatccaagcaaacttctctgatccaccacaaaccacaccaaacagcctctgacatccacaggcacaatccctgtgcacttcccactggctttcatgatgcttgctctactgcctggcggcaatgagcgtaactgtgatgcagatgaaaagcatgtcttccagatgctgtcatcagcccacaggtgaagtaaaattggctttaaaaggttattttttcatctatttcatgaaattgtgggatctcagtgcctttaacagatgtccacaagcaggatgtagcagggctctgaattgtgagtccaagcagctgcttgcatcctcgcaagagcccaaagttcccgcctcctgctgcttcacccatctcctgagctggccgaccccaggatggatgtcctcttctcagatgagagagcccagagttcctgccgccttctccttcaccggcctccctgagctggccgaccccaggatggatgtcctcttctcagatgagagagccttctcccgtcgggcagccccgtcactcccttggatccaactgaggagcacttgggcaaccaggggctgtgagcccaatccaaacaaaaatgctcgtggtgaggagaagaagtcatcaaacagctgaagccactggcagctctgttccatttcactttacattcccaccgtcgctgccagcatttgccaaatgcccatttagctttagatctcaggcagaaacagggctctcctgcaactacaaatttccacaaaccacacattcaaaccaactgcgatttcaaggttcaatctccagctacacagaattgccagaaggaaggggatattcccttcatagcttctgggaaacggagcacagccttgaaggtatgaagtcagaacttctagaaccaccaaaggccttttccggctacagcctcaacacctcccctccctctgtgtggggttgttcccatcccagtgaataaaactgcttctcagagaaataagcttatttgcttatataaaatcaagtcaacctggagagaataaaaacagcatctacacgttgagggcagtttgagagcctacctcttgtcagtggtgcttgctaaaaatgagccttctgtagaaaagcattttgtagaaaactagcatgatgggctgatatacaaggcagttaaacacacatgaatacatttaggaaggagacacttgcttgcaccctccccccatactggaaaggtatgttcctgatgtaataacatataatggggattagatgacacagagggctatgagctccacttgcaaatgcacattcagacaaattcttttcacatctgtagagagactaccaaatggatggcttaggctgctgtaagcccatactcacaactcctacccaagtcctgccaatactgttgtgtaaacgctaccaggtgggaggtttgagattctgggaaaaatgcaaagattttacaggaaaattgttctcctgacaatagccattaagataaagtacacctccaaagttcagggtgagttttgtcttaatgaagaccaaagctgcagccctcatctcctttaatcggccacatctccatcttttgtattttcttctttgaggacagatgctctcattctcctctgccaacagagataaaaatgctttaagctgccgcagaacagattcaagtgaggtttaaagggcagtgtcccgaaggcgaaggttataggataacctagatgtggccactccagagacattcagacatgggatgaatgatagcttgatttgggttctgtgctgttggcatgtaagactgtgtgacaggcagcactacggaagtggaactaaggaggccgggccctggtaccagctctgccactggccagctgtgaggcctagagtctaacagtgcctcctggctccgcttgcccaggtgagaactacattagggttaccactgacatggaaactaatccttccactccattagtcgcctatgtgtaaagtatatgttgtccatgaaaacagacctgaaattctgataggaaggttgctggggtttgtgattgtgcaacaaattgtaaatgcctttgttctgatttgtccctccttcattctattttaaactgagttttctcaagtataaacaaccccagccatagcacagagagtctacaggactgaagacaacactcaacatggtactaccttctgccaaaccaagaatttgacaatggttatttaattcacacattccctctaacatttgtatgtataatgattataacaggcaatattccaagcttgggtaaacatggtatttgcttatctgctaaagcgagcacatcagattatctaatctgtggttctgaattaaaggaatagtttagctggggtccacaatgacagcttcacataacaagtccctgagacacaagtctagacatagctttttaggaggcaatcttacgggtcatctaaagaaatgatttattttgacattagaacctctctcttaacatcagttaatggagggttccatagcgtcccctaagtcttcagagttgggctgcagaaattatcccgttctacaaacacttcataaggcagcactgaaatccttagaccatgtgtcacacaagccaaaagttcaaaagaaacatgtcgctgttcgagggaaagaaattactttaatctctcagcctttaaaaaaaaattctagaattgtattttgtatctcactggaaaaaaagccagtgttcctccaattattctaaaacaaaaaaagaaaagtctgtagtctgtgaatcaatccatacagagatctgtcccttgaagctggagggtgggtcaccccagagggcagtcacttggcctaaaggtctggtgaggagaacactactttgtaaagtttgggaggagagaggggtgaccagattccatggtacagctcttttgtgcctcacctcgtatccatgagacagactacacaaaatcaccaggacttagacgctcctgcaagcagctctgcagccatggaagtgaagtgctggctgacggcacggcgagccgcttcctggcacgccaacagaaagcacatgtctgcatttttgattccagtaaactccaggctggctctcagccagaggacctctttgtaatgtcaaagataaaagtactggccatgtttggcaccctgcctccacctccattctcttgtaaccgtctcataaaccaagcatgcattactgttaacagagtcttccagacaaaggtctgacggagcttcataaacattagcagatgacgatcagacaggtccctactgcacaggaaggaaaggaggtacagggaggggcaagtgatttcactcagaacatgctggaaattgtggggagagctggaaatagatattcaactatatactcagaatactcctactaccagagaactgctcactgagccgcctgagtcgtgcacatcttccattagaacctggcatgtgggcaacatcaaacctcaaatctgtccccagcagtataggtatcatctttatattgatatctgatgaagttcctcaaatttggatgttcaaaatggctttttgagtatacaagatgatataatgcttctcatacccctaatattcttcctcttgcccaagggaatgctacgatgccagtcacagaagatttaggaaatgattaccttttgattagtttttgttttcattttgggtcatactcattgtgggccaaaattacacagccctagctgtttgcctttaccatttctgttttactttccatttaacttttgagactactctgaaagtaagattttaaggtttgtaaatgcttaccaactaaaatacgcaaggatttcttttccggaggtaaacaaacttacaaatccctcttgctctgtgcaagaacaaggggtacccagaccttcattcagaggacttaatatgagaaagtcccaggtcttcatcaccagtggaagctggatagctctggatgtgctttttaaaatatgtatcagaggctttaattcactccagagggctgcagagagcttacttcctcccctatgctaccaagagtgtgcaaacacacagatacccacagacatgcccacatacacacacatcccaggaatatgctttaagggatactgagggctccgactttccctcaaactgcagacctgttgttcctccagctttgtctctcctctttgctgtaagggcctagtaaggtaaggtgggtatatacttagaatcacctcaggagctgttaagaatacagaccgggttccatcgaggcaaatgatatcagcatctcttgggggcaggcagataccggtatcttttctaagctccccaggtgattccaatgcacagtctgggccaaggaccatcagcgtggcctttgccgcctcagccattgctccgaatctctgcgatcatgctgtcactcttcgtgccgacatggttaagacttgctgcaagtattgatggttttgcttttcttttttcttgtctgctcaatctacagttctgtctcccatgttctctgcttttgcacaaatagtttatttacaatagacacaaaagtgaccaagtctgtggcactacggggaataaatctcatgcccttcaggtgctctttagctcaatatatgacaacatctccccagtgcactccagggccaggtactggatctgagaagacacagctgagatgtggcctcagcttacattccagtggttgaaacggccaaacaaatgtatcatttctaaataccgcacgtgataacagagaggtaagccctggggctatgggagcatagaggcagagccctctgcctggccaggatttagggaaaatgtcctggagaagaggatgcatgagtgcaggcttggaggctatgggagcacagaggcagagccctctgcctggccgggatttagggaaaatgtcccggagaagaggatgcatgagttcaggcttggaggctatggaagcattagacaaggagagacaagcaggaaggccagtagcagagaagagaaagaggtccttggggaggccacgctgttgggtgcttctggttcactcatgcatggcagggcggcgctgcggagacggggcagctccccggccctctgctgccctactaggtctgcagttacttgctgttcagaggctgcttttccttagaggctcttttccccactaagctgaagggctacttcagaatgagcccacagacccaaaaacataaagctgaattaaacggttcatcgggggaaaggggtggagataaaggtttagatatgaggtagagaggtagggaaggggtcagatcaaagaatgaatttgatcctgcatgggcaacatggagacatggggagattttaagtataatctctatgtttttcaaatatttacgtggaaaatacacttgcaggtgggagggactgaaggcggaaggtgttaggtagatgtttcaacaatccagaaagagatgacatgaatctgaataaggccgtgccttagcaacagtgagagaggaagagagagactgaagagaaaaggaacaattcaagagagtgtaacaagatgataacctgggagtaagtctgtggagagtagaggattccaggacaacggccatgcatctggcttcagtggctgagtgcatggcgaagccttccggtgagatggggaatgtagaaaggtgtttaggaaagggacgttcgcttttggacatgctaatataagatgtctgcagagaatccaggtacagttacccctaggaagcgggaaatatgaaactagacccagaagacaagtgaaagtgagaagtgtcgacttggaagtcaacgccacgcaggtggaatctgaagatatgcgacagaggaaatcacccaatccaacggggcccaagaatctcaggggcaaagcggagaagtaaaggagggcacggaaacgaaaggagagtgttcccaggaggaggaaggaagggacaggtggtgtggaactcaacaatggcatcaatggggaagagactcaaaggaggtcaatggatttgaaatcaggggctcaccgatgacatcagagagagcgtgctttggggagtgataactcctattgtgggagttaagagaaaacaaacagggtcattaagtgtgcagatgactcaaggggtttcacagattaaacaggaaacaatggttagaggcaagagctgagctggaaaaagagtttgtttcttataacgggaaagtgtgggcacgtttatgccacagggaaggagtcagtggacacggaaaggcagaccccaacagatggggcagcaaggggggcgaggtccacgaggaggcagagggtagggtcaagagcacaggtggtagaagcgggtggtggggactcggctttggcaaggaggtccccatttcctctaacaggaagagacagaatgggtgcagatagagttgcatctggaagtcagcagggtgggaagttgagatgggctttatgtctgatggactctttttccctatctactgaaatcaagagacagcagaggcttaggaggatggagcagtagtgagggtctgggagtgctatagagaatgggtaaaaaggggccagctgaggacaacttggcaaggaggaagcccagctgagggaaggccagaagcagccccagcacctgtctgcaggatcctgtgactttcacagccccattgcattacaggggcctgaactgcaggaatatactgttgatgtcatcagcagttggagggttggagagggacaacgcagggatggcaggaagagggcgttgagcttgtgagtgtaaacaaacatgggttccggcagagaaagaagggaagctgcctatgctaagattttcaaaagagtaatgccccttttctccaactacagtttagcccatgaaaccaatttgtatttgtttggcctccaggaagagcagtgttatttctttaatctaggtttcatgttaacacatctgagaaccgcttgcccatctccccatttccattttcagtgcagctataatcttgataatgagggcacggtagtcattaaactattggaaactatgagtctgaaaatgcttgacagtcgcttaggttcccatttgctttatgcatttctagtctgtacaaggttcacgttctagaacaacatctgagcacactgctcacaaacagctgataagcatttcccaataggactagatgacctacctcatagggtgggcctaagggctaaatgagataatatgcaaagtgctgtgcatagcaactggctcgcagtaaccgctaaatgcacatgagctgtgctgttacagaagagatggggagtaggcagcagaacactgcgatggagacgaagagtgtaagaggacaacgctgagtaaccgaggtgatgagaaacgcttcagtgctctctgagcaacgagaaagcatggaagagacagagtcgctgcttcaagcgtgtgagaaacatcaagagatcacagaaagctactcaattcttagggtttttcctttctccccaaagaagttattcttcatcaggagagagcagaataggaatcttagaaaagttcccatctttaattccagctgaactatattccaggacagtgaaagaacttggaaaatatggtcatgaaactattcttactccactctgaagaactgagagaaagggaatggcagcagaagaccagagtggcggcaaatatggtctcaagaaaataaaaataaaactctgtaatggaagtcttcaagcaaataagtcaatgtctatctttgaccaatgcttattaagaattttaaaacatggtgtaccctagagacagcacaggtgcgttgctgtacacaccagagatagcacaggtgcgttgctgtacacaccagagatagcacaggtgcgttgctgtacacaccagagatagcacaggtgcgttgctgtacacaccagagatagcacaggtgcgttgctgtacacgccagagatagcacaggtgcgttgctgtacacgccagagatagcacaggtgcgttgctgtacacactagagatagcacagttgccatgcacaccgctgctgtctctagtgaatgctgttcttgcagctgcagcaccaagaacaaatcctgccaatctgaactcatttaattccatggagattatacaagtatatggggcaaatattattaacaccatattgttcgatttcaaccaggatttgttaatatcttcataatattctgggggtaagataaggctatctggttaggatgagaaagtatatataggttcctggctggctggctgaacaaccaactatatcttaggattaactgatgtcagccttgaatcactccttggtaggaatcattttccttattttatagatataggtgagtttcagagatggccaactgcaggccaaataacaacaacaacatttactgagggtttattgtgctaattactttaaacactgtatcttatttaatcatttcaacgaagtatcaggtaaaaaccagtccaatccttatagaagacaagactgcagctgagaaagacaggttaacctcctcaagttcaagtagctacaaagtggtggagaaggacttgaactcccagttgtataattcagaaacctgagtgctctctgctacaccacactgcctcaaatattcaagtacttgaagactggtaggtgggacaagaaacctatttgctctttattgttccaaggggcagaactaagaccctgatgtaagtggaaagaggcagcttttagttcatgagattaattaactttacaatcacagttgcccaagagtggaacattgtgctcaaaaagagtgtgctgagatcagcactaaaaaagttcacattgagtacggatacccacccagggcacacactgtccaggagatacttgccctgggtaggcgggcctctaagggcccttcccatcctgggcttataggcccctatgaaatgattcttctacatttgttcattataaaaatatacagatctccaacaggataatggggatattcatgcttttgaccagattagaaaactcacatatctaagtataccaccaaaccaacactgtgttactcaagtctggtttcatcaactctggaatgtgtgcattcttggaggaggaaagaacaccaggggcatgaactgcaagcagaaaggaatctgtcatgatgataactggaaatatatatcctgtctttccaacgggtggtttacatgtgagtttgtaggtcttggtatggggaagtaaggtaggccatactcagtattacaaagtgttggaggaagagagggcaagaatatcccttcctgatagcccattgtttaaactaccatgaaattgttttatgagtaaaagtcattttgaagcatcaggtaatagagatttttggcatgtcctatagagcttaactccatgctaggcaaataacagtatttattcacatattcacttgcgcaacacaaatttattaggcactgtattgggcactgaggacaaaatacagaacaagactgatagggtcattagtactttcctaacaagtaagcaaatacacagcaaatataaaaatgatacgtaacgtttgctagtgcaatcatggaaataaaggcattgcagaaaataatgaggagagcagcacctgattttcatagggtagtcaaggatctctccccaaggaggtaaggttgaagccacgagctgaagaatgatgatgagctaggcaagcacaaagctacaggaagatgattttggacagagggaagccaagtgcaaaggccccaggacaagaaagagctcggcatattccagccgtgagcctgagccgagactggtagggtgaacaggagccaggccgcacaggggcctgctggtcttgttggggaagctggatctcccctccaagaaagtgggaagttgctcaagagctaccttctgaaaacattctctggcttttgcgagaaaactaaattccaagacaacagggtggaaacaggcagaccgcttagggaggctcttgcagtagtgtaaacaacagagaagggtgctgaagaaacactcacaggattatacatgttgctggaaggggagagaggcaagaagtgacaactgacctctgtcaatcgtgaggtcttgacttaacctcattctggcacgctgcttgggaaacactagctaggtttattaacccaactgtggttgccaccaacagcagctgctaaaccttcttctggttttcaacaaaaatcccccatatatcttatgtattcgcagctccctaagtcatcaaaccttcatctcatctgaaaagagagcctatctgtggcttgaatcactacaatgagccaaaaatcaatttataattttgggtaatagttctaaatctattttcaatcatgtgggggtgaggggtgttgagaggaaaaagtgaatgaagtttgagaaactagcaatgaagtctctcagtcaacaatttaatgactacaaaataaataaataaatgcactagtgtacccttgggtcccagttcttattcagttacacatctgttctgcaatagaatgagggagttaattacttttctatgacatgtatgtattttgtgagacaccacattgcaccagttaataatgatctaccttctgttgacacaaaacgtttaaattaataaaaaaatctaaatgatatatcacatagcaaagcatacttcactgaaaggctggatggcaggagtagtaattttcctgggtagaaataattgagatgagcttatggtagcatgaaaagctcaatcaataaagagacttatatgggcaaactgttttcaagagtacactctttttagaaagggtaggctgtgcttcgctaatagctaatgtagcagcactgtgattgttagagaaagaaactgagactgatacccagtaattgcccataattgacaatattagcaattttccatttgaatctgtctgttcaatctttagggtcagaaaagacaaatgtgaaaagggtaaaaacaatcccttgaagctctattaatactaaaaaaaatctttgtgctcttcactgagtgtacccttgtaactagatactaaaccaactgcattatggaaacagcctattttttccaaactgtataagcaatattaaatgaccttggaaaaatcgagataatatgtaaagtagactcccagcacaaagacggaagacatactctaaataaacttgacaagagtgccttgttcaagtctcaaaaccacccaaggaaaagtctgaaacccacaacatcccgtaattattttgctattttccacttattttgggttaaaaaacaaaagtctaccacttttctttcatttttaaattcattctcacttctttcttaaaaactaggggaaaaaaaccccaaaacatcaggactggagtcaagaagtttatttcctgtataataatttctttcttttggggtcccaacgctaaaagactattacttctttctgaccattcaagcccctgctcttcactgtccttcatggtttaaagcagcctttacccatgctggcccacagagtatcatgaaaggtccatggacctgacactgtaagaatttaggtacaaatctagcgagatgaatccttttctaattcttgcctatttttggcttttcagggagcttcatatactaggaacttcttctaggctattgagtacatagtaggtatttagtaaatgctggttgtcgtgggaagcaacagataaaggtgaaaatggccaaaacccagagtgggtgatgtaaaaaagaaaaattgtccaattttataaagtttcatgattttttttcctttagcggtaggatgtctaatatttctatttaatctcaaatattaaatttatacagggatatccaggtcagaggattccagaacttgaggattaggaagctttttagcaatgcagagatcagacagatgaaaaagactgttcttagaagacctgtacaaaacaaatgccaccatatcttcttaaaaaagcccaaaaggtcagtacatcgaatccaaatacctatagctgaagtctatttctcccaatcttagtgaggactgaaaactataggtctccctgaccatgatgcagcatggttgtctggggtaaatacccgaggttcattgtctcatgccagggtaatcgaggatgcagacacacaaagtgattttgagaacggaggtttaatgggcaaaagaaagagaaaagagaataagctctctcttctgcagggacagagaggaaccggagtggtccttccggttttgtggtgaaatgcatgggggtttttatagacaagcttgaggaggcagtgtctgatttacatagggcctgagagattgggtggaccaggtgtgatgtttgcatagcacctgaagaagctggccatcccaccctaatcttttattatgcaggtatctatctgggaggtagccatgttgtctgttccttactgtacacgtgattgacaaaagggaagatggtgccactgagaggtaaagccagcaggactttctgggttgagtggggacttggagaacttttctgtctagctagaggattgtaaatgcaccaatcagcactctgtaaaaacgcaccaatcagcgctctgtgtctagctaaaggattgtaaacggaccaatcagcactctgtaaaatggcccaatcagctctctgtaaaatggcccaatcagcaggatgtgggcagggccaaataagggaataaaagctagccacctgagccaacagcggcaacccactcgggtccccttccacgctgtggaagctttgttcttttgctcttcacaataaatcttgctgctgctcactctttgggtctgcactacctttatgagctgtaacactcaatgcgaaggtctgcggcttcactcctgaagtcagcgagaccacacacccactgggaagaacaaacaactctgtacacgccacctttaagagctgtaacattcactgtgaaggtctgcggcttcactcctgaagtcagcaagaccatgaacccaccggaaggaagaaactctggacacatctgaacatctgaaggaataaactccagacacaccatctttaagaactgtaacactcaccatgagggtctgcagcttcattcttgaagtcagtgagaccaagaacccaccggaaggaaccaattccggacacaccaccatgttgaacatgcctggcccccaggtagccttttcttattggcacagctgccagcattcacccctgcaagcttccagcttgcttgtctatgtctgtgactcgattttacaggctgttctttgttagaaaagatgtgatttggggactgcttttcattaaagggaaaaccttaccgaggacttccttaccctcactatctgcccaactaatttctttttaactcctatatcaaccagataaggcccctcctttctcctgcaggctgaagagtttgtatgcccttagtctttctttaaagtcttacttttctacagtgtttctctattagaggttctctctgtccctttttaagttatggggccactatatagttatggggcagctgcataaaaacgttcatggtcttttcttgagctaaaagacaattacataaaattaaggaggttagtatccacaatttttacaatgattttaactgaccttattcataacatgaagtagttgtaaaaagtagatattcatttaatatgatgtcaaactaaggtaattttcctcatcctctgaggctgcttgttactcccattggagtactcacccatgttgaacgcaacctaattgttcagaaataattaacatgtttttatttcagttgtagaaaacataatttattaattggctgctactttatgtgttccattttaaaaggcacaataaataagaaattagcataagaaggtattgaaaaaatgccaagattgactaaattctgagaaaagcaagataattccaaattaaggatgagtaaatttattacataaaggagtttaatgacaaatgtggagacaactgttttatgggcctttagctacagctttccaattttaatgttatagacaggaaaacattatcaacgctttcataattccaggattctaatttacatatcaaaacaagagaaagagaaagcccacatctctccttacttattagagttctcggggtctgaaaacggcttgtcaacaaaggttgaaagaagaggaagcagaagatatgctgatggctgcaactgaagcaatacaatatcctaattactgggaagtacagctagtttagagaccatcacaccctcacctcagcaattaatacccagtacaattggtaaatgttctaatctttaatagaagcacccagaaacagcctgtaagcagatgagtatttgaaacaaaccgtttgccatatccccgggtattaatcgaacccaaaagcatctcattctttgtgggggaggaagaaagctgccatcatagatatgcataagcagctctctacaagctcttcttctgggtgtaatgatgtgaaaaccatgctaatttccttgcccgatatttgaattttttattcttcatgcaatcatttctgacttcttggttctacacacactcacgtttttctggctattgcgggtcgaaaggccaacctcactgttctaacaatgacttcccatccctccatgatgaaaatgcaaaccctctgcccagcataggccatccctcaccacccactgctggccttaccagcctttatcctccagcaatactaaaccattagctgttccctgatgcgccatattctctcaagcctctgggacatttcacagggtgtgtccctgtcagaagcatgtgaaccagagcaactccatcttgaataggggcctggtaaaatgaggctaagacctactgggtggcattcccagatggttaaggcattctaagtcacaggatgagataggaagttaccacaagtaacaggtcataaagaccttgctgataaaacaggttgcagtaaaggagctggccaaatcctaccaaaaccgagatggccatgagagtgacctctagtcatcctcactgctatactcccaccagcaccatgacagtttacaaatgccatggcaacgtcaggaagttaccctatatggtctaaaaaggggaggcatgaataatccacccctcgtttagcatatcatcaagaaataaccataaaaatgggtaacccgcagcccttggggctgctgtgtgtggaggagtcattctttattcctccaccttcttaataaacttgctttcactttttggactcgccctgaattctttcttgtgtgagatccaagaaccttctcttggggtctggattgggaccccttttccagtaacatccccagactgaatctctttgaaaccatctcaatgaaaattcctatacaacctgtacatctcaggtcaatgtctcctgtgaagtctttctagactgaccagggattttttttctctttcattgccactatacttcaaacaggcttccagtaaaatcactgccacaccaaattaaactgtgtctgggtatctatctccacattagaatggaagccacctacaggaaggggacatctttcaatctcaggattcccatggttggcctatgatatatgtctcacatcatgaaatacttgaggaagaaagaaagggacaaaaggagagaaacagggagggagggagagattcaagcaggtttgctgaaagactggagatgaaaatggtaattatgggtgagtaataagcaaaaaaaaggagacttaagtctatttaagccctaagcaatataagacgccttatttccagagagttaatgttcaagctataaacagaaaagacttattcctaattctagtccttgttggggtgagtcagggctccctggactctccacagcagctaatgcttcagtctcttcttacatgatagacctgtcatggagtctcacccaagtgggttgtaaaagcactggccaatgtcagtctagggtcttaaatggacacttaaatatactaaattattcagtagtaaagccaacccaaaatatctatttttcctgtttatatttctagaattctaccatctaaagggcttgagaaattggacaaagatagtatgttaagtatttgaaaatgaatacataaatggaagtgatctctcaagaaaaataatgtaaataaataaataggcctaaaagttccctcttgatgttattttacctttatttaccttttaaccttgcttccacaaccaagggcagtacccacagtgctttatcaaaagagcactgccccagaattatgatacttgtattttctgggccggattgtccagcgtcactctatttgtgagtgacacaagtcatttctcctctctgcaaaatgctgatattgacctagatgcctaatgtttcttctagctattcaaatttaactgactttctgacaaaccacttagcttgtgtgatattcgatggatctaagtacaaagtatgctctctcacgtctaccttttaagctctgaaggtatgcaatcaataacatgcagaaagagcccaatctgagtgtcatttcagcaggttttaaagacagagtgaagaaatgcatgtgttctacatcaaccatgtctacctgaagcccaacagcaacttctcagagcagggaaagagaaagtggaaccacatttggtcacctaccatccctaatacacggagctgcattacatactccctgtagcttaccaatgccaccaattccccagcttcattcttccaaggatgcaatgtcactagagggcgcagttaatgactatataaatagtgagccccaagatagttattgtgaaatttaacctctttccatatcccaacagtgagctgttagtggaactttgtgtggcagagacctatagaactccaaagttaggtaaggtcaaacatgtcatgttttaaaggctttgagcatgtactatggaccaaaagcataagccttcaagttcactgttgagcccgattaacagataaggggaaaatgtactttttgagaaaaataaataggttatttttgcatggcaccatgttctcttaatttctatagagagtgagataacagaagtgactagaatacctttttctccttctaggacatccttcccattgacactggaggggccaactacatgttttaatcagagcccacagctgcccacacccactgcagagtgagctactctccaccaaccctgcagccctgaagtttctgtgaccactgaagaggtctgttttcagacttagggtcaaagtgtgggtgacctccaacacctactgtaatgaaggaataaatgtcaatagaagccttgtctggtctctgtcccaaggcattttattatttgtttcattgtgagattccaaatgtggtcttactcagaaaagaacaataattcttacatggcaaattctgaaagaggcatcaatgcaatccctctcaaaataccaatgacattcttcacagaaacagaaaaactaatccccaaatttatatggaaccacaaaaggtccagaatagccaaagccattctgagcaaaaagaacaaaactgaaggaatcacattacctgacttcaaattatactacagagctatagtaaccaaaacagcatggtactggcataaaaacagacacacagaccaatggaaagaaatagagaatccagaattaaatccatacatctgcagtgaactcatttttgacaaaggtgccaagaacatacactgggggaaggatagtcttcaataaatggtgccgggaaaactggatgtgcagaagaatgaaactagatttctatctctcactatataaaacaattaaccaagatggattaacgacttaaatttaagaccctcaaactacgaaactactaaaagaaaacactggggaaactctccaggacattggtgtgggcaaagatttcttgagtaacatcccaaaagcacaggcaaccaaaacaaaaatggacaaatgggatcacatcaagttaaaagcttctacacagcaaagaaaacaatgaacaaagtaaagagacaacccacagaatgggtgaaaatatctgcaaactacccatctgacaaggaatcaataactaggatatatataaggacttcaaacaactgaataaggaaaaaaatctaacaatctaacaatctgggcaaaagatctaaataaacatttctcaaaagacgacatacaaatggtgaacaggtataagaacatcccgcatcatcaaagaaatgcaaatcaaaactacaatgagatatcatctcaccacagttaaaatggctttgatccaaaagatagggagtaacatatgctgacaaagatgtggaaaaaaagggaaccctcgcacactattgttgggaatgtaaattagtacatctactatggaaaactgtatgaagggtcctcgaaaaactaaaatagaactaccattgatccagcaatctcactggtaggtatatacgcaaatgaaaggaaatcagtatatcgaagaggtatctgcacgcccatgtttattgcactactattcacaatagctaagctttggaagcaacctgagtgtctgttgatagatgaataaagaaaacatggtacatatacacaatggagtactagtcagccataaacaagaatgagatcctatcacttgcaacagcaaggatggaatgggaggacattgtgttcaattaaactagccagacacagaaagaccaacttcacatgttctcactaatttgtaggagctaaaaattaaaagaatttaactcatggagatagagagtagaatgatggttaccagagcctgggaaggtagtgggcaagggagggaacgggggatggttaatgggtacaaaaatataatcagatagaatgaataacatctactatttgatacaacagggtgaccagagtctacaataatttactgtacatttaaaaattactgaagaaatataattggaatatttgtaccacaaaagaaatgataaatgcttgaggcaatggataccccatttatcctaacatgattattacacattgtatgacagtatcaaaatatttatctcatgtacccataaatatacacgcctactctgtagccataaacattcaaaatttaaaaatacaaaaataaataatgtttacaaaagaggattggtctcttgggaaataaactgcagagacagcccaggatgacatccactttgtccaggaatctggggggaggggagcaatgacctggatgtgactctgtgcagtgccactcatgctgtcttcttactcagctgtacttcccttccttctgctatgtacaccccctcagtgacagcaatgtcgggaactgtaggggtgaagaggacagcacgagtagtgatgaaggacagtgatatgccccctaagtctggacaaaggtcagcttacttctggaaggagagcccaggttaggaagtgcaggggagcaagccaggaagaatacaagaatgaaaaacaagctgagctgagcatggtggctcacacctgtaatcccaacagtttgggaggcagaggcaggaggactgcttgatcccagaagctgaagactagcctgggcaatacagtgagactccatctctacaaaaatatttttaaaaattagcagggcatggtggcacacgcctgtagccccagctactgaggaggctgacatgggaggattgcctgagcccaggagtgagccatgaacacaccactgcacttcagcctgggcgaaagagtgacgccctgtctcaaaacagaaaaaagaaagaaagaaaaacaccaaccaccccagcacagtgaccactggaaccaaaccaaacaagaggcactaggcacaaaaaaagggggaagaaagcagagacaactaaaaattggaacaggaggagttaaaaaactgttaagaaaattatgtgaacaattcagagactctgatcagcaaatgatgggaactgaggatgctgtatttcttggaacctcccaaatagactatttccccagatcattcaataataataatggctaccattaccaagcatctaccatctcccaatctatacatatattatctaattatctaattgaacccttaaagtagctttgccaggtttagagtattctcattttacaaaagagaaaattaagaccatcacagggaaggtaacttgctgatgtcaaagggttggtcaacagcagaaaccagaaccatctatctgcaaagcacatgctctttccaccgtatcaagctgtcctcttatccaccatttggatttcatgtctctggccagttgctgatgctccggaactagaacccaacttctgctaaatctaactctgtactctttgtataatatcctgtggctttaaataagatattgactcagcaaatggtactagaatcattggctatccatatacaaaaaagaacattatgcatacacataaattaactgaaaatggatcaaattcctaaatgtaaaacctaaaactataaaatctaatatgaaacacagaagaaatatctttctcctcttgaattaggtaaagattttcagctatggcttcaaaagactgatccatgaaagaaaaatactgataaactaaactatttcaaaatttaaaacttctgcttttcattctgtgaagagaatgaaaagaccagctgcaaactgaggaaaaaaacatgtataaaacatatgtccaacaaaagacctgtgtacaggataaagaactctcaaaactcagtaagaaaacacccaatttttaaaataggcaaaagatttgaacagatatatcaacaattaagatgtacatgtggcacacaaacacgtgagaaaacacattacagtactgcaaattaaaaccacaatgcaatgttaccacactaaatgtattaggaggatgaaaaacaaaaagaaaatctgacaaaaacaagtgctggtgaggatttggggtaactggaactctgagtcattgctggtgggaattcaaaacaataggggctgctttgaaaaaaagtgcagcaatttcttataaagttaaacatatatttaccatagagcccagcaaccccactcctaggtatttgtccaaataaaatgaaaacttatatttgcacaataacctgtatgtgaatgttcacagtggctttgacaaccaccaaaactagaaaacaactcaaatatccttcacttagaaaaacaaactatgaaatagccatgtaatggaatactacttggcaataaaaatgaaccaactattgaggttatatattataaatgtgtgtacaaataacatggctaagcaaaagaagccaaatgaaatggctggttaatgtatatgatattgtggaaaaggtaaaatggtagtgacagaaagaagatttgggttagcaggtgctgggagtggggtatagacatggatacaacgcagtacgaaggaatttgggagtggtggtgatagaacgcttctctatcttgatggtggtggtggtggttgtggtcacagactgcatttatccaagtttgtagaactgtacactaaaaagggtgaattttactgaatgcaaattacactccaattctttaaaaagatagggaaggtctatctgttactcttatcactatagaaacagcatagtgaagaggttagggctatactcttgaaagctcccgttgcctcatctgtaaaacggcagtaagagtaaccctaactttgatatggttgtagagagaaatgagatgaggcatacagagaagtctgcagagtacctcgtgagaggtgaagccagctggacttccagggtggagtggggaattggagaacttttctgtcttacaaggggattgtaaaatgcaccagctggtgctctgtagctagctagacgtttgtaaaatgcaccaatcagtgctctgtaaaaacgcaccaatcagcgctctgtagctagctagaggtttgtaaaatggaccaatcagcaccctgtaaaatggaccaatcagcaccctgtaaaatgaacctatcagcactctgtaaaatgaacctatcagcactctgtaaaaggaaccaatcagcaggacatgggtggggacaaataagggaataaaacctggccaccccaaccagcagcggaaacccgctcaggtccccttccacgccgtggaagcttttgttttttcactcttcacaatacatcctgctgctgcttactctttgggtccgtgccatctttaagagctctaacactcaccgcaaaggtccgcggctccattcttcaagtcatcaagaccatgaacccaccggaaggaaccaactctggacacactagcacacaataagtgcccccataagctttagcaggtattctaatttccagtagtatctgaggaagaatcaccttattgtactagacttcctgaacactactgcgtacctgtggaccatgtgttgggctggggatggtacttggtacacaagaacacatactctgtatcacattagctgccatccctcaatctatcctctgagctggaggcttatgaagccccaaagatggtagaaaagaatgtgtgtgcaagaactggaaaggtgagacagaattcacgacaccacaaattgtggagagaccatcttttacccgaggtggacataacagggccacgtgaaggagcctggtgagcacagctgcctgtcctctggggagaaggcagagaagaagtgccacatcctgtgatgtggtgaacgccacagtccaaggcaaacacaatagctacattgtttatctctcagccaactttacagcccatcgtagcatgcccagaagcctctccccgtatgtcatagcaacactgcagacgggattatgtgattatgaagtcagtaactcccttccttgattaaacatgaactcaaacagacagtcattcactctgggggaaacccatttttctgcttgtctggagaagcaagacacaggtaacatacagcaatgttaggtttcaactaattaaaaatgggaatgaacacacgcacacgcacgcacacacttcttcagttccctgtcaaatcttcctgaggacaacatagtttggttatgatgaaaactttagaaacgggaaacattctgcttagattgttaaaattgagaacaacgcagagctggttgggctcatcatcccaccaggagacagttctgcttacaatttatctagcaaaatagagtaaggcagcagaaaaaatcttggtttcctagtgacctttaagtaagtgctcccatttcaaatagactcagtaccataaaaactttcttgggctgagaactttcatttcctttgaatataacttttgcgctaacattctttcatttcttcttcttcagacaatcattgtttcttcctttcactcaaacctgcctctgttccccggttttcacggtttacagggcatagcccaggtgatgtacagcccacatgggaatcaaggcagttcccacacagcaccagcacaaagtcatttctttgtagaagctgggcttcttcagggctgtgtaactcataggtgtcgtggagggtctcagaaggaaacgagggaaggcaattctgtgttgcagaaaaagagtttttctaaaaagaagctgaaataattaccagagacaaaaattaacattgctttatatttacagaagaaactaagaggaagtaggcttagaattgtagcatcagggaatgagaagtttattaaggcttctccccactacagaaccatttattaaactgtttccagaatggatacattttcacaatgatcctactcaatctctcttcatagaaggctctgtgataaaagaagatatagatcccctgctccacagacggctgacactgggtaaaagatgcacacatacttggaagccctcaggaaaattagatcattatcttctcgttttttctttgcctccaaagacttagatttttacctatgtactcgaaaagcaactgcagacttccaatcaagatgctgtaagttcaaacctggaagcgttcccttctactccaaatccatagtaatgacaggtaaaatataaaaacaggaaccaaaaatagctttgccaagtcaaaaaaaaaaaaaaaaacaggcaatgatctccctggaccaaaaatagaacagaaatgcaaagcaataaacaaagctgaagctccagggcctgaggtctggaagtaggtggcagtaggtacaagctgagtgctggtggttaaacagggaatacaaatgtttcacataaaaatggtgagtacagtcaaccttaaagcttaaagccagagaatggggtgaggctaccttgcttgacaaaagaggccgggataaacaaaaccagggctgatgacctgttcccctgtgctagatatttacaggaagctgtgggcctgaaggggccaaacagagccatgctctcttgtctaggtacacagccatgacgcccaccatctaggcaacacttctgcactagcctcagcatcaccggggcgcaagaggtccaaatgccattaagttctggttttgaactggaggctgaggggcttgggggaggcaaaactaccagacagaagggaagagcacagaaggagtgaaaagaacaaaacaaaaaaactgtccactaaaaatgagcctgccatacaaaattccagaacactgagtgaaatgcaatgctaaccaactgaaaacaatcagaacataaattccctccagtaaaataaacttcatggaactaacacttaaaagaagtgtgattagaatacccaaagagatgaataatgtagtagcatgcattaaagtaaaaaagaagttataaaaccaaaataggcagaaataaaacacagagacgtgaaaaagaacaaatttgaaatcttggaaataaaaattggtctttaagctgaaccagtaagcagaaagtatccctagcacctgacttaagggagctctaagtttaaaaacacggacaaaatgccagaagctaaaatgggttctctctgaggagtaggtcgtgggcaggagcaagagaggaaaggggtaccattgttttcaactgtgttagagtactttaatttttcaaactatatacatgtattactttaataaaaaatcaaaataagaaatgtaaaagcccatttgcaagaaataacactagtgaaggattacctgaaggatttgcagtcactgctttcctccatagagactaaattgtattcttggaaagaaacaaaccatcaaagagatatgatcttagattacctaatttttcacgcttctagttacctcttttattaagaagtattaatttggctgggcacggtggttcacacctgtaatcccagcactttgggaggccagggcgggtggatcacttgaggtcaggagttcgagaccagcctggccaacatgttgaaaccccatctctaccaaaaagtataaaaaattagccaggtgtggtggtgcgcggcgcctgtaatcccagctattcagggggcaaggcaggagaattactgaaacctgggaggcagaggttgcagtgagctgagattgtgccactgcactgcagcctagaagacacagtgagactgtctccaaaaaaaaaaaaagtattgtcaatcagctatgatgaagaatattatagaaatcagtgatttcactcgctgtggaagtccagtaagaatgctttgtgagtgcctcaggcctcagtgcagggaaaaactgctctggctgtgttttccttcttagggctactgtgaattttgaaagtagtcttttaggtttggctgctgatacattaagggtaaattcatcatttttctagctgttatatattgcttctaggccttttggttaagctcaagtgtagtacttctagctgttacataaaggatcatatggtataaattctgcatactaaactactttcatcttatttgtcacttttatttctcaaacgaaaataaaatttattgctgttgtattacatatgcaagtagatacatatatacatgtgtatgtatccttgtgaatgtgtgcgtgtaagctacttcaaaatcttttgggtggaggaaagggaacaattagataaaggaaattggtattttgaaacagaaaaagggaacaaaagcaggttgaatgttagggtcgcaactagagagcactgaatggcaacctatgagtatgaagttgatcctgagtgctaaagataatgctgaatgcttgaacatttctgagcaaagtaacaacatgagaatagtggcatctgagagagtttacctaaaacagtgtgtgccaaggatgaaaagaaagaaattgagagcccggtgaataatcaggggctatttcaataacctagcagtgaggcaacagagctttgatagactgatagacatggtgtttcaaaagaattaactctaacaggacttaggaaagaaaaattgacatggcaagtaatcatagcttgtttgttttttgcaacaaggcatgtgacatccaaagcagcacgctatgttcttgccacaaacttatggaaacaatcaattccatttggtctgttcagctcctattgccttggattctgacctgggcaagccatgaggacccaaatcattcaaaaacctccctcagaaggtaagttttatttttttccagaaattaagctgcagctgattacaaatgacaactgtaaatatgcaaattatacttgctattaaaagggttcctgccttcctgaaacaaaatactgtgtaagtccaataatatgcagatgtagacacataataaatattgcttgatgcagaaaactggtgagatgaattttctaggttccaagaaaagcagaaaaataagcttggaaactttaaatccaggaactgaaaattaattttgattgaactaatgttgaatttatgatcttttgggaatgcactaagctgaatttacctctgtatttttttttgaggcaaattgatagtacagagatctcagaggagtgtttatatcactaaacaaaattctcaaatagaaacttaaaaatacaactgaaaaattagttgcaaactaagtttatattctcatctaagtacatactctactctcttccactagaaaatatttcatggaaacatgggaaaacaggagcggggaggggccctatggctgtctagtgtaattctttaatgttacagaggatggaacgaatccagagaggttcaatgacttgcccaggaccattcaatgtgttagatacagcatggactataatccagcagagtaatcaagtactgttttcatgacaccattagacccatctcaatattttaatggtcaatgttatatgttaacttgagtgggccacagggtgcccagatatttggtcaaacattattcatagagtgtctgtgagagtatttctttatgagcttgccattggaatccacagactcagtaaaggagtctgctctctctggtggcacttaactaaccagctgaaggcctgagtggaaccaaaaggctgcaattccctcaagtaaaagcaaaagagaattcctcctggcttactgcttgagttggactgatcagttcttcttggaacttgggcctgccagcttttggaacagaacttacaccactggctctcctggttctcagggcttcagacttgtcctgaaactataccatggctcttctgggtctccagcttgccaactgcagatcttgagacttctcaacctccataatcaggtgagacaattccttagaataaatctgtttctccaccccatcttgttggttctccttctctgaaaaaccctaattttaatattaaacgaatctttagctcaatagagtaaagaaaatggtctcagtgggtatggtagacattatgcactagctacccaaaatccatttaacacctctcttttctcttgacttcctcttgcataaaggctaaaaagctaaaatacagttcctagcctcttctatagctaaaggtggccatatgacaccattctgaacaacaaagtaaatgacatcatttttgagcaataaagtgtaggtagatatccttaggaggtcttccctttgctctttgcctcttattaccccatcttttttctccagagcttagatacactgactggggtttggaagcatcagtcatcttcagactgtaaggacaaacccacatgctagggatgactatggaggaagacagaaggatttcaggtccatgatgagatctatgagtcgctgctgtcatcttggattacttctccagaatttttagaacatgcaccccacctactaaagctacgtttagttgggctatctgttatttatagccaaatcctttcctaatatactattgcagcccagatgtcacctgttacaataaaactaagatcactatgacccccattttaataaaagatcatcattcattcactcaagaattttctgaagatccaccatattcatggcacctaagaggaactaaattcaagagccttctcatttccaaccaaggatgctggtggaaagctaccttgctaacattccagatcatggtctgggaggaatcccagggcagtttcccatgatttctgtcattcttgcctgtggcaaaaggctaacaataaagtagattgaatcttcaggagctattagaatattcaacttttcccacttaattcccttattttcaaaagttcttcttaaggcaaaatggatcatgttcatggactcctgcagcattagaatgagctcagggtcctttctcatgcagtgagagcaactacctctcttgattcatgttgccaatgggagttacagtgagttgtggtatactggcaggagcattaggtttagtcatgacatctgggtgtcagacttggttttgccactttttcctttaagtcccaggggtaagtcctgggataagtctcagaggcatatctctgaacctttccgagtttcacttcctaatttacttataattactcagaccaagaaagataacaattacgaaagaattctagtgaggtaaacattcttccaaagtaagatttctttagacaatctgattatgtgaaatatttcatattggacctaaaaataagtaggtccaacatgaaaaaggtatatgagtaacagaagaaaagtccattcattatcttcatggcatttactttgtctctcctttctcagagtaaaagttgttacataagtgatctcaatctaataatgtgctgcagtggaaaagccttatggagcaaatgttaaagaaacagagagacatcatcaagatggctgactagaggcagctggcactcatctcctccaccaaaaagaaggaaaacagtcagcagataaccacaggttaaacagagcatctaagagggaacaatggaattcagcacaaaagggacagggactctccaaggcacagagaaagagggaagataagcagcagtctcagccgggattggctcagagccaggaaaggctccccattgtagggaaaaggtaagcaagaaatctccagttgtccacattaccaccacagatgcctgccatcctagccacaggagagctgctcagcttcacaggccctgagcctagtatagggagttgactggagtccatcatggaattgttcccaagggcattcatgctgcattctagtcacccctcaggacccaaggtgctgtggcatggcaccattttaagagcccagcaacaaccagactatatcctgccctggaccccagaagcccctccattccacatccctggaatgccactgatattcccccatatccactcagagggctgcagtatcatgaggccagctggaccaagtggtacagccagatatccagtactctagcccacactgtgtcctataccctggggaccagcagaaccagtgcaccagggaggctgcccccatgacaaatggagctgaagcacattttcctcaaagcatgggagctgcctgcctggggccactgccacctacagcgatgccaccccttccaaggacaaggccaccacacacctgtacatgccttcaggggacctgagaaccagctctctggggcacaatgtccagaggccccatctgtatcctatctgggggctggaagataggataagcctgcacatggcatcaaggaaattgaggacaggcctgggtcaacccatctccagtggtgccatatgcaccattacaaggcctgcagacagtctcatgtcatttagacacctaaggaccagaatgcctggcccactgccaccatcaccagtacctacatgtgccaacaaggggcctaagaaccagcccacctggtgtctccatccccagcaaaggttgcccaagcctccactaacaatcacagcctaagccactaaagaacctgtgatcactgctgacactgattatggacaaagaaataatatgaagaccacagtactgttcctacccaaaatcagagctaaagaactctacccaacaaatactgtaaatatatctacatgaaaaagtcattctctatgaaagccaatccaaaaacttagaagaagcaattatgacaccagatgcacagacgtaaggacacgagaaatgcgaaaaagaaaacatgacacctacaaagcaacacaataattcttcagaaaaagatatcaaagaaaaggaaatctatgatatgcttgaaacgaaatgcaaaataatgacctcaaggaaactcagtgatatacaagagaacacaggtaaaacaatatgaaaaactcagaaaagcagttaatgatctgaataaattcaaagagatatcgtaaaaagaaccaaagagaaatcctaagactgaagaattcaatgaacaaaattaaaaaatataatcgagaagcttcaacaataggctagatcatgaagaaggaatttctgaattgaaggcagagcttttgaaataacacagtccaaaaaaggtgaaaatctaacaaaaaagaatgaagaaagcctaagtgacatatcggacatcataaagtaaaaagtattcaaataccgaaatttccaaaaggagaagaaattataaaagtcagagaaaacaggcagagcaagatgctggaatagaaagcttcaccaattgcccccacccccacaaggacaccaagttaacaactatccacacagaaaaaaacaccttcatgagaaccaaacgccagatgagcattcacagtactggcttttaacttcctattgcgaaaaggggcactgaagacatagaacaaactgtcctgaatcgccagtgccacctctccctgacccccagcagtggtgcgtggtgacaagagcatctctgggtgctagggaagggatgatatagtttggctccgtgtccttacccaaatctcatctggaattgtaactggggcttgcatcccctgaaataacagcctgagctgtaccttggcctcttttacccacagctggagcaggtgggatgccccaagtcccgaggctgcacactgcaggggggccctggaccctgcccataaaaccattttttacctcctaggcctctgggcctgtgatgggaggggctgctgtgaaagtctctgagatgccctagagacattttccccgctgtcttggtgattaacatttggctccttgtttcttatgcaaatttctgtagccagcttgaatttctccccagaatatgggtttttcttttctaccacatcgtcaggctgcaaatgttgactccatgtctcacatccaggtcatgtggggattatgggaagtacatcttgaattgtaatccccataattctcacaggtcaagggaagaacctggtgggaggtgattggatcatgggggctgttttcctgagacgggggtgagttctcatgagatctcatggttttataaggtgctcttcctgctttgctcttcgttttctctctcatctgccaccatgtaagacatgcctcttcctcttcactatgattttaagtttcctgaggcctccctaaccatgtggaactgtgagacaattaaaactctcttctttgtaaattacccagtctcaggtaatatcttcatagcagtgtgaaaacagactcatacaaggaagaatacagcaattgtgaggcactgaactcagtgctgtcctgttagaggagaaaggaaaagcaaaccaaactcacctgatgttgcccacagagggagcatttaaactagccctagccagggggcaatctccaatcccagaggtccgaacttgagtgcctgcaaacctcaccactgagggccaaagtactgttggcctctaagtaaacctgaaaggcagtctaggccataacgactgcaactcgtaggcaagtcctacagctgaactaggcccagagacagtggacttagggggcatgcgacatactgaggcaccagctgggacagccgagagagtgctggcgtcacccctcccctggccccagggtgcacagcacctggctccaaaagagaccccttccttctgcttgaggagaggacagggaagagtagggaggactttgtcctgcatcttggataccagctcagccacagcaggagagggcaccagcagagtcgtgaggcccccattccagaccgtagctcccagatgacatttctagacatactctgagccggaagggaagccgctgccttgaaggaaacaacccagtcctgccagcattcatcacctactaactgaagaacccttgggccccgaataaccagcagtgacacccatgaattacatcgaaggccttgggtgagtctccgggacttgctggcttcaggtgagactcagcacataaccagctgtggtagctacagggcaaaactccttctgtttgagaaaagcagagagaaaaataaaagggactcaactaccaacatcttaggtaccaagaaccccaagaatgggttcctggggtccctgactccaagacttgagtcttagcatttctgggcctgccttcggccggagggcagtcctctcccctgactagagtcccaaatccctgcaacattcaccacgagctgactttagagaccttgggccttaagggaatgttggcagtaatctggcaatactccatgtggccaggggtaaaggtggctgcggggtgaggctcctgtgcctttggaaaaaggagggaagactgagaaagattgagtcttacagttttagtgccagctcagtcgtaatacaaaagaataccaggtagacttttaaggtctgactcccagacagtacttctggacccacctggggcctgggggacctcatggccctgaagggaagggcataggccttgctggctttgccacctgctgattgtagagccccagacccttgagcaaacacagtcagcagccagggagtggttacagcaggtcttgggcgagacccagcactgtgctggcttcaggtctacataaaagcagaaacatggaacaatggaacacaacagaaaacccagaaacaaatatacacacctatggtgaactaatttttgataaaagtgccaagaacatagaaaagacagtctcttcaataaatgatgctgggaaaactggatagccatatgcaaaagaatgaaactacaccactatctctcaccatatacaaaaataaaatcaaatggattaaagacttaaatctaagacctcaaactataaaactactacaagaaaatattaaggaaaatctccaggacactgggctgggcaaagatattttgagcaataccctataaacacaggcaaccaaagaaaacatggacaaatgggatcacatcaagttaaaaagcttctgcatagcagaggaaacaatcagcaaagcgaagagacaacccatggaatgggagaaaatatttgcaagctacccatctgacaaggggttaatcaccagaatatacaaagagctcaaacaaatctatagaaaaaacaaatctaataatctgatcaaaagacggacaaaagatttgaatagacattgctcaaaagaagacatacacatggcatacagacatatgaaaaggtgttcaatatcactgtcagagaaatgcaaatcaaaaccacaatgaggtatcatctcaccccagttaaaatggcttataataaagacaagcagtaacaaatgctggtgaggatgtggagaaaagggaacccttgtacactgttgatgggaatgtaaattaatacaaccactatggagaactgtttggaggttcctcaagaaactaaaaatataactaccataggatccagcaatcctactgctgggtatatacccaaaacaaaggaaatcagcttatcgaagaggtatctgcactcctatgtttgttgcagcactgttcacaatagctaagatttggaagcaaactaaacgtccatcagcagatgaatgcataaagaaaatgtggtacatatacacaatggagtactattcagccagaaaaaaatgagatccagtcatttgtaacaacatggatggaaatgaaggttattccattaagtgaaataccagtctcagaaagacaaacatatgttcttacttatttgtggtatctaagaaaaatcacacgttcttatttatttacttatttattactaaaaaatcacatgttcttacttatttgtggtatccaaaaatcaaaccaattgaactcatggacagagagagtagaaggaggcttcccagaggctgcaaatcgtacgtggtttacaggggacgtgaggatggttaatggggacaacagaaatagaaagaatgggtaagacctactatttgatagcacaatagggtgactatagtcaatgattacctagttgtatgttttaagataacttaaaaaatgtaatcggatcgtttgtaactcaaaggataaatgcttgaggggatggataccatattttccttaacatgcttctttcacattgcatccttgtatcaaaacatctcatgtactccataaatatatgcccctactatgtacccacaaattttttaaaaaataaaataatttaaagtcagagaaaacctatttaacgaaataacagccaaaaccaaaggaattcatcaccactagactagctctaaaaaaaattcttaggagagtcctatatccagcagcaaaaggacaatatttgccatcatgaaaacacaccaaagtagagaactcactgatagaacagatacgcaaatgggaaaaagaagggaatcaaatgttatcactacagaaaaccaccaaactgtaaaggcaaacaatacaagaggaagaggagaacaaaggatttacaaaacaatcagaaaacaatttttaaaatgtcaggactaagtcctctcatataaataaccataactgtaaatggtttaaattcccccaattaaaagattggctggataggtaggaataacaacaacaaaaagaatctaactatgtgctgcctacaaaaaaaatcacttcaattgtaaagccagattaaaagtgaagggatggccaggcatggtggctcacgcctgtaatcccagcactttgggaggccgaggtgggcagatcacgaggtcaggagatcgagaccatcctggccaatatgatgaaaccctgtctctactaaaaatataaaaatcagctgggcgtggtggctcgtgcctgtaatcccagctactcaggaagctgaggccggagaatcccttgacccagggagttggaggttgcagtgagctgagatcgcgccactgcactccaacgtggtgatagagtgagactccatctcaaaaaaaaaaagtgaagggatgacaaacaatactccacgcaaacagaagccaaagctgagcaggagtagctgtagtgtatcacacaaaatagacattaagtcaaaaaacaaagagagacacaaaaggtcattaaaaatgataaaaacatcaattcagcgataggatataaccattgtaaacatatatgcgcccaaactggagcacccagatatacaagacaaatattattagggctaaatagacagagagaccccaatacactaatagttggggacttcagcagtggacagatcatctagacagaaaatctacagaaaaatatcacacttaatctgtaccacagaggaatccagcagatgtttacagaacatacatccaacacctgtagaatatactttcatctcatcagtaaatggaacattctccaagataaatgatacattagtcctctaaacaaggcttaacacatttttagaaactgagatcatatcaggtaccttttcagactgcaatgaaataaaactagaaatcagtaaaagaaactttggctgtacaaatacatgaaaattaaacatgcttcttgggtcagtgaagcaattgagaaaaagatcaaaaactttattcaaacaaatgaaaatggacatacaacatatcaaaatgtatgggttacagcaaaagtagtgttaagatggaagtttatagcaataaacacctctataaaagaggtaggaagatttcaagttaaaaagtctaacaatgtatctcaaggaactagaaaaacaagaataaaccaacatcaaaattagtagaaggtaagaaataaagatccaaacagatctaaacaaaacagagattaaagaacaatacaatacaaaagatcaatgaaacaaaaagttttttgaaaagataaacaaaattaataaacgacttgctagactaagaaagaaaaagactcaaataagtaaaatcagtgaggaaaaaggggacattataccagattccccagaaattcaaagcatgattagagactgttagcaacaactgtatgccaataaattggaaaacctagaagaaatggataaattcccagtcacacacaaactaccaaggttaaaccgtgaagaaaacagaaaacgtgaacagaacaatagcaagtaatgagatagaaacagtaataaagcctcccatcaaagaaaagcctaggacctgatggcttcactgctgaattctaccaaacatttaaaaaagaatgaataccaattctactcccactattccagaaaaattaggaggaggaaatacttccaaagtatatatataaaaccagcattatgtaaaaccagcattaccctgatgctaaaactagacaaaggcacaacaacaaaaaactaaaggccaatatcactgattagcatagacacacttttttttcaacaaaatactggcaaaccaaattcaacattaaaaagatcattcatcataatcaagtgggttcatctcagggatggaaggatggttgaacatatgtaaatcaataaaggtgatacatcacattaacagaatcaatgacaaaaccatatgatcatttcaatagatgttgaaaaaaactttcaataaaattcaatatgccttcatgatgaaaaaaatcttaacaaactgggtatgagggaaacatacttcagaaaataagggccatatatgacaaaccccaagctagcatcacacttaattgggaaaaactgaaagcccctcctttaccacgtggaacaagacaaagatgtccactttcaccacttttactcaacacagtactggaattcctagccagagcaattagacaggagaaaaaattaaagggcattcaaattagaaaggaagaattcaagttagccttgttcacagacaacatgatcttacatctagaaccaagagactccaacaaaaactgttaaactgataaattcagttaagtcgcaggatacaaaatcaacatacaaaaatcagtagcatttctatatgccaacagcaaacatctgaaaacaaataaagaaagcaatcccatttgcaacagctacaataaaatagcataaacacctaggactaaacttaataaaagtgagatctctacaataaaagtataaagcattgataaaagaaattgaagagaacataataaattggaaagatagcccatgtggattggaagaatactgctaaaatgaccgttctatccaaagcaatctacattttcaatgtaatccatatcaaaatatcaatgacactctgcacatgaaaagaaaaaggcaatccggaaattcatatggaacaacaaaagcaatcctggacaaaacgaacaaagctggaggcatcacgttacctgacttgaaaatgctctataaaattacaaaaagcaaagtaagcatggtactagcataaaaatggacatatggaccaatggaacacatgaaagaacgtagaaacaaatccacacatttagtcaatggagtttcaagaaagtcatcaagaaaatacattgagaaaggaaaatctagatagcccatatgcaaaagaataaaactagacccctatctctccccatatacaaaagtcatatcaaaacagcttaaatatttgaatataagacctaaaaccatgaaactactataagaaaacattgggtaaacacttcagacattgagctgggcaactacttattgagcaagacctcaaaagcacaggcaaccaaagcaaatatagaaacatgagatcaaatcaagctagaaagcttctgcacagcaaagaaaataatcaatgaagaaacaacctatagaattgaaaaaaaaatttgcaaagtattcattggacaagagattaataatcacaatatataggaactcaaactcaatagcaaaaaacaacccaattaagaacaggcaaaatatgctgaattcatagaaatggccaacagatatataaaaaaatgttcaataacattaatggtcagggaaatgcaaattaaaaccacaatgagctatcatctccccagttaaaatggctactataaaaaagtaagaaaataacaaatgctggcaaggatgtggagaaaggggaaggctcacacattgttggtggaatgtaaattagtacaaccactatggacaacagtaaggaggttcctcaagaaactacaaacgcaactaccatataaccaaacaatccaaacgttggatatagatccaaaagaaaggaaatcagaatatcaaagagagatctgcactcccatgtttattgctgcactattcaaaatagccaaggcaggggtcgacctaaatgtccatcaataagtaaaaaaaaaaatgccatatatatatatatacacacacatatacacacacacacaacggaatatagttcctctatgaaaagtaataaaatcctgtcatttgtagcaacatggatggaacttaaagacatcacatgatgtgaaatatgccaggcacagaaagacatatctcatgttctcactcatacatgggaactaaaaagaaggtgattttatagagatagtgaatacaatagtggttttgaggctggaaagagtagtaggtagagggattaagaggggttggttaatgcatacaagattacagctcaataggaggagtaagatctagtgttcagctgcacaatagggcaactatagttaatagtttactgtatatttcaaaatagctagaagagaaaatttagaatgttcccaacataaataaatttttgaggagatggatctcccagttacccagatctgatcattacacattgtatgctggtatcaaaataccacatataccacacaaatatgtacaactatcatatatcaataaaaatgtttaaaaagcaataaagagcatttaacttggaagaaatcacattgtcctccctttgcagacaacatgaccttatatacggagaaactaaaagactccaccaaaatacccttagaactgataaattcagtaaagctgcaagatacaaaatcaacatgcaagaatcagcagtgtttctatacaccaataatgaactacctgaaacagaaatcaagaaagtaatcccatttacactagctacccaccccccaaaaaaagacacctaggagtaaatttaaccaaggaggtgaaaggcctctgcaataagaactataaaacattgataaaagaaactgaagagaacacaaatggaaaggcataccatgctcattaattggaagaattaatattgttaaatgatgatactatccaaagcaatctacagattcaatgcaatccctattaaaataccaacgatattcttcaagaaatagaactaatgatcctaaaattaacatgaaaacacaaaagaccccaaatagccaaggcaataccgagcaaaaagaacaaagctggaggtatcacactacctaacttcaaaatatcccacaaagttatactaacaaaaaaaacatggaattggtataaaaacagacatatagaccaatggaacagaacagaaaacgcacaattaaatacacattatttataggcaactgattgtcaacaaaggcaccaagaacacacagtggggaaaggacacctcttcaattatttgtcatcagaaaagtggatatccacgtgcagaagaatgaaactaaacccttatctgtcaccacacagaaaaatcaaccaaaattaattaactactgtgagcctggaaactataatactaaaagaaaacagttggtgggactgtaaactagttcaaccattgtggaaaacagtgtggcgattcctcagggatctagaactagaaataccatttgacccagccatcccattactgggtatatacccaaaggattataagtcatgctgctataaagacacatgcacacgtatgtttattgtggcactattcacaacagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattctcagcaaactatcgcaaggacaaaaaaccaaacaccacatgttctcactcataggtgggaattgaacaatgagaacacatggacacaggaaggggaacatcacacaccggggcctgttgtggtgtggggggaggggggagggatagcattaggagatatacctaatgtaaatgacaagttaatgggtgcagcacaccaacatggcacatgtatacatatgtaacaaacctgcacgttgtgcacatgtgccctagaacttaaactataatttaaaaaaaaaaaaagaaaacataggggaaacacttcagaacattggtctaggcaaagattttatggctaagaccacaaaagcacaagcaacaaaaacaaaaatagataaatgagactgtattaaaccaaaatgcttctgcagagcaaaggaaacactcaacagagtgaagagacaactataaaatggcagaaaatatttgcaaattatgcattcaaaaaggaactaatatccagaatatacaaggaactcaaacaactcaacagcaaaaatatcacaaatattccaattcaaaagagggcaaaggatctaaatagatatttatctaacacatatagaaaaggccaataaaaatgcttatcagcaaccatcaggaaaatgcaaatcaaaaccaaaatgaggtgtcatctcaccccaatgagaatgactattatcaaaaagaccaaaaaaaataaaaataacaaatgctggcaaggatgtggggaaaacatactctcatactaggctggtgcaaaagtaattgtggtttttgccattaaaattaatagctacccactcccaaaaaaagacacctaggaataaatttaaccaaggaggtgaaaggcctctacaatgaggccactgccattacttttaatggcaaaaactgcaataacttttgcacccacctaatagtatagccattatggaaaacagcatgaggggttctcaaaaaactaaaaatagaactaccatacaatctagcaattacagtactgggtatttatccaaaggatagaaaatcagtatatccaagggatacctgcagccccatgtttattacagcagcactattcagaaaaactaagatgaaatcaacctctatgtccatcaatggaaaaatggataaagaaaatgtggcatacatacacaatggaatattattcagtcatgaaaatgatattctgtcattcatggcaacatggatgggcctagaggacactatgttaagcaaagtcagtcaggtgcagaaagataaaatactccgtgttctcactcatatgtgggaattaaaaaaaatggatttcatggaagtagagagcagaactgtgggtactagaggctaagaaggtggggagaggttggttaatgaacacaaacttaggaggaacgaatctgctcatctgcagcactgtagggggatatggttcactttattttattgtatattctcaaaacgctaaaagaggattttgaatattcatgacataaagaaatgataaatatatgaggtgacagatatgctaattaccctgatttgatactacacatagtatacacataattaagtatcactctgtatcccaaaatatgtgcaattattatgtgtcaactaaaaacaaaaggaaaaaactataaggataaaaaacagatcagcggttatcaggggttggggtaggggtggtagggttgactataaagggacatgagggcacttttttgggaaacgaaaccattctgtatcttgattttgatggcagtttcatgactgggtttgttgaaatcatagaactgtctcactaagtagggtaaattttttgcatgtaaattgtacctcaacaaacctgattttattttaaaaaacatttttaaagaaataaactaggtaaaacttggtatgttgtttaccgagcaataacttgtcaatcataacgtaattcaacccacttactacatatgttctactagcactctggccttcacccatccttttaattaaatatttaatgcctacattcccacttgactctaaactccacagatccttacctttggttaaatcggttaaatctcagcttggtgggtgacaaaagttccaggaaacaaaatatatgcagttcaatgagttatcttatttatctgtttcctaccatgtactgagggtcattacttttgggtttatgaaatctaggcagagttctctgaagatcattgagattttgccgtggaggtgtttcaatctggttccatactacataccttgtcctgggtttggcaacggaaacagtcacattcaaagcagtactggtccctcagctgcttccggcgctcctcactggtcatcagcatatccaggtagcagatggtgagctgtgcaggccagagagagggaagcgctgaaacatctgctgtgctcatttctttaacaaatggttattattattgctaattattggagtaaaacttgtttttattataaaccaaaaatataagagagaaggtactgcttatagtttctctacccaaatgatcacacgtaaatttttaatctatttcctttcagtctttgctatgtggtaaatatatatgtatcatatatttaaagaacgggtcttatgatctctacccacttttgtatcttagtttttttcactacaggaaaatatcaaaaactgttgtatgtttactaaggtttgctaataaattctataaccattagcaatcagagaagccaaattaatcctggcaaccgaaagggtggcagatgatacagccagattgctcttaaattctaaccaattctatagctgcctcatggaatttaaggtcatccaaatttggtatctttgaaatgagaaaacagttctcttatttgtatctaggtttggaaaaaaaagggggggtagaataatttccaaataggggagagtttaacttgagagtaccaccactgatggaagcattcaaactgactgccttacaccctttcagagtaatatcccctgcctcggatggtgaagggttataaatgagaggatatatttaaaggactcctcggacactctctaacactgagtcccattaagtcacgggtctttaggcaacatcataatgcttgagcattttgcacttgattagatctcttatgaaagtctaattcaaaatccagaaaacagaatgcttgatcttcccctcaacctgttccatctcggctagagcattctcactctcagttgacagtaactcatcttttgacttatccaagttgaagcctcagagtcatccttgacttcactctttcctttacacttgccatccaatccaccaggaaattctgcgggctccaccttaaaaactacccagaatcaaccactttttaccttttccagtgccaccatcctggtctgagccatcattacctctcacctgtaaaatgtaatagtctcacaactggtctctctgattctttctccaggccccctgcactccaccctctagccagagtgattcacataaaatatgtcagatgacatgttctgtttgaaacatcacaacagctccccactttgcctgagtgaaggccaggtccttctaactccccaagtgcaattcaaagtatggtccccgcattggtgccagtgcgcactgtgggttaccagtccatgacgacatgagtcaagaaacaaagtcaatatttagaaatgttttttactaatttggtaagggtaattttatgtgactctaataataaaacattgggctttaaaaaaaaaaaaaaagacagggtctcactgtgccaccaaggctggtgtgcagtggcatgatcacaactcactgcagcctcaacctcccaggtttgggtgatcctcccacccctcagcttcccaggtagctggggctacaggcatgtaccaccacactggctaattttctgtatttcttgtagagatggagtttcgccatgctacccaggctggtcttgaactcctgggctcaagcaatccttcctccttgacctcccatggaattacaggcgtaagccactgcacccagcccttcatttttctaataatttattttcactagattttataaaaatactggtctgcaatagattatgaaggaaaagaaaaactggtccttcgtcataggtagagaagcaatggcttcacataatcccacctgttccctctcatttcccagtttccctcattgctgctgctccaccaggctggcctcccgtctggctccacacacactcctacctcaaggcctgtgcactggctgttccctctgcccttctgccccgtttactatgacaacctccctcatcgcctttgagtttcagtcaaatcccactttctcgttcaggtctaacctcaatgccctattaagagtaacaacccaattcccttacctgctctagtttttcttttcctgtatcatatatcagcttgtaccagactgtagaaattacttctttgcttttaaaagtagaaagtaatcatggcggtatgtgtggtggggggagaagtgaagactttggcagagcaagaaggcaggattatccactgaagggatgcaaaaaactccctagagcagaaaactccatgtggtttttgttatacttaaaagaaagcatctcatgtctacaaagcatgatcttacttgtttgaaatcatagtagggcaaaggcagccaccctctctggcagaaaacaaagctttgggaaggactctctcaagctgtaggggtgatggtggatggctgggctggccagccagatctgtcaaatccaccatggccgtcaccatcaccaacgggacaggagtcacagcctgatctggctggctggctctccatagattcttcacattaggcaaccataacatgctgctccacacacagaaacaagaatatctgcccttaagagatacagacaatgacgttactgagtatctactgtttgtggcgaggcagcatagcacagtaaaaactggcaaaggtcttgggttcaggtaacactgaagactgcacccagatctcttgataagtctgatgctctttttacttttacatggctgcttctcatacttggcagggagagagggctgtagaagaagctggcgtcccttaaggagtgtccgtagcaccgtcaaacctaaaatactcacacctgtgttagagaatgttctgtggcaactgagatccttcagctgagacaacagccactttttgatttcctccatgtttctcttgcttcatgatctgaagccagggttgcctctgaggcacaaagggtcacctataccaggcaagttcctcttgtttctaatgaatgctatgttccaaattccaaataacctatttccaagctcactttttgaaacagcctatgagtaagtctgggacagtagatagattcatcttatactatcaggctctgtgggtcccagtttccttacaggaggtgaggtagcaaatgagcgcatccctatgtcccctcttgggttaactctaggacactaattctgaatccagcccaatggctcttagtcatcaactcccattatcagagcaggtaaatggacagtagttattgggagattacagtgtgcccagtgtgaagccactaactccagggcctgtcatgccagaaaaaaatgtgcttgactaacccaagactttattacaagggccaaaactcatgagtgatcttgtcaggcagtgaatggccaacaggagactagttatttcatttaaccccaataaatgggctcctaaagcctccctcggcatactgtaactgcctggaaccattacctggactacgcaatggctttctaactggcttccccgctgcctgcagtgtacctttcatcttctaaactgctttgagagagatcttcctaaaactcacatgtgatcacgtcatttctctacataaaaacttgcgatggtttctcactgcccttgaataaaggcacacaaggatttccctcagctgtttttctgtctgcctttctagcctccatgtctctccctgaaccccagcctgtcacagttatgtacattgctagacctctgaaacaatgaacaccatgccaacatgtgtctgggcatcactggctaagcgagcctctcctccacactcagcctcctgagagcctctcatcctccaagcttggctcaaatacacctcttcctatggcgactgccccattacctcagagaaagccacccatttttgtgcttcttttatgccaatgaagtctgcagaatatctggttatcaattgtgaagtgcttaatggcaaaaatattttattcatatttttgggaaaaaacagccagattactaactggtaatgacagctaaaatcatgttattagccaaagataaaaacctttattaaagactcattgactcactagttgtaatggaatatctgctcagtaaatgtaaggctcatttagtgggaatgtatatgtgaaacttggccattgatcagtagacaccttaatggcacagaacaaaattgcattaaaatattaatgccattgaccactgctctgccattttagtgcagctcttatagaaaatgcagtaaatcatttctgacattagagtaatataatgaaggagattttctagatcttgaatacatagcttacattaaaatctcaagacaaaatgaactccttttccatgaaaccatcttttcattgtctacaactgagtggataagatgagcaagttaaggccggccacggtggctcacgcctgtaatcccagcactttgggaggccaaggcggtaggatcacgaggtcaggagattgagaccatcctggctaacacggtgaaaccccgtctctactaaaaatacaaaaaattagccaggcgtggtggcgggcgcctgtagtcccagctactcgggaggcagaggcaggaggatggcgtgaactcgggaggcggagcttgcagtgagacgagatcatgccactgcactccagcctgggcgacagagcgagactccgtctcaaaaaaaaaaaaaaaaaaaaaaaaaagatgaccaagttaaaattagaccttgtttcatttctagaattccgtgatcacagttatgaatgtttctgttaatactggctctgaactggaaaaaagcctgaaaaatgtcacttctttttaaagtcaaacctgagtatctttgtgtctcttgtttcacaagttgtgtccttgtttcacaaatcctgctaattttatcttcttaatattatagtcttcaggtaccctatcacaagccaccacctgagctccccgacttcaggctaccactgttatctcttccctggattattacatcaccccgacgctcattctcccaaccttgcctacacatagaaaagtggtcatacaaaaataagcaatgagcaaaggacatcctgttcaataaacggtgctaggacggctggctagccatatgcagaagacacctaccttgtaccatatataaaaattaatacaaagattaaaaatttaaatgtaagaccacagactttatgcaccctagaagaaaacctaagaaacaccattctggacgtcagctttcggaaagaacatatgactaagtcttcaacagcaattgcaacaaaaacaaaaattgacaagtgggacctaaactaaagagtttctgcacagcaagagaaactatcaacaaagtaaacaaacgacctacagaataggagaaaatattcacaaactatgcatctgacaaaggtctaatacccagaatctataaggaacttaagcaattcaataagcaaataacccaagtaaaaagtgggccaaagacatgagcagacacatttgaaaagaagacataccagcagccaacaaacatggttttaaatgctccacatcactaatcagagaaatgcaaatcaaaaccacaacgagaaaccatcttacaccagtcagaatggctattactaaaaagtccaaaaataacaaatgttggtgaagctgtggagaaaagggaacacttatacactattggtgggaatgtaaattggttaacccactgttgaaagcagtttggagaggagctcagaactaccatttgagccaacaatcccattactgggtatatacccaaagaaaataagtcattctaccaaaaacacacatgcactcacgtgttcatcacagtactattcacaatagcaaagaaatagaatcaacctaagtgcccatcaacagtgagctaaaaaatgtggtgtatatatatatatatatatatacacataccatggaatagtatgcagccataaaaaagaatgacatcatgtcctttgtggcaacatgaatgcagctagtggccattctcctaagcaaatcaatgcagaaacagaaaaccaaacccagcaattacagatttctcataaattgtggaaacaaatatttagagaatctatcgaaccaaacacccaatgttctcacttataagtgggaactaaacactgggtactcatggacataaagatggcaatgacagacactggcactactagagagggaggtagggcaaggggtgaaaaactgttgggtaccatgttcactaccagggtgatgggattcatcacaccccaaagctcactatcatgcaatatacccatgcaacacagctgcacatgtgccccctgaatctaaaataaaagttgaaattatttttttaaaaatcacaattaggttactaaatattcttttagcttaattcaaaaggtaaatgaaattacatttcttttacacttatccattcttaagaatggggcagggacttttataatgaatttaactgtgaaatcacaatttagttatttattgaatataatttaataaaaccccgttaaaagtaattttatcatcttaagccaaaaacaaaaatcaaacttgtatgtatttgtattcaacagcctaaacctgaaagcaccggctcatttcagacttaaaggtaccttcatttaaagtgaaactggtcataacactttcagcttcaatttcagaggagcatgtattagaacaaagactgcctatagaaaatgttaatttaagaatggaaaataatctgtgtagatgtcatcatggaccaacacttctatacacaaaccaaatgttattcaacagttgtagcaatctttcttgccgagtccaaacatcagccagaccacctccaccaaagaccaattattctgctttgatacgtaagatgagatttactatagttttgatagattctctaaatatgtttccacaatttatgagaaatctctaatgtcatattttttttttggacactcaccatttgagctctacttttcccttcaggaaactctaatcacaaatggaagaagaaaatcactatgtagtaagcatcatgtgctgggcactgtcctaggtaaataatttgttacttcaatcctgagaatgaagctttattactaaccccctccacactgcgtagtagtaagtgtagcactgaacaaatcatttcccagtttaaaccttacattttcttccataaaataaaaaaaatgaatatgtaacattatctgagttttctaagattccaaagatggtacagactacttaggtcttactcaattttgtagtccttgggttttgttttttgtttttacctattaggcttcatctattgcttcctaaattgaatcaccctataaatattccctatcatcatagccatggtcgtatatacaaaaagtgaatgaaaggcaaaggaaacatcacgtttcaatcatatggttcaacgagttgagaaaaactcacactacagcaacagtgactgaggtaaaattgaatgtacactgagtaaaatgtttcgtttgtgatatcccaaatctaactcaggggttagaattgggtggggttttaaaaattgttttcttcaagtgttttatgtatagtacatacaataaaaaacagtaacatttgtaaacatgcaggaaaaaaaaaacaagaaaatctggccacgcagttcctttgctgaaacccttcaatcatgtcccgctgctcgtccttctcccttacacaaatatttactgggcgcctcctatagaccagccaatgttatgaaaccttcagctaaaccaaggtctgtgataaggctcccatggggtttgtcagtctgatccctacatcttccctcaaattcgggtcacatctaaattctttcgtcgtctattgatgagaactgcttcctactccttgaactcaccattctgtccctggcctctgtgtctatgtctacaatgccttttccagcctcatccaactctaactccatggatcctttcagagtctaggagtcagtcctctggaagcattccttaaccactctccactccctccccttactaatcactcgagtgctcctgctctgagctgctgtaagcctgtgcccatttacaccactgtgcatcttaattctattattgttttctgttctctgtcagtttcctcaactataccttgaactcttgaagtcagggctgggtcttaataatctttgtattagagaaggtttctaaaactgctaccaactcctgacatccagtaaacatgcagtgaattcgtttaatggtttagcaaataagatgactaacagaagaaacagactgtcttaatcccaaaagacatcagattaagactgacattagggatactaatgcattcaacttgtgtcaatcacatttctcccagttgatatggcgccagagaatgctggcagccaatggcattatttgtaacagctacaagttattttaaccaggaactaccataagactgctttggcctacccagctttcctccctgatccatgttttataaaactatcagaacaaatgaatctcatatttaagataattttgaaaaggtagccatcagcaatccagtcaagtgagccatgacttaaatgatattacacatctctctctgtaggaggcggctgaatgaggagacaaaaatccaaagtcaaataaaaaaaaaagacccaataactcagcattacaatggagagccttaaatagcaaagtattataaatgttgctggtttgcaaggaaactgtccaaagagggtccaaaggatggatttatatagagagaaacatggggtgagaaatttccatggcaacttctgttatcacagaccttgtgcaattttccagctctccttgtgtgaggtttgaaatgctcccatcttaaactggcagtagactggctttcatattcccttcctttcaggagccatgggacaccactgaggactgccagtcatttgtaaatgtctgagactctattccagctttttttttttttttttttttttctgagatggagtttcactctgtcgcccaggctggagtgcaatggtgcgatcttggctcaccgcaacctgcgcctcctgggtttaagcgattctcctgcctcagcctcctcagtagctgggattacaggtgtgcgccaccacacctggctaattttttgtatttttagtagagacggggtttcaccatgtcggccaggctggatgcaaactcctgacctcaagtgatccacctcccttagcctcccaaagtgctgagattacaggcatgagccacggtgcccagccctattccagctcttattttatctttaagaagtctcattaatttactcaacaaatgttgattgaggaacttctgcctcagttgctgttgagtcttccattgtgaatcccatattctgacactcagatcccaaatagctcatattaaaactgtgggtgccctaatgagcactaaagccaaatgcaaagttcatgataggaaattaccaaaatgtctaaaattttttcccaaggaattttaactttcaaaaaattaatacataatatttatacatatttatggggtccaggtactattttgctacctgcatacgatgtgtaatgatcaagtgatggtatttaggttatccacgacctcatgtatttaccatttttgtatgttgggaacacaaaatgtctagatttattccttaatttaaagctaatatttgtacaataaataggaattaccctgcttaatcaatgcctcaaactgtcttttctcatggctctccctctcccctacctctgctccaaggggtcagtttgaaaggcataggatatattttagttgttgggggatggctacaggcattagttaagcacacgccaaggacacaagtcttctccaatgatgcaacaatcccacacgatgaagaactgtcccattcaaaatggcaatagtgtccccacaagaaatactgccggtcattagagtaagctcaatataatagagagtcgattcaacaaaaagttatcaaatgcctcctggatgcaaagctaagtgctaagagatacagaaataagacacgattgtctgtcctcataaagctctaaatagagaggtctccaaaacagccataatatgtgccaaaaatgtattaataaccactataagcgagaactcaaaggaaaagaacttcttctaatatgggaaatcagggaaagagttacacaagagatgtgattgaaagggtatcttagtccattttctgctgttttaacagaataccacagactgggtaatttataaataaatttctcacagttctggagtctgggaagcatgatgccaaaagcatggcaccggcatctggggagggccttcttgctgcctgataacatggcagagggcgtcacatgaggtggcagcaggagtgtcctcttcttataaagccaccaatctcatcatggggttcccaccctgataaccttatctaatctggattacttcccaaagactccacctccacaaagcatcagcaagaatttggggataaagttttcaacagatggaatctgggggacatgtttaaatcataacaaacagcctcgaagggcatataacattaagacaaagagacacagtggacagaaacgatgatgaatcaggggaaacactgttcagcaagacctacaaaatggaatggagaaatgtttattctcttaaactggtatatatgaaggacttgtggggagaaccttctttttgttgagaagatgccttgctaagtaccacagggaaaaatatctgagtctgaagggctttacactgagtggaaatgtctcgtatttggcaagagggaggatttgcttgttgctccagagatggaaagagaaagatgtgaaaaagtgaaagcagcacctaaagacaaggtgtcttattcaactaaatgaaaagcaaccacgggagaatgactggcagccgagcctaggaaaatagaagaaactttctttgttgtttctgaaaattccaaccaactctaattgcttttgtcaagttacttggtttgttttttaatttgcaaaaacatcgtcatcatcgacaacagcagcagccgctcttcagcccccaaatgaatattgctgaaaatagatagcggtttcatctcttacctgccttgaagtcctttgcggccccagaaaaaaaagagaaaaaactacattgtccatctcactgacatctatcccagtatatttcatacactggtcctaaaatctggaaatttagcgagtagttgtataagaagtggctccttccactgaaaatcagtttggggagaatcttgtcaaagccaaatccctgtctacataaaatatggtacctctgagttgaggttttattggctgagtgctgcataaatgcaataaaagctttcagtactgttttccttgcaataaatatccactttagcaaattggaaaggagaaggaaacggggttctggaaagtagaaatatctgtaactcagaactcagcatgggtagtcactgtgcaaaccagtgcaagcttaggttcagagccctggagcagcccgtttgcagctgtcttgtaagaaggttctgcaccaaaagaggctggctggacagtctgtcaaactggaggggtcaaggccagttcactgctggaggtcatcctccctgtcctctattccctttgcatctttgctgaaatgatcacccagagatgctgatgggtttgtcaagtcccaatgtcagcctgagacagtataagctgtttgctttactagcacaaagttaacatgcatcattaccttcaatgtagccagtggccttccgagtgaagaagtcttggggatcccactcacaagctgggatgcccccccctgcccacggaaggatatgagaggctgctcagctgttgccactgaggagatttcatgaattccctgtgtgtgcataaaacacacaccctctgtcatacacaaactcctctctctctcacacacaggacaggaactgtcatcatccagaaatatggtgacctctcccctaaaaaattagcccatttgtaatttgggagaagaaaggataggttgctggggagaggtgactgaactacaaatactctcactggcagaaggacaatgaaaagttgtcccctcaggcacaatcagttttagggacgggccgagctgagagggtctttgataggaaagaaggccaggctgggaagcatgagtttccttacctcctctcccacctcgatgtctcggactgctcgcagtaagaggtggggcccattgaacacaatcgaacagttggggtcacagctgtgattgagcaaagagatactggaaaaaaaaaggggggaagactgtcacagctcagcaggtagagtcaactaaatttaacaaatgcagtgggtaaaatacaccttcctttggggggcagcagcaggtagggttgacaggatgccaggggttcagtactcggggatgcattcacagaaatgtcactagcacacctcccacgaagtgcaattctcctcaagatgcaggctaactagggaattccgtcatttaataataaaaaaatttcctgagtcctttttggggattggggcatagttgactgattagataacagtcaataaggcaacccaacacgaaggtcagaaagaaactgactcagaaagaaatacttagacagctgggtgtggtggctcacgcctgtaatcctaggactttaggaagccgaggtgggtggatcatttgaggccagcagtttgagaccagcctgatcagcatggtgaaaccctgtccctactaaaaatacaaaaaaattagctgggtgtggtggcacatgcctgtagtcctagctactcaggaggtggaggcaggagaatcgcttgaacccaggaggcggaggttgcagtgagccgagatcgcaccactgcactccagcctgggtgacagagtgagactccatctcaaaaaaaaaaaatactcagacataatgggatgcagcagccaagataccactgacctctcccataggatctcatttgttgagctcctttggagaaatggccgcctttgctagaacatccacactgaaaaataattaggactatttgctcttaaatagagagctgacgttattttgccacctacatcctgatgcatcctgggccatggtccagtcattttattaccttggagggacatttcttaccatctgggaaacaaaatggatttaagctgctatcaggaattggtaataattagaatgagcacttactatgtagaaacactttcttgcacttgagcatgttcatcacatttaatcctcacaacaatcttatgaggatcatttacaggtaaagagactgatgcacagaaattaaatgacttgctcaaggacatacagctagtaagtggtgatggaatttggaccaggtggcctgaacgcagagcccatgctttgaatcatcctatgttactgccttttgagaaccacctaccagtagacctgacctacagttaatgacaattgtgagaaataagaaaaaaggctgaattcttagattcacaattattagaaagtctaaatttgtatttggactcttatggcataaaaacaaaatgaaactgggtgtgcctatagtgcttgtggagagacggtttcatagctcagtggtaagagtcagctcagcaatagctggagagagcattcaggggccaaagcctgagagttttcttgcctccttgagtgaaagggctcagagtgtgccaactcgaaagacaacatgaacccaactgatacgtacggcaagtccggtgaaatcagcatgtgctgcagctcaggaaactggggaataaccaaaaatcagcccgatggttaattagcacccaccgtcctcaacttcttcacccaaagtccccctgagaacaagagtttagttctgagatctgcccctttgttaatatcacagcatataatgtggggttataaaactgttttctttcaacttaacattttccatttttttgtaatttattgctaagttttaagcttggctcttgaacaagctgcagcaactgcctttctaactacctccaaagggctggggatttgggtgggaatgaaagtgtgtcttccagtacatgaagtaccatacaccatacctgggatataggccaacaccaacttcctgcatctccgcattacagatggtgaaagagttgcagatcacctgtaaacacaaggggaaccatcagtattactagagtcacttaagaaacttcatagccaagagaataaaaaacgttcaaacccaaatgtaggagcatcttagtagttgcttaagaaagagccaagccaatcatggatgctctttgacttacaacagaatttatctgggatatactccccctaaaaacatcaggtggttaagtgcagaaataccaacctcctgggagaaaaaaaaaaaaaacagacggaaaccagcagaggaaccattaatttcagtctcattatccactaccccaaagttacagttacatgaactgttcaaaatccagaatatgaataagctatttattgaaaactagactcctgctgtatcacgattttttcaaactgcatgcagtttccaaatgccactgtgtatctgttcagtgatagcaacttgtctcttactcctacagaaagcgaagtatcccgtgactgagcctgtcgtctgatgcgtgttggtgaagaccacagggagcactggaggtcatttagtcaagccatggtatttaccaggagtccatcactgggtacatgacacagtcctgtcttatgcagggacggagcagaagcagtaaaaaacacaatcgactgtgctcaaggaacttaaaaacctcgtttgtgaaataaggttgatgtatgaggtcacacagaaccatggaaagagcactggaccagaatcaggaaatctagattctggctaaaatcactgcttcagacaggtgcgaggaaaagagcagtgaagaaaaacaaaacaaaagttcctgcctccgtggagctcaagttctagttgaatacacagattttttaaaaaacccaatgatagaaaactgtcacatgtagataaatgccaaggagagaaacaaggtccttacagagaaaaaaagttgtcaagaaagctctttaggatgagttgacatttaagcaatgacctgaagggactgctgaaatgaacgtgtgtatttataggcgataaaggctcatatcaggagaaagagcaagtgcgaaggccctacgctaggaatgcccgtggtaacagaggaacagcaaagaggctagtgtgaccaaagcggagcaagaaagtagggggcaaaacacgagctcaaagacggagtgggatcacttacggccctactgccatatttgggttttgctctgaagaagatagaaagccactggattttgagccaaggcatgaaggagtctgacttctgctttaaaaggatcattctggctgttgtgtagagaatgggctataaaaaggtgaatggaagtggagaaaatggttaggaagtcactgctatagcccaggtgatagacaatggtgactcggatgtcggtagcaggagaactgggtagcacagccaacaggccttacttactgcgggacggcttgtggggaatgaaaggagtcaggataatgctcgagtttttggccgaagcaagtggaagatcatagctaccatttattaagatgaggaagaatttaacaggaacaaatttggttacagggagttgagagcaagtccaacagttctgttttggttaagttaaatttgaaatccaagccaagactaagaatgaacaattggagttcacaagaggagttgcgcctagagatataaatttaggatgaaacatgacaaaggccatcaaaaaacaaaaaaaggagaagaggctaaacatttgagatgaaccagagactacaaatggatgctgacttgttataaagtttctgtaaaggaaaaagtgatgacgaatttctcaaatcaggtttacatgaaagaacacgaagtatgaaaacacactgagtcctctgagactcttccactgctccaaacagctcttacatgaaatctagtgcactctagcatgatttggcttttttccctctaaatatataaaattgcagtttcaaatcaggagcaaaattatacatatatatttgtaaacaaatgctaaattgctttaaggacaactattttgcattaagcagcaacagtacattgtctatatatacttatgtataaattggatggtaaaaatataagacagaaagtcctacgtttaatttttgaaattttaaacatttttaaatgtgtataatttgggaagggatacaagttttaacaaatattttaaagtataatgagaactttagttgaaataatccaccaacaaaaaaaccaggtcaaacacatctgatctgttaacttctgaatcaaaccagcatggttttttcctggactatgaagcaaattaacggttttttcaaaataggaaaaatctttatcagtttttttccatcggtttatttcatggattctgatggaatgtttaagaaggaaaagctaacaagaggaaatgtcagcttgcttgtctcttccactgggaaactcttcctgatttcctaagatgacttccctctttagcagcatttatcatactggatcattatttacccatttacttgccatcatacacaactggatcgtaaaatacttgggagggcagacacagtgtttcattcatcactctagtcctgtacctggctcaaagcctggcaaacagaagacactaataaatctatttccttttcttagagacaaggtctcactctgtcacccaggctggagtgcagtggtgcgatcatggctcactgcagcctcgaactccggagctcaagtaatccaccctcagagcctccggggtaactgggactacaggctggcaccaccacctctgactaattttttaaaactttttgcagagacaggagtcttgctatattgccctggctgaccttgaactcctggcctcaagtggtcctcccgtctcggcttcccaaaatgctgagattacaggagtgagccatagctcctggatttcatctatattagtctgagtgttacgtgttagtctttctgggctagtaaacagaaggtttagttttttgcctactctcacttttatttaaaatgctggctccatccagcactatctcaattaacaacctgacaggaaatatttttgacatacacaactgatagcaacagtggatatgcagaagctctctggcttttttttagtgcaagaataggtagataatatgtccatgtgtgctcaataatttgaaaggaattgctctttatatcaagaattaaaagaatggaaataaagcccagaaataaaagtttaaacatttttcaaagtactgtctttgtgaaaacagttttcttagggaattgcacaggttaaaacaattaatgaatgcttacttcacaaaaagataacatttagaaaaaaatattaatggtactacttcaataaaaaataaatgcaactgggttaatgaattctttctaaaaattaagcttgagtattactttagaaatttttaccatgtcttaaaactaaaacacatatttaaattgttttattattgaatgcaaagttatatttactttctgtaatttttcctttaaactaattgaaagccttcatatataatattatagtttttctagatgacaaaaatctagtgagttgtcattgagcctctgtattttataaaaacaactacagtgaaacttaaaatgttctgtgaaccaaattcttatgtcatttggttcagagtctaggtccagaatctgacatttgtgtcctgaggttagcaattccccggtagattagacacaaatagcaaaatcaataccaacacacaaagtgaataccttacaaaatgagtgtattaccatgtattcaaatttcatatttttcctgaaattcttaggactaaaggctttgtattgtagcagcagttaaactgagatatttgcaacacaagagaaaatcactactaagccattatcttgcaacggtaaaaatcagaacagccataagcaaactcacaaccaatcagagctgagtaattctacaccataagacaagaacccagccacttcccagccccctcccccaattactgaattctacacagcctatttcaaataatactttcaatttcccaatatatatacaaattttaaaacacatttaaaaagaaggggattcagtttctgaacacaactatacagaggtttcctccaagaccatctgcatctcctttaaaacttttctgtctaaaatgttcagtacagtgtctggcacagaagactttaggcacatcaagtttactaactagagggactaaatatgagttttcaaaacggagtttaatgtacttagttttattaaaccctggacagaaaaactggaaggaggaagagttggcaggtacgaaaaccagaagcagaagcttttacactacataactgcctctgccccccggcaccccgactcctagaactaatatttctctaactttaaaagcacaataagaattttaatcagggtatatttttctctacccacagaatatgacaggttattaagtacagatttttttccagaatcttctcataaaccttaagagattaaaaattgtatctcccaatccctccttatctgtatggcaaatatttatccatccttcaggacccaattcagtccttgcctgtcccattgcctcttttggtcacatagttaaagggtttgaaatctccaaaccagaacagcgggaggggaccaggctggcgacggaggtcagctcaggagaggagaggctatacttcttaaatgatgattcgcaaatcccagaatccacaaagtgttaccggaaggtttacgagagtacaggtgatttcggcatctgtttcaatttcaattaaaaaaaaaatccataatagaaacaatgaccaactacatttccctttgccaggaagttgctggagggtctcaagttttaccagggagcatgctgtaaggttgcggggacaaaggcccatgctcacgacttagtcactaagctgcatcttcactacactgctagtcttgcgacagtttgacattatagttttccattgtttcttagtcacgttatttcatttgcaaacctaatggacccctgattaaagacagaagcaagtaggagatatgactccaaagcacaatgtagacaaatggggttgcatcaaactaaaaagcttctgcatagcacaggaaatggtcaagaaagagacaacccacagagtgggagaaagtatttataaaccatacaacggataagaggttaatacctaaaatatataagaaactcaagcaacacaatatcaagaaaacaaacaacccaattttaaaatgggcaaaggatttgagtagacatttctcaaaagaagacatataaatggtcaaaagattcatgagaaaatgctcaatatcaccaaatgctcaatcattaggaaaatacaaaataaaatcacaatgaggtatcacctcatgcctgtttcatcaaaaagatgaaagataaaccttggtgaggatgtggagacaagggaattcctgcacactggtggagtctacattagtccagccattatgaaaaactgtacagaagttactcgaaaacctcaaaatagaactgccatataatcaagcaatcccatttctgtactcaactaactaaaataagagatatccgtgctcccactctcacgtgcactgcagcatttttcacattagctacgatatggaattgacctaagtgtccatcaacaaatggatcaagaaaatgtagtatagatacacaaatggagtaatattcagcccttaaaaagaaggaaattctgtcatttgcaagaatatggatgaacctggaggacagtatgttaagtgaactaagccaggtacaaaaagacaaataatccatgatctcacttatatgtggaatattaaaaagtcaaactcatagtaatagagtataatggtggttaccagaggcatgggctggggagagaaatggggagatgttggtcaaagggtgcaaagtttcaccttcttcacaggaggaataagttcttgagatcaccacagcatgatgactacagttaataataaattgtatatatatttcaaagtttccaagaaaaaatttcaaatgcctcaccgtaaaaaatgacatgaggtaagggatatgctaaattagcttgatttaatcattccaccttgtatacatttaccaaaaattcacattgtactctaaatatatacaattgttattcgttaattaaaattttaaataatttaataagacagaaagcaaggatgttgaaaaacaagggaaaatacataaaatgataattctataaatttgtctcaagatgctttatatcatgacttaccaggttgaaattcttatagagcatctcaagacatctctaatatttgaaaaaatgttaggaggagaacatacactgaatacgtaatcttatttttttttttgcagatggcgtgaagaccacgaaagtccccagtgtgtgatttggaatgtgcttgcactttgctacctaaaacctttcttgtcttataatcgagaaaaagaacatagaagtcatgaaacataatccagctggtttcttaaagagttaattataagaatgtgaagcatcaggtcatgaaagcaatatgcaacctaaggcccaaagcaataatatttcatttaaaaatttgtgttgattaaggccaggcgcagcggctcactcctgtaatcccagtactttgggaggccaaggcaagtggatcgattgagcccagaagtttgagaccagcttgggcaacatggcaaaacctcgccactataaaaaatacaaaaattagctgggcatgatgccatgcacctacctgtaggtccagctactcaggaggctgaggctgcagtgagccatgatcgcgccactgcactccaatgactgtccccgccacaaaaaaaaatgttgtggtaataatgtttttacaaaactaatttacagcaggttaaaccatgcgatatcacgtgataaaggagaaaactaaaaatttgtctttatatgctatgattattaaagattttacaaattcactttgtaatacaagtcaagtaaaaaataaaataataatattatttaagaaaactctttatcccaccacacatgacaatatatttgggaatttgtctttctagactgagatacatccaactgttttcacaactgcagtggtgtctgtcccatttcaagctctggccacaaataagtctgcagtgcacactagacacacaaaatcctcaacaatcacttgtcaaggctaaaatcaatatcaaggccaatatcataaggaatggcaatcataaaattgtgctttctattttatctctctcccacagtcaaactgccaaatgttagcaaatgaagcccctttagataacatgctttctaaaatccacagattttcattttctaaaagctttactcacaacagaacttataaacaactatccttgctaatagcaaaatagtcacatatttgtccactgttccttccctgaggctcttacctggcatttcacctccttaaagccatctgatgaaacaagcacttaccacagatgtctgtcaaatacgtagagaaggtataaagctctgacacatcattttcattgtttcattttcttcccatatcctgaggctcagaaattcttcaataatttattacaagacatcattataggtttccatagctccacggtcacatctaccaatttcatttagatgtgctcctacccaaaaggtttatcacaatgaactgaactttctcccatgtatcgcacttaaagattcttttgttcagcttaaatcttcaaaaacattctcttctatgatactctagtttcattattctctaagtaagtggtgtggaaatccacccccagcagtaccaggacgcctcactgtaatcttactcccagtactaaattcctaaatcaagtatgctaggtgctgcatagcacctgactgaagttgaattagatatggcagcgtgtggctcaagttatctgtttttccgtcaaattaatggagaaaaggaaactacagaaaaacgttacacgtgaaaggtaagactgcacactaatcaactgcttaaagtaatccccaaatgaaagatacagtgcgtgctgaggttcctttcactatgtagaaattaaggtgaatattctctccgggtgaacttttggcaggcaagggtttgccataccgatgatgcctgacatctcagggagtgaaacccagaagcaggtatttcacatgacagtagctgaagtgtgcatgactcgtgtacaagctgtgcgggcccgcatgaaggtattttggggactagtgcgtggctgtttctggcagccaatgacaggctagatggggagcaccttggggggccactccttctttggttgcccaagcatgcctgatccctggatacagcccgataacctagtgggcaggagccagggaagaacaaacacagatcagacgagagagagtcacaactttaattatgcagtcaagaggcatcaagaaatgagtctctgaggtcagacagcccctcttttgatctctccaggtatgctcctttatttttggaaatatagaaagaaataaaagaggaaatttatcatggcttcattccaactcctacactgttcctttgtacagaagtagctcataattcttccccttcttcttccagacacttttatagatggccagatacacaaatcagactggtgggatttcaatgcaaggatatcatttgatcttttgtcttctcttctggtaccatttttaactagtcaccatcatgaatacataaatagtgccattcccagcctctttcctgaccagattcctgagttggtaagtagctaaaacaccagcatactgcccctacaccgcttcagtgagttgctgcagcaatttgcaaggaaggttcccctttcctgactcaagagttcatcagaatgtgaagaaaagaggagttcaagaccaccctggccaacatggtgaaaccctgtctctactaaaaatacaaaaattagccgggcgtggtggcctgaggctatattcccagctactcgggagggtgaggcagaatcacctgaacctaggaagtggaggttacagtgagccaagatcacaccactgcactccagcctcggcgacagagcgagactccatctcaataaaaaaaattaaaaaataaaaaaatttaaaaaaaaaagaatgtgaagaaaatagataatttagaaaagtagattaaacatattttcttttgtaatggacattgctgaaaatacagtttgacaaactcttcttagctagttagcaggaccctcttgactaagaaagcattatagaagtatcggtttaaaaagatagacaggccaggcaccatggttcacacctgtaatcccaacactttgggaggccaaggcgggtggatcacgaggtcaggagatcgagaccagcctggccaatatggtgaaaccccatctctactaaaatacaaaaaattagctaggcatggtggtggcaggtgtctgtagtccaagctactcgggagactgaggcaggggaatcgcttgaacccaggaggcagaggttgcagtgagccaagatcgcaccactccactccagcctggcgacagagcaagactccgtctcaggaagaaataaataaataaatagccaaaccctggcctagaggagacaggctgactgttgggtccagatctggtccccatcaacttttctagtctcttctctagtgtctgccttctcatgttttcctctcagttttcctgtcttcacaccttcatgtctctgccaggtggaacagtcccactgcttagaatgttctcccctccttcctctagctactgaaataccactggtcccttaagaacggttcgaaagtcttttcctgtgggaggccttcatgtcattgaaaaagaagaagagagagggacagctgcaatcactgtggctccagtcggtgccggggagactgggtggtttggactgggaggaattctccacagtgcagcatagcggctatggcaaatcatggccagactgtttctttaggtgggtcacagatccatccctcctcaccttcccctcagggaatttcagcaactccagccaggggtttacggacagaactctgatctccccgggacacagcactggggggaggggcagctatggtctctatgttcagcagacttagtctttcctgcctgctagctctgaagagtccatgcagtctggacaaggggaactccccccagcgcagtgcacctgctctgccaaggggcagccacactgcttctttaagcatatccctcatcctgtgcctcctgactgggtgagacctcccaactggggtcactagatacctctgacaggagcattctagctggcatcaggtcagtgcctctctgggaggaagctcccagaggaaggggcaggcagccatctgtgctattctgcagcctccactggtgatacctccaggtgcaggaagcacccaggtgaatacggtctggaatggactcagcaaaccacagcagccctatggaagagggtcttgactgttaaaaaaacaaaacaaaacaaaacaaaaaaaaacagaaagcaccactaccaccgacatcatcatcaacaaaaaagactccacaaaaaccccacctaaaggtcaacagcctcaaaggtcaaaggtagataagcccacaaagatgagaaagaatcaatgcaaaaatgctgaaaactcaaaaagccatagtgcctcttctccttcaaatgactgcaacatctctccagcaagggcacagaactaggcagagtctgagctggatgaaatgacaaaagtaggcttcagaaggtgggtaataacgaacttcactgagttaaagtagtttgttctaacccaatgcaaagaagctaagaaccatgataaaacattacaggagctattaagcagaataaccagttgagagaggaacataaatgacctgatggagctgaaaaacacaacatgagaacttcacaatgcagccacatgtaacaacagctgaacagaccaagtggaagaaagaattctgagcttgaagactgtcttgctgaaataagacaggtagacaagattagagaaaaaagaatgaaaaggaatgaacaaaacctccaagaactattggtttatataaaaagaccaaatctacgaatgattggggtacctgaaagagctggggagaacaaaaccgagttggaaaacataactcaaggtatcatccaggagaacttgcccaacctagcaagacagaccaacattcaaactcaaaaaatccagggaaccccagtaagatactccatgagaagatcaaccccaagactcataatcatcagattctccatggttgaaatgaaagaaaaaatgttaagggcggccagagagaaaggccaggtcacgtacaaagggaagcccatcagactaacagcagatctctcagtggaaaccctacaaggtggaagagattagggatcaatattcaacatttttttcgtttgtttgttttgagacagagtctcactctgtcacccaggctggagagcaatggaacaatctcggctcactacaacctctgcctcccaggtacaagtgattctcctgcctcagcctcccgagtagctgagattacaggtgcatgccaccatgccaagctaatttttttgtatttttagtagagacaggttttcaacatgttggccaggctggtctccaactcctgacctcaagtgatctgcctgcctcagcctcccaaagtgctgggattacaggtataagccactgcaccctgcctcaatattcttaaagaaaataatttccaacccagaatttcataactggccatactaggctttataagtgaaggagaaataaaatccttttcacacaagctaatggtgaggaaatgtgtcaccaccaggcctaccttgcaagagctcctaaaggaagcactaaataaggaaaggaaaaactgttaccagccactacagaaacacactgaagtacacagaccgatgacactatgaagcagctatatcaacaagtctgcaaaataaccagctagcatcatgatgacaggatcaaattcacacataacaatattaaccttaaatgtaaatgggctaaatgccccaattaaaagacacagaatggcaagctggatgaacagctgagacccatcagtgtgctgtgtttaagacacccatctcacgtgcaaagacacacgcaggctcaaaataaagggatacaggaaaatttaccaagcaaatggaaagcagaaaaaaagcaggcattgcaatcctagtttttaacaaaacagactttaaaccagcaaagatcaaaaaagacaaagaagggcattacataatggtaaagggttcaattcaacaagaagagctaactatcctaactatatatgcacccaatacaggagcacccagattcataaaacaagttcttagagacctacaaagagacttagactcccacacaataatgggagactttaacaccccactgccaacattagacagatcatcaagacagaatattaataaagctattcaggatctgaactcagctctggataagtggatctgacatacctataaaaatctctaaccccccaaaacagaatacacattcttctctgtgccacatggcactcactctaaaattgatcccttctaattgttttactaattggaagtaaaacactaatcagcaaatgcaaaataactaaagtcataaccgtctctcagaccacagcacaatcaaattagaactcaagattaagaaactcactcaaaaccacacaactacatggaaattgaacaatgtgctcctgaatgactcctgggtaaataatgaaattgaggcagaaatgaagaagttctttgaaaccaatgagaacgaagaaactatgtaccagaacctctgggatagagctaaagcagtgttaagaggggaatttatggtactaaaagcccacatcaaaaagctagaaagacctcaaatcgacatcctaacatcacacaactaaaagaactagagaaccacgagcaaacaaaccccaaagctagcagaagacaacaaataaccaagatcagagaggaactgaggacagacacacacacactttccaaaaaaaaaaaaaaaatcaaagaatacaggggctgagttttttttttttttttttttaaataaaataggccactagctagacttaaaaagggagaggaatcaaacagacacaatgaaaaatgataaaggggatatcaccactgatcccacagatatacaaccaaccatcagagagtactataaacacctctatgcaaataaactagaaaatctagaataaatggataaattcctggacacatacatcctcccaagactaaagcaggaagaagtagaatctgaatagatcagtaacaagttccaaaattgaggcagtaatagcctaccaaccaaaagcagcctaggaccagacatattgacagctgaattctacaagaggtacaaagacgaagtggtaccatttattctgaaactattccaaacaattgaaaaagagggactcctcgctaacttattttatgaggccagcgtcatcctgacaccaaaacctggcagaggtacaacaaaaaaagaaaacttcaggccaatactcctgatgaacatcagtgtgaaaatcctcaataaaatactggcaaaccaaatccagcagcacatcaaaaaacttacccaccatgatcaagtaggctccatcccagggatgcaaagctggttcaatatttgcaaatcggtaaataaatgtaattcatcacataaatagaaccagtgacaaaaaccacatgattatctcaatagatgcagacaacgcctttgagaaaattcaacaccccctcattgtaaaaaccctcaataaactaggtattgaaggaacataactcaaaaatattaagagccatatatgacaaacccacccagccaatgtcatactgaatgggcaaaagctggaagcattcctcttgaaaactggcacaagacaaggatgccctctctcaccactcctattcaacacagtattggaagttctgaccagggcaatcaggcaagagagagaaataaagggtactcaaataggaagagaggaagtcaaattgtctttgtttgcagataacatgatcctatatctagaaaactccatcgtctaagcctaaaagcttcttaagctgatgagcaacttcagcaaactctcgggattaaaaaaaaaatcaatgtgcaaaaatcacaagcattcctatacaccaacagacatgcagagagccaaatgatgaataaactcctattcataattgctacaaagagaataaaatacctaggaatacagctaacaaggaaaataaagaatctcttcaaggagaacgataaacctccgctcaagaaaatcagaggacacaaataaatggaaaaatattccatgctcatagataggagaaatctttattatgaaaatagccatactgcccaaagtaatttatagattcaatgctattcccattaaactaccattgacattattcacagaattagaaaaaactattttaaaatccatatggaaccaaaagagagcctgtagagccaagacaatcctaagcaaaaagaacaaagccggaggcatcatgctaccaaacttaaaactacactacaaggctactgtaactaaaacagcatggtactggtacaaaaacagacatatagactaatggaacagaatagagaactcagaaataagactgcacatctaccaccatctgatcttcgataaacctgacaaaagcaatggagaaaggattccttatttaaaaaatggtactgggggaactggctagccatatgcagaaaactgaaactggaccccttccttacacattatacaaaaattaactcaagatggattaaagacataaatataaaacataaaactataaaaaactccagaaaaaaatctcggcaataccattcaggacataggcataggcaaagatttcatgaagaaaacatcaaaagcaattgcaacaaaagcaaaaatggacacatgggatctaattaaagagctttcgcacagcaaaagaaactgtcatcagagcaaacagcctacagaatggaagaaaatgtttgcaatctatccatctaacaatggtctaatgtccagagtctacaaggaacttaaacaaatttacaagaagaaaacaaacagccccattaaaaaaatgggcaaaggacatgaacagacacttctcaaaagaagacatttatgctgccaacaaacatgaaaaaaagctcaacatcactgatcagagaaatgcaaatcaaagccacaatgagaatctcacccactcagaatggtgattaaaaagtcaagaaacaacagatgctggcaaggctgcaaagaaatagggatgcttttacatggttgatgagaatgtaaatttgttcaatcattgtgcaagagtgtggcaattcctcaaaggcctagaagcagaaataccatttgacccagcaatctcattactggttatatacccaaagaaatataagttattctactacaaagatacatgcatgtctattttctttgcagcactattcacaatagcaaagacaaggaattaaatgtccatcaataatagactggataaaaaaatcatggtacatatacaccatggaatactacacagtaataaaaaggaacacgatcatgttctttgcagggacttagatggaactggaagtcaatatcctcagcaaactaatgcaggaacagaaacccaaacaccacatgttctcacttataagtgggagctgaacattgagaacgcatggacacagggaggggaacaacatacactggggcctgtccggggattgaggggcggaagaacatcagcataaatagctaatgcacgctgggattagattaatacctaggtgatggggtgatagctgcagcaaaccactatggcacatgtttacatatgtaacaaacctgaacgtcctgtacatgcacccccgcagttaaatttaaaaaaggaaacagcacagcaatattaaagatagtactgcctgaaataccacaatttaggttttttctctgaagagccagaaaggagatacaggaagagctgaatacaagtgacaaagaatctgaacaggagaggagagatggtctcagagttgttccaaacttacttgtcctcaaagctctcctccaccaccttcctccaccgcatgtggaggccacctaaaaatcacaccactcaacacattgttttctatcaaacaggtctttacactaaatcccaaatatgttgtccatgagaggaacatctgacgttcccacgccactcacgcctcaaagcacttcacctcacctcttccagttctccaatcccctcacaaagaagctatgagtacagtatcttcatgaaagaaaggtaagagaactcaacagacgcttctgaggctacatggtccgatgttctcacgcatcaaggaaatttggtcaaaataacctttgcagaaaactcagttatgaaggaagtacgtacaggcagagtggggagggggttaagctaaaggtcgggtctgaaacacagtgttgtacactagacccatcagaaggatagatttgttcattcattaagggtctattatgtaccaagcacagcgccaggcactaggaagaaaagaggaaaaattgtcccttttaatcatgttgctattatttcaccgcccaagtaaaacaaaaatgtaaaaaactccccatttctctctaattttgacaaattttagccttcctcagccaaagattattttcctgactattggccatatttctttgttaagtcactctgtcaaaacataagttgcaataatgcggggcagcgtcgaatctgccagatcaatttagaaacaaatgagtctgctgctcttccgtggccctgggaggcgggctggcctccacgtactgtcagatcgtccacaggaagaattgctggggattactgaagaccagctgggaagcgtcaactaaaatggatggcctttgaattttccactctcccattgtctaactatagccagccgccattcccaaattaatgccacagagagagagatattctctcctaaggcaggctgcaaagataaatcggctacaaaagagcaagtagctaaaggaagaaacagaaaatgaagccttggcactctgtcatgtgaatgtcacagtatttgcaggaattcatacacggcacaaccagagacagaatagaaaagtaagcttccttcctaccccggtcctcctccatatccccccaaaacgaacccaattgtttcctgttttgtgaatgccttctgctaccccatgtcaccgtattttaaaacatcagggattcagttgctttatgtggggtaaaatgtgttaaatgtgcctgcatttctaaaccatcggctaatgagattttattaggaagagcccagaaataaattaccagaatttaccagaaagctataaaatggagggattgtgaggattaaatgagaaaatacatgtgggccttggaatgactcagggcatataggaagcttagtaaatggtagcaagatcataattattaccatagttcgatcaactgtaagacccactcaataaacagtccacaccattatgttacgtaccactaagaaaaaacactaccaattaaactgtcagcctgtgtattataaatcagatatctcagaattaatgaaatacagtatcactacatatacctctaggtttccagaagtaagtcacagtgtacgtaactagtgacaaagattctttacttggccaaactcagaggagattctttacttggccaaattcagaggagattcacgcctctgaatctcctaggtccatccgtgttgttcctcaaaatccagttttagcaaaagaaccctgcctagccggtttcgccagaacctcggtactcagaatcttcatgttcctcatccttcaccaccctcgggtgctgtctgatcaccctggcctgtcttcagcaagaatccagttaggtaagaggggcctcaaggtgactgagaagatgcatctggaacttgcttcctccacaaagaagaatcgaaacagcaggacggaatcgcaactggaaacagcaggacggaatcacaactggaacagatcatctaacagagaacagtggaattcaacatggaagtgacaggagacgcctaaggcaagaaaggagagggaagcaaggcagcctctttggctgggaccctgaagaggctccccactgtgtggagagagtaagtgagagatgcccagccgtccacattcccacatggactcctgtgatccgagccacaggagagccccttgtggtccttagactaacagagtgctgcccggggaccacgctgtggcactgctccagggagggagcttgtgctgggccccacatactgctcgagtcctaagcagctacagcacagcaccattttgagggcccagcttccaccaggcagcatcctgccctgggccccaaatagcccttgaatgtccacattcctggagccccattgatatcctccaccacagccactgctggctcctgctgctgccagggctgaagcacaagccactagcagtgaccctgtggccccagcagcaaggccaccatgcacatacaagtaccctaggacaggttaacccacctgcagccaccacctaggaccaaagcacacactcttcaggacacctggcccagttccaccagccccagtgaccaggcaagccatgcaaaggcctggggattgccctaccccgtccatccaccactgtgggcagctgagcagttcctctgcaagcctgaggatgggcctgcccgacctgccgctaccagcacatctagcatccattgcatgtgccaactgcaggcctaaggaccggactgcccagccgggtgcagccaacaccaacactggccacttgggagccaggggatcctcctgccattgctactgccattgcctatgccacgcccattgcccagacgcccaaggaccctcccacccagcacactgatgccacctaccaccagcacccaagcaagccaactggatgcccaagaactgacatgcctagacttgctaacgtggatgccagtgtacacagccttgaggccaaggacaggcacatttagcccaccaccgccaccgtggggcccaaggactggtgcgcccggggtccctgtccccagcaaaatttcactgcagcttctgctaacaaccacaccacccagagccactgaggaaattatagacaccacggatgccgatacagccaaaaaagaaaaagaaaaaaaatcatatggagactacactaccgtgcgcacccagaaccaaaaccaaagtacccaaccaaggccggatgcggtggctcacgcctgtaatcccagcactttgggaggccaaggcggtggatcacttgaggtcaggagttcaagaccagcctggccaacatggtgaaaccctgtcttcactaaaaatacaaaaattagccaggcgtggtggcacacacctgtagtcccagatacttgagaggctgaggtggaagaatctcttgaacctgggaggcacaggttgcagtgagccaagattgtaccactggactccagcctgggcaacagagtgagaccctgtctccaaaaaaaagaaacccaccccccccacccccacccaaccaaccaagaaacaacaaattaaaaaacacagtgcccaacccaaacaccactatagacctatcttcaggaaaaatcctcccctgtgaatgcaaatttaaaaaactggaaggagcacaagtcactgtctgtggaagagaaagcgaaaaataaataaaacaatttaaaaatggataataaataaatggaagaagcaattgttagaccaggagtgcagacatcaatttaaggacacaagaaacatgacaaaagcaaggacatatgactaagaaatacattaattctccagcaacaggttccaaagaaaaagaaatttaaaacatttttattaagtagtaaaagaagcctgacctaatactgttaggtgaggttagccagaatcccccttacctggatatttcctcttggtaattttccatctaccgacccccacactgccccttggctaccaattcccacgtgcccacaatgtatttggagctgagcctaatctttctcccccagtgcaagacctggttgcagtggtccctgtacctatcgccatggtcctgtgctttaacaaacaggactgagtatttttttctgtaacagcaggatctgagtacaggttgttggtgtcaccacagccacactaggccctgaacgtctgaccaccccctgttcttggagcctcagtcactacacagattggctcgctctggccttcttgactcttaacattgcccagaaggattcaccaccactttcagcgtcatagttctttgctttcaccattccgagtcggtcgtcatagaatatgctatcatatgtcactcaaaatccaaaatatgcctccgatataaagttacactgcttatgccaagtcagtggtcttgccaaatgtggccatactctggaggtgactttgtgcacatatgttcccagtattttctatccatgctcagttaagcagtgccatttcccttggcacagagtttaaattagttatttgcaaacgtaaattcacatttctttttcacctatcacaccgctctctctaaataacagagtaaaaacacttacgcagataatttgggtagggaaactggggatggatttcacagtcattcatcattagcctgacaagtctttgagttagggattgaacactccggcatattagttggctatttgttattgagagcaccagctctcaagatcacaggacatataaggtaagtgatgaaggatacacaatggcatttagagaaactacacaagaactgaagaaaaacaaggaggcacattgtttctgcatcactcttattacctgcaaaccaggggatggataatttaaaataccagcggagtccacggcagccgacagcctgttaccttccttggttacagaaagatgcgggggtgaattacccactccatggctgctttaccgcgatgcacagtacacgtcagatctcttgaaaatactcgtcgtggctcactttgggaggctgaggcgggtggatcacgaggtcaggagatcgagaccatcctggctaacacggtgaaaccccatctctactaaaaatacaaaaaattagctgggcgaggtggtgcacgcctgtagtcccagctactcgggaggctgaggcaggagaatggcgtgaacccgggaggcagagcttgcagtgagccgagatcgcgcccctgcactccagcctgggtgacagagcgaggctctctctcaaaaaaaaaaaaaaacaattgccatgatatagtcaattcctacctcctacgagtctgactgtgctgcttgtgatctgaccaggagaactctccacttttcccctgtgttgtcctttttcataatccctgcttagtaatcacttccaccaagaagaaacgtctcaactttctcatgtgtgagattcaaccagtcaccctactcttcattattacaaacaaaaggtcaagttctccttttcttgagttatatacagatttaattagttatttctaataaaaaataaaattccacatgatcctttctttccctctagctttattttgcacaaatgctctcatttcccccctacatctaaatgcaaaacagaatatattcactaaaggaatcagggtttgatgattacagcaaacaactgcatttgcatatgtgaggtttccaactttgaattcaaagacaataaatagcaaaatgatttagattagaatttgccgtttctggaaaaaaaatgttatcaatgacaggaaaagaaatgttggtgtcaaagaaaataaaacagaaatacctgtaaataaagatgagtatctatcaattataccatgataaagctgggtgggagggagattattactgtaaaacttgtttgaaggggaaaaaattaaccaaagcattatcaataaacgactaaaaagctgaaacgtaaggatcactttgggaaatgaagcaaaatcaaacaccaggaaacaaggcatgaaaagaaaaggattaagggaacagatgagttgatgacaaaaaagttacaaagaccaggaggaaaaagaaatatgagaattaccgattgtaataaagaaaaagaaaaagactgacaagcataggaaaaaaaatgacgtttttatggctgcttgatgatagttcagtccattgtcaacctaactagaatcaatcagaaagccgatcctcagaagcaaatgagtgaagaggcctctgggtaaaggctgagagtactggttgatgggcatcactgttaccactgttctcacctaacttgagaagattgtgatactagctccccaaatgctcctgttaatggcatgtaccctactcttagcaggtctcacattctgtgcaaaaacactgaaagtcaacataatatgttttgtagtgtaatggagacagatcaggtttttactaagctaaaaggagatacagccttggctacgcactcgagcagaacgctgtgaaaacgcatactaaaatgatgagcctgaactccccacataccctcaagtgcatacagggttgtgtctctgcaaaagcctctacccattgaggtttccttgtgcaggggatagtctgtatctagatgctatatcaaggtgaagatcaagtatctttagttttcataaaatactagattccaaacagaaaggtaattatcagacagagtaggtggcaattagaggctgagcaggaggctctaagaatctaaaaggaatttggtcggcatgtgatcatgaaatccccaaaacattccagaaagtgataaaaataaacacctttgggtaaagtgttatttccccaaagaggaattgaagctagttagatctctttggtcataatatatattatcagtatatctggagaaagaaacaaagcaagattaccttttcttcttcttcttccatagtttaaatttgctacattgggaaacttcactgcacattaatatatcaactccaactagaccaaaatctttcaattaactaaaaacattttttaggatgtaactctgaaaaaaataaaaagtgagaaaaagcaaacataaagtaaactggcttaaaagtagggttcagtttgttttgttttgtttttgagacagagtctcgctctgtcacccaggctggagtgcagtggtgtgatctcggctcactgcaagctccgcctcctgggttcaagcaattctctgcctcagcatcctgagtagctgggattataggcgcctgacaccacgtctggctaattttttgtatttttagtacagacagggtttcaccatcttggccaggctgatcttgaactcctgacctcatgatacaccagccttgtcctcccaaagtgccgggatcacaggcatgagccaccgtgcctggccaagtagggttcagtttttaaaaataaacagcagcaacaacaaaaaccccacatgtactttcaaaagtatgttctgtgattactcttgtgcctggttcttcaaacaaacacaggacttttcacaaatgaagcctgcatgttcaatgctgaataagattaaaacgtgtttagctcattgtacctacagaaacacaacagaacttcagcaagattttcaacaatgattattttaattttaaaaaggattttgtgtaactttgtttaaatctgataatcctctttacttcaaaaaattaaagaagaaagtgaaagtaatacttggaagcaaaatgaaactaacacgaagtgtatcaggtacttttccacattaactcactgatgtaattaaattacaaatgctcagcgtcctaaggggtcaacactgtaattaggaaaagtgtatttctccttagtccttataccatttgccctggtataaatgcttgtagtaaacattgttactctttctcagacaagcgttttaaagatgctagttaaaatgtagttggtagctagtttcctgagtcaatatggcaattataccaataaaattgcagatcaagatgagccagaggcagtaaggaacaggccaaagaaaaacaggaagaaaaggggacgataaagaaagtggtaggccaggtgtggtggctcacacacctgtaatcttagcactttgggagactgaggcgggcagattacttgagcctagatgtttgagaccagcctgggcaacatggtgaaaccctgtctctacagaaaatgctaaaacattagccgagcatgctggcaggcaccagcagtcacagctactcaggaagctgaggtggaaggctcgcttgagcccccaggaagcaggggttgcagtgagccaatatagcaccactgcagccactgtccagccttggtgacacagcaagactgtcgcaaattaaattttaaaacagtggtagtttattccaaattcatgtgctaatcaaatcatatctctgtgccactctcacattcagccctttcttcccgtttccactgcaggtatttgtctcctgtattcattatctcttacttgcaactttccaagtcaatctctctggtccctgtctttttccaaaccattctttaaattgtcatcagataaatcttttttaaaaacagatttgattttacaaaagagaaacaggagatctacccagtagttgcagaataaagacaaaattctctcgtgtgacatcaaacgccccctataatctactcccatcctgtgtttccctgcacccaacacgtatttcagttatcctggcttctctgtcattcccaagtcaggttgtgggcccatgtggtgttttgtttttgtttttgtttgagtctcgctctgtcgcccaggctggactgcagtggcgcgatctcagctcactgcaagttccgcctcccgggttcacgccattctcctgcctcagcctcctgagtagctgggactacaggtgcccgccgccatacctggctaatttttttttgtattttttagtagagacggggtttcaccgcattagccaggatggtctcgatctcctgccttggcgtcccagagtgctgggattaccggcatgagccaccgcgcctggccgcccatgtggttttatgtcttttctttttttttggcatatgattgccaggtcatagcttttatatctttattcatagtttcctcttttaaaaatatctttttcactactgcgatcgctcataattttattcatcctttaggatccggcttaaatgtcacctccttcaagaaactttcctacatccaaatagatttacctgatacctgagtatagatagtacagtatattgttataattgttctattttagtattattgttgttaatctactgtgcctaagttataaattaaactttattgtaagtatgtatacataagaaaaaacagtatacatgaggttcagtactatccatggtgtcaggcaccctctggggtactggaatgtatcccccatggataaggaggcactaagcaacatattgtatgtttagctttgcatacttttggctacttacagatggaatcatactgcattgatgattttgcaatttgttttgggttttttttttttttggctcaacattatatcctaagattcatttatgttgatgcatgttgctatagtttatagctgacagacctcttgatgtgtcttctaggaggcgcttatgaagagaatttccataggaacactgtttgtaaatgcaaaaaattacaaatgaccctatgttcattactaggttatacaaatagataacattattttctattttttcatttttcagagatggggtctcattttgttgcccaggctggtctcaaactcctgggatcaagcaatcctcctgcctgggcctcccaaagtgttgggattataggcgtgagccacagtattcagcctcttggtattttctatactagcacctactaatgtatatggcacatagtatactctctacaataaatgctttttaagataaacgaatttgagaagaaaagttatgtctgattcattgtggcttcctcatccatagaggccagcacatgctcagatgctcagtcaagatctgatattcagccacaaaaggctagcagtggacaggcaggaaataatctgagctgacacaagtgagggagcaaaacaggacgtgtgacgtgttgggtgcctacccctagcgaggcaggcagagcattattttttatgaggttaattccacctgcttacttttgagtcctacaaaccactgtagttcacaagaattcctttcttctcttgtgactctctgtctccccagcctcagctaattccctctccctgtctttgtctccctccttctacttctcctcctcctcctgtactactcccctactcccctgggtatgagcctgcttcggtactctgggaagggtttagtgatggtggtaaaaactgacttcttgatttccttccttgcctgccagcgaagtcatcttccagcaacttcttccattctgttggagcaatgatttgtctctcactatgccatcctttggtttgaacattgcatacccatcttaaggcagttgatccaccctgcttattgcctttttggcatattggatgccagctcttgagcagaaccaaacccctggaaaactgatcaccatctcaacatcttattaaactaattctcattttgctaaactagaaacgaatcatcaggctaacactgccagtgaagatgcaatgtaagacaaattataccaaaccaccaataggcatgtattcatctgcagcaccagccaactactctcaaaagaactgatacagaaaatgatgaaaaggaattaaatccaaaagtaaagagacgactgccaactacagataagattttccatgaaattgagtattattcggttcatctcactctgacttcattttattacagtttagacctgactagctaaaaaaagaaagaccatcgctttgacacacaatagaagtaaaaataaagctgacatgtcaccctttccttcattcctgttttcaatattcaatcttccccctttccctttcccatcacctactacactcacttccactgtaacatttctttctcctctcttagaaaagatccttagaggaaattaaaatgtggccagtccttactctttaacgtcaacgtttctctcagcatgcacttctctaacttgagctatcatttcactaaaataactcaactctttcttttctgaatcttccctagcgttgctgtatttcttacacccgcttggattcatgcccactcgctgctcaggatatattgtgtctatacttgagtaggcacaaaatgctttttcaaacaaaacgtatctgtcatatcagtactgtttcctccatatacgtcaaccaaattaaatagcttccctgaccttttgtctactttctttgccttctgagtatcctcatcatctaactcttggcctggtaaaacaggatatgtggaaaagtcataacttaccttcctcattattttctctatcaagccataaaaagtaataagggaaacctttactttgggcttaccttcactccaaaatgtagaattgtgtggttaggtttaaaaaatgacagaattcttgcaagaaaatgttaatctaatgttagaactcctagcagacaaggtagggacgctgaatgtaattattcagagactttgagaaaaaaaaagcgggggggagaaacaagcgggttttctatctgcaatgagcccagcactttatgaggtgcctgtctagattctttttttaccacgaaagttgggagaagctactatcaccctcatttcacaaacgaggcttctaaggctcaaagaggcttaagtggtgccagatattgaatccaggtttttctgatcctcatgttccaaagcaggacaagttaaatctgaaagcatcttaagaggaatgagctataaaataacattctgacaatacaatcatacacgatgcagactgcttatccatgaaggcccttcacaatctggcctctgcatcctttcctcacccttcctctcatcaccggccacaaatctccctttttccagccctacagaacaccatacaccattttctaaagtgctgtgctgatgaatgtactttccacaggctctttcattcgtgtgactgccctttctcttgcttcatctatctcctactccaaaacttagctcaagggttgcctccttcaggaagcttttcctcattctccagtctgatttaggttctcctcctccgtagcaaagtacatacccctaacaataccacttaccccactgaaccatcattgctgatttacttgtctgtttcttttactactagggttattcctagaaagaagaagctacattttatcctactttgtatctctttcatatagtacagtgactgacacatcataggtgctccagaccccaaatagaagaactgggacagaaatcaaagggtagtatatctgggatcaccaccctgggggagtgggctatctcatgaaccagtatttaagcagaggctagataataactttcaggagcattaagaactcttttttgttgttgtttggtttttttgaaacagagtttcattccgtctcccaggctggagtttggtggcatgatctcagctcacttcaacctccgcctcccaggttcaagcgattttcacgtctcagcctcccaagtagttgggattataggcgtgtgccaccatgtccagctaattttttgggttttgtttttgtttttttaaggagagatggagtttctcaaaaaacaaacaaacaaacaaacaaaaaacaaacaaacaaactctggccaggttggtctcaaactcctggccttaagtgattgacctgcctcagcctcccaaagggctgggattacaggcatgagccaccatgcccggccaagagctctttacactaagtgaggagcagtgttaggcaagccaagacatccatgcttgctctgttattctacggctcccgacagctccagatcaaagttttctgatgaagatgggccaacatctcagaagacaggatggcacaacagtaacacaactatcatagttagaaaacctgggttctggctctgacttggttgtgtgatttttggtagacagtcccaaaagtcttgggtgatttcatctcagtttccctatttataaaacaaagggtgaaaggtaagctagggggagctgaccaactagatggtctgttaaacgccttccagtgctaagagaattgccttattttcccattgctcactgtgttctcttgtgaccacctgaaggtctctgccagctcatcttataccagtgctgtcttccctgtttgatggctcatttctctaaataaagcataacattcacagaacaaaatgagtaaaatctctgtttttttagttcactggacaacatcacttttcttttttcatttttgagacagggtcttgctctgttgcccaggctgtagtatggtagtgccgtcacagctcactgtggcctggacctcccaggctcaagtgattttcctacctcagcctcctgagtagctgagactgcaggtgtgtgccaccatgcccggctaactttttccattttctgtagagacaaggtttcatcatgttgcccaagctgctctcaaactcgtgactcaaatgatccaccagcctcagcctcccaaagtgctgggattacaggtgtgagccacatgtgctcggccacatatctttttattttaaaatattaataaaacaaaattatgcaggtaaactctgagtccaaagggaaattggcattgacttacaaaatttaatcagatacttagaattcactgagttaacacgtgcatacttgaccttgcttgatgcaaagatctgtgatatgtaatcatttgctacttcactgaagatgtttgaatcctccttgttgtaaggttgactccacaggaaaagactgattcacatggctttgttatcattggctttctgttatgaaagcagacaatttaggtcaagggacaacaatctatttttctgcctgaaaatgaccccgacatgaaaaccaactgatagattggttcatttctattaccagcactaaagaatgggcatagggctgggcacagtggctcacacctgtaatcccagcacttagaaggccgaggccagcctgggtaacatgggaaaacccccatctctacgaaaaaaagacacaaaaattagtcaggtgtggtagtgtgtgcctatagtcccagctactgaggaggctgaggtgggaggatcacttgagcctgggaggtggaggttgcagtgagctgagaccatgccactgcactccagcctgggtgacagaaaccagactctgtctctaaataaataaataaataaataaatggcataaattagccttataaattactttaatcctgaatttatagaatcgttacacatctagaggaattacttaactttttcagatatactttgcatttttcacagagagaaaaataattacataggcattttcacatttggaagttcataactccctcgggacctattccacaggaaggccgaaggccaaaggtctcttgtatattatctagctccttaaaatggcaacatttaaaaaaaaatctaacctccttctcccccaaatcaattcagtttgttgaaattcttccatatgccttaaaactaccaagggaaggcagagtcagacaaggtttaaatgtttgtaggcatctgagaaagaattgaaaacaatcagagtagagatggtggtctactctgcattctcccttgggcgctaccacaaaggcacttctctgtacccatcagcagagccgcacatgctctctcttctcatagaaacagggtcaaccctcatttctaggaacataattttcaaccacaaagttcccttccattttttactttcctgacatcagtctgctaagtgaagatatctcggtaagaactccaattttaaggggaatgaatctttacagaatgtactttatcttgtcagcactttgaatctaaatttccttctcaccctttcaccctaaaatatcagcttgcatcaggcacaaaggaagatgcacagctgcaagtgctcaagatgactaaggaaggaaaagcagacaagtcactaattactctccaaactggaggcctaaatcatccttctcttctacctgttgtttctggaatagtttatgtcagtaatggaaaatttaaacactgtcatataattccattttttttccccactccagctcttaaaaacatcctagatgttaagatgtgtagcctaggacagtggttttcacacagtgctctaaggaacctttagagccagacacacagaggaggtatcaataggaggggtctgatgccccttcgacacatgttactataattaacatgtattttgagactgagaatgtaggctccatgaaagccgggattcctgtttcctcacagccatcacctcgtccttttaacagggcccagaatacagtaagctgccggataaaagttttttgactgaataaactgcacggttattacagctgggaactgatttcgctgatttccacggtaaccctgtgaggcacgtatagtagttatcctcactttgcagatgggcaaactgaggctcagagcagcctggcttccaagaccctccttctaaacatcataccacatgacacagcctcccacgtgagccagcagctgtatttcatctgttttacatgtgaggtttcccaccatttgactggagaaaggtcgatgttaggggagaaaaaaccatttaaaaaccaccaacttcatggtgaaatccaaaggctgcaagtaatcaatctcactccttgctctgtttttcctgccacccttgggacttgacgcaagtggcttaactgctcattgtttcaggttcctcatcttattttacaacctatcttgcaagatgagtatacatgaaatattagaggatcctgatgttgtcagaagtgtagttttgcggatgttgatcccagaattgtgaaacaaggacacggttgagatgatcgctaaactctgcctgaagttcaacgcctctgtcattgaagaccttgcacagtgccgtccacatggttattttattcctccatgtccttaccaactaaacaagccatatgattttaggtttcgtggccagacagcctggctaagctcctatcaacatgtcagccagatgaggtgaagagatggagaaacaaacctgcatgtgggttgcgtcgaacaataaagagaaaacagagaccaaaaatcttgtgccaaggtttgacctcaacaaccgcaaaaccaatcattgctgtgttgtttcactatgtttctagaaacatccatagaggagaaaccaaagtcggcctgaatacatgttaatagctttcacgggcttacttctgatattttaaacaggcaacaaaaaagaaaaaccaagtttcagatcttgccagaaattggggtttcacttaactgtaaaacagtcaaggggagtttatcaggtaagacacgaagcctttctttataagctcttataagactagagaccactggattgccgtgcagttactgccgctggcattattttcttagcacactaagaaaaataaaaatgttcaaagtcctgtttttaaaaacaggatgagacttctggcttctgatctggtatgtaagaagcttagaagtcaccattccatcctaacaacaagtaaaaagctaaacaaactaaaaaatcaaccattcttcttacacatttgagatgctagatatattagcttaatttaattattccacattgtattaaaaactcacaataccactttgcatcttataaatatacacaactataatttctcaatatacagtgttaaaaaaaaattcttagatctgccaaagaaataaggtcacagggcaagctgctgcccccaagactagagagacagaggggcgcatacagagcattgcaacttactacaacagaaacctccatggaaatcagtacccggtagaaacctcaattgtactcgacatactgctgggggtctagaatgaacaactcttcgagtttaaaactccagaggtgcccatcatggggagtagggagggataagcttttgtgagtttttttttttccaggagctctagcagggcctcgcagtgagtatcagagaaaaattcccttatgcttccagtggaaaaaggaggaaaaggaccattttgaaaaaacaccagagatcagcaccataggaaaaggaaaaaagaaaaagaaaaaaacaccagagaattatgttcttaacaaggttttgccctccagagaaactaaccagaccctaacttgctggggctttggcagagcctaacctacctggggaaggaaaatacccaactccagtccactctagtcatcctgtcccacaagaaaacaaacaaacaaactgagaagcactgagtgaagctcacagtccagggtcatgggctcactagaagactgagacccactcacaggactacaggagaacaattccattctgagttagtccactttgcatttgctataaagacgtaaccaatgctggctaattttcaaagaaaagagatttatttggctcacggctctgcaggccatacatgaagcagagtgtaggcgtctgcttctgatgagggcctcaggaagttcaccatcatggcagaaggcaaagaggggccagcatgtcacatggtgatggagggagcaagaaaagggaaggagagccagactcttaacaaccagctcttgtgtgaactaacagagcaagaacctgctcatcaccaaggggaaggcaccacgccatgcatgaggggtccacccccatgatccaaaacctcccaccaggccccacctccaacactgggggtcatatttcaacataagcttcggaggggacaaaacatccaaacagtatcactccccagtgatttaccaccacatcactaaagacccattcacaattctttttacccagtacatcatgacatccgtctttcagcaaaaacttaccagacatactaaaaggcaaaaaacacagtgtgaaaagattgaacaagcatcagaatcatagtcagatacagcagaaatattggaatcattcgacaagaaaatttttgaaaatgatgaataagctaaaggctttaatgaaaaaaggacatgaaagaacagataagtataagcagatgaaaattctaagaaagcaaaagtaatgctagagatcaaaatcattttaacagacttgaataatccttttgaccaacttattaggagactgaacacaactgaggaaaaatctcagcttgaggatacgacaacagaaacttctgaaatgaaaaagcaaagagaacaaagattgtaaaaaaaaaaaaagaatatccaagaactgtaggacaactatgaaagatgtaacatacatataatgggaatattagaaagagaataaagagggaaaggaacagaagaaataatattcaaaacaataatgactgagaaattccccaaattaatgtcaaacaccaaaccacagatccatgaagcttagagaacactaagcaggatgccaggaaaactacctctgggcatatcatatttacaactaagaaaatcaaagataaagaaaaaaaatatttaaaaaaataccccagagggaagaagaacatacttcagtggaggtaaaagaaaaacttttgttttcttattcttaattgatcaacacacaatatctttttcaaaataatagcaacaatgtactcaattacgtatgcatatatatgcttatgtataagtgaaatgaatgacagtgatgattccaaagatgggagggaagaattgggaatattttgttattataagatatttgcactactgataaagcagtttcatgttattcgaaaatggacttggattagtagtaagtgtatattgcaaactctacggcaaccattttaaaaagtaaaaagaagtataattaatatgctaataaaggagagaaaacagtatcatataaaatccagctttattcataatttccaaaacttggaagcaaccaagatgtccttcagtaggtgaacaggtaaactgtggtacatctagacaacagattattcatcactaaacagagattagtcatcaagccatcaaaggacatggtagaaccttaaatgcatattactaagtgtaagaagccaatctgaaacactttatacggtatgatttcaactgtatgacattatggaaaaggcgaaagtatgaagatagtaaaaagatcaatggtggccagagatgagaggggagggagagatgaacaggtggaacatgaaagattttgggggcagtgaaaaaagtctgtatgacgctctaacagtgaagacatgccattctacatttgtgcaaactcacaggatgcacaacaccaagggtgagccctaatgtcaactcgggagtctgggagataatgtgtcaatgtaggttcatcgactttagcaaatgtaccaatctggtttgggatgtttatgatgatgggagataggggtggggcagggaatggccaagggttatatgggaaacctctatgctcaattctgctgtgaacataaaacggttctcaaataaaaagtttattaattttttaaaggatttttacacaactaagccttgataaacatttaccttctttcttcttcatcataattatttttccgcattattttgctattttccttctctccttctctctctctctttcttttagagacagggtctcactctgttgcccagcctgaagtacagtggtgccatcacagccaactgtaacctcgaattcctaggctcaagcaattctcctacctcagcctccccactagaactacagacgcctgccactatgcctggctaatgtttcagtttcttcgtagagatgaggtctcattatgtttcccaggctggtcttgaactcctggcctcaagaactcctcccaccttggcctcacaaagggccgggattacaggcgcacatcacgatgccagacccaattttgctattttctagcataacatggtatgcacacattaaattaaatgtgaaaaacaaaggcaaaaagaaaaataaatcaacaaaagttctccaatcatgactaaaatcatggactatttccttctaatcttttctacaggctgatttttaaaaacattacttaattcatggagaatatcaaccagagtgctcaagatctggcccttgggaagacaggctttcagatcatctcgagtccttatttcctttctacccccaacctctgctgtgcctggtgctcagggcccctctccagaaaccgtcactctgaagatgagcaggcacattcaaggctgtagggagtacaggggaggatctgatgcagtctttcaaatactccttttcttttaaggtccccatatgaacctatcccccctcaggacctcacttcattaatttctgagcctttctgagcaggaaatatgcttgcttctcatcgatatccaccactgtaggcactcagatcccacctagctccccactgttaattcagtcatcagaactccaactgctttttgtcttcattattgatcaatgtgttataatgacttttgattccatcaaaagtagaatttgtttttccattcctcattctccttgccattctatggtgatggatgatttctgagagaagaaagaggtagaaatctctctattccatcacaattcttattcttacatggtattgtaataccatattatctttattaatctggctttataatatatttcactgtctggcaggaacatggtcatttcaaatttgactgaatgtttcaaaaaagtattttctatttgtctttaaagttatgggcaacttaccagataagttgaaaagaagttcaatatcctaaattcaaaatcctaaattttcacatgtagaccttcctatcaactcagacaatgccaggcacaaacctatgatcagtaactgctgagtgattgtgaacaagccatccaagaaaagtcaaatgcataggggcatttgtggaagtgtggagttgtctctgaaaagctgttgcactgtgaacttgtttcagcctgagaggcaagaaaggctggcctgtgattacttccggtgtctacctagtgtgaaatgtgttgagtcaatgaagcatctggaacagacttagttcaactggaaggttcatgactgggatgcttcctggagccctcagaccagagggcagacataacccaagaattgcttcttattaaaggaacagagacaaaaacctaaacagagggataacggcagagcattaaatgcagataattccatttgcgactaatttacccaaataaaatagcagaaagcagctttcagtggaataatttaaggcaacaggcaggagagtggcgtgaactattattttcatatttccattgcttacttgtcacttccagtgaatatttaacttttgagcatccactttgtggcttaaggatgttcctaacttccccaaactttgcatccttgaccagtacactacaatatttattcacaaccctgggaaatacctatgggaaagttactgttccctgaacgaaatacatgaaaatccagatttctctactcgctgacagtttatatagataatgctacttccccctcaatttatctctactctgtttcaatctacacactgctgtcagaacagcgttagaccacagatctgagcactttaatccccccctcaaaaatggcccccctctgctcaccagctccatgctgaggctctcacgtccttctcatgatataacccccatctactgagacactcagttctcctcaaatgaatctattctccattccctgactaagctgcagcgttctcacctcagtgcctttgcctaggctgtgtcttccatctgaaatgccctttaccagactactggaatgacaactctccttcaaggcccaagtgcctcctatattaaaacaataatggttagaactttccatttcaacaaaatgatgcagaattcaccttatattgaaaaaggcaggtagtgaaggaaattcagtgtacgagtaacaatgcacctcatgtaaaccactgtgaggtaaagaaaaggcaaggactttaaagccagatattcatggatttagctccctggtctggcatctttgaatcttgtgactcggggcaagttactcaagtcttctggaactgagttttctcctctatacaatggacacaatggtacctgtgttgcaagtgtggactgtagacacaaaccacgcgtttcccatattccatttaataattctgtgctgccctcgtctttcccgcgttgtaaatttcagccttctcaggtctgtgtctttctcctgtgccgttcatcagtggaggcttagttcccagtgctggtggaagatgcctccgtacactgttaaggaggcaatgctttctcttcctatcattgataatattctgcatcatagggctatgagacctccaggcttcagagattaccactgtgtcctgtggaggcaacctctaaaaagtatgtaattctgattttcttagttaataatgtgtcactctggtaacactatttaaatgggtctctattttctcaaaacgtaagtacttctgagttctctttgttaagccagaaggggaggcaaaagaaaataactttgctagctttcttatttaaattgagagcctgggatcaatgaaaatcaacacgggtttgctgtgagaatgaaccacaataattaatgactcttcagtggctagaacataaaagatagctagtgttagtgagaccatcagcaacaatacaactgcacaacttctactaacaataatgacatggacactgttctgccagaccttccagtccacaggcctttgaggccttagccaagacttttctctactggaggggtaaaaaccactaagcaaagcctcgcttgtctgagtcagctgagtctcatagccagggtatttgtctgaccctgttttcagtgctgaatttgccatcctgttgtaaatcagtcagcacaaactcagaaacatacccgttcatttacttaacagcacacaatccttcaaagggcaaagtggtttgaggaaatccaaactaaccaaggggggaaaggccaggaacacggattcctctgctgaagataaatggtagctatcaaatctgcacacaaatccctgaataaataccaacagcattccttcgtgttgttttgaaattcaaactacattaggaaaagagaaaggtgccttactttttgacataccactaagtcttcactccatcagaatgctattagcattagtggcagattttattacctctctaagtgtgtataaaaaccaagtgtctctaaaaagtattatttttgttgacatttatcataaagactattaaaacaacatataaaaatgtcaatgttgactttcttcagagaaatagaaagaactacttaaatttcatatggagcccaaaaagagcccatatagctaagacaatcctaagcaaaaagaacaaagctggaggcatcatgctacctgacttcaaactgtactacaaggctacagcagccaaaacagcatggtactggtaccaaaacagacgtatagacgaatggaacagaacagaggcctcaggaataataccacacatctacaaccatctgatctttgacaaacctgacaaaaacaagcaatggggaaagaattccctatttaataaatggtgttggaaaactggctagccacatgtagaaaggggaaactggatcccttccttacaccttatacaaaaattaattcaagatggattaaagacttcaatgttaggcctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaaagtatcagaggaaacaggcaacctacagaatgggagaaaaattttgccatctatccatatgacaaagggctaatatccagaatctacaaggaacttaaatttacaagaaaaaaaacaaccccatcagaaagtgagtgaaggatatgaacagacacttctcaaaagaagacacttatgtggccaaaaattatgaaaaaagctcatcatcactggtcagagaaaagcaaatcaaaaccacagtgagataccatctcacaccagttagaatggtgatcattaaaaagtagggaaacaacaggtgctggagaggatgtggaaaaataggaacacttttacactactggtgggagtgtaaattagttcaaccattgtggaagacagtgtggtgattcctcaaggatctagaactagaattaccatttgacccagtgatcccattactgggtatatacccaaaggcttataaatcattctactataaagacacatgcacacatatgtttattgcggcactattcacaatagcaaagacttgcaaccaatctaaatgtccattagtgatagactagatacagaaaatgtggcacatatacaccacagaatactatgcagccataaaaaaggataagttcgtgtcctttgcagggacatggatgaagctggaaaccatcattctcagtaaactaacataggaaaagaaaaccaaacaccacatgttctcactcttaagtgggagttgcacaatgagaacacgtggacacagggagtggaacatcacacaccaaggcctgtctggaggtggggctaggggagagatagcattagaagaaatacctaatgtagatgacgggttgatgggtgcagcaaaccaccatggcacgtgtatacctatgtaacaaagctgcactgttctgcacacatatcccagaacttaaagtataattaaaaaaaaaaatcaatgtgtcatttgagtagctcattgcacccaaactggctattgcacaatttcagtttatacaatctattaagagaacgcacacgctctcgtctggttagaacgcattcttcttcctgagggaaaacctgagcttaggttgttctctctgaaacatccccactaacggggatgtcccttgaaggccgcagggactctaccttttatctctaaatctctggagcctaccttggtgcctggtacatagcagtcactcaattcatggttggtgggtttatttttttaaaaatagcagctgtcatttaaccagatgctgctttgtgggaggccctttgcttacatgatcactaacacttaaaacaactctgtgaaggaggctaacaaatcctgccttacagttgaggaatctcagatttaggaagattaagaaacttgtccacagctacatacctggtcagtgagtaaaagattcaaactccaaagcccagctttgcagagtctgaagcaaacactacgctgtacagagtctagtcacctatagtcactgctgatcttgccatgtctcgggcaccactgatgcctcactataactgaaccaagtgggaagggggcactgatctgaatgtattctgacaacagaccatgccctaggatgtaagtccctggtacaagactgttttcattattcttactcctgtctcctaaaagcaggcaagaaaaccagtttttgatagattagaattgcactctattttcattcggataccaagtcctgagacaccttagctggctaggtaagtctggtggtgggagacctgctcctgaagccataagcaagttaacatatgtgaatttcctctgtaaactccacatggctctatgacaacaacacagtgttcaatggtatcacggtggtgaaaagagcacagatttttaaatcagatataacagaattagaatctgcacctcccccttacaacctcatcatctagggcaagttgagttaattaacctctcaaatttctaattcatcatctggaaagtgtacagaataatctgcacattgcaggatgtggtgaatattgctaggtgttcaccaacatctgttctcccttgctcccagggcacaggcctgaactacgtttcccagttcctcccccaacccctggaatcaggcacagctacgtgactaagttcgctccaactgagtggaagtgaaagagttgggaactgcttctggagctaagccttgagactgtgggctggccctgctgggctcctttttccacttcttgtgaaggcctgaggggcggtggagcaacaccatggaaagaatccgggccctgaataacagcatggagtggagtcacccacccacctggtacatacattacacaatcagtgaaaaagaaataaatgtctatctcctttgaagctactcaattatcattatgtccctttgttacgagaacctggccttacctttgccaacagtgtttttcccacctattataatgcctggcacaaattgggtactcaataaataaatgatgtcattgctgctgctgttaccactactgccacacctaccatgcaaagcagttcccttcttacacacattgaaggttccacggccacagacacaaactgctgcccttagctacagaaaggaaagttaatgaaatgaagatggctctggaggaaaacaaaatcaaaactttcaactctagaagaaatagcttaaagcacatgccctattgaaggacaaacacttagctaaaacagccatcatcattgttgcttttgttaggtattatgtttttgaggttatagcaggaaagcttatagacacagcacaagaaggaaatttaggaaggcatataatcggggtgtccatgttatacacagggtgttcacccaatctgcaaatgtttattaaactattcaccaaatatttgtgaaaccaacgaggtaccaggtatttgctaaatggaggtacagataatagcctcaccctcaactttcacaggagttttatcacaaaaaaaatcaaatgaaaataagtagcttattgtgtacatgtgacaagggaaaaaggagaggaacaaaacctacccatgttgtgaggctgcacgagagagcaaacataccaaagaatcttgctttattttctcagcgaaaagagttctagtgcacccatcagttgctcttgtaaccagacactgtccaaggagcatcagaccatcccaactcaagaacaaatgtcccagttagccatggctaaagaacacttcccttaataacgtcttttgatcggcacgaggaaatctacctatatgagtacttttttggggggttcagtgagtcactcacagacctatttctcaccaagtcattcggaaacgtaaatgtccagaaaaataaattttaaatatgataggacttcctggatgttaaattcaatttcagagtattttctcatatgagagtcattttgtaaaatagacttttgcattttaacaaaatcatcatcattaatacctatgcttataggtctaaacagtttcaatcaagtcacaaactaaatcaggctgcccttcctccagaccctgacttgctaacagatgccactatctgttcaggcaccctcctttcctcttcccacctctctcaaagccactcccactgtgagtatcctcactctgacacttgtgtactggaagatgatttttcaatgagaaaaaatctctctttaaatgacatttttcaaatttaatatgactaagttctgcccccaaacctactccttagatgggaagattcattcccatctgagagatgacagtatttatttttctctaatacatgagcagtattataaaaccttcccccatttctccccaatccatgtcatccagtctatcagagtcatgacaattctgaccccagaatgtatcttgaatctatttcatttttcccatctcctacatctcctatgccaacctcctaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcctagggaaagccatcgtctccggcccagggaaagccatcgtctctggcctagggaaagccatcgtctctagcctagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcctagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcctagggaaagccatcgtctccggcccagggaaagccatcgtctctggcctagggaaagccatcgtctctagcctagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcctagggaaagccatcgtctccggcccagggaaagccatcgtctccggcccagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcccagggaaagccatcgtctccggcccagggaaagccatcgtctccggcccagggaaagccatcatctctagcctagggaaagccatcgtctgtagcctagggaaagccatcgtctccggcccagggaaagccatcgtctccggcctagggaaagccatcgtctctagcctagggaaagccatcgtctctagcctagggaaagccatcgtctctagcctagggaaagccatcgtctccggcccagggaaagccatcgtctctagcccagggaaagccatcgtctccggcccagggaaagccatcgtctccggcccagggaaagccatcgtctccggcccagggaaagccatcgtctccggcccagggaaagccatcgtctctagcccagggaaagccatcgtctccggcccagggaaagccatcgtctctagcccagggaaagccatcgtctctagcccagggaaagccatcgtctctagcccagggaaagccatcgtctctagcccagggaaagccatcgtctctagcccagggaaagccatcgtctctagcccagggaaagccatcgtctctagcctagggaaagccatcgtctccggcccagggaaagccatcgtctccggcccagggaaagccatcgtctccggcccagggaaagccatcgtctctagcccagggaaagccatcgtctctagcctagggaaagccatcgtctccggcccagggaaagccatcgtctccagcccagggaaagccatcgtctccggcccagggaaagccatcgtctctagcccagggaaagccatcgtctccagcccagggaaagccatcgtctccggcccagggaaagccatcgtctctagcccagggaaagccatcgtctccagcccagggaaagccatcgtctccggcctagggaaagccatcgtctctagcccagggaaagccatcgtctctagcctagggaaagccatcgtctctagcctagggaaagccatcgtctctagcctagggaaagccatcgtctccggcccagggaaagccatcgtctctagcctagggaaagccatcgtctctagcctagggaaagccatcgtctctagcctagggaaagccatcgtctccggcccagggaaagccatcgtctctagcccagggaaagccatcgtctctagcccagggaaagccatcgtctccggcccagggaaagccatcgtctctagcctatgttattgtgacactcttaacctcatctcatgcttgaccccttgaatccattctctatatacttctctagacagaattagaatcatctttttacaaacatgaaggattcagtcacacccacatttcaaacatttcaatggttttctgctacttcagaagaaaattgaaacttcttcaaatggcctaacacggctccgcttgatccagcctctaccacacaacagccatccccactcttctagccttgctccctcatggcatggctttaaatgccaccattggaggaagtccatccttaatcacaaaaccgaaaggaggggccacgcacggtggctcacacctgtaatcccagcactttgggaggctgaggcaggcagatcacttgaggccacgagcttgagaccagcctgggcaacatggtgaaacctcgtctctactagaaatacaaaaattagccaggtgtggtggtgcatgcctgtaatcccagctactctggaggctgaggcaggagaattacatgaacccaggaggtggaggttgcagtgagccgagatcgtgccactgcattccagcctgggtgacggagtgagactgtctcagaaaacaaaaaacaaaaaaccccaaaacttaaaagattctcccttgcatgagaatcttatttgccctccacttaccaccatttataataattcctctttttgtttccttcctgccctgttattaacacctctgaaggttggccccatgcagggaacatactacttttatagtgcactcggctggcaagcagtctttcttactttctctgtgttgtgtctatgtatacacagcatatctgtgagggagatattaatattattcccattttacagataaagaagatgtgaagcatatggaggctaagcccctccctccatcaggccacagagccaggtgcaagcccagtctcaccccagcatcctggctcctgtcagctgtcgtttatcatcactatacaccagcacgcctggctctttgtaggagctgagtgaacatgggcagaaggaatcgtgaagtaaacgcttccaagtcggaacatccagagacatttggttcctctctaggtgctcttacccattcctagttctactatttatgctgggaggcatcttctgtcccttactaattgataagttcatctagggcaagaatcatgatttatccatcttcgtgcctctcatgatacccaacagtaggcgctcaaaaaacttttcctagtgtgtgcaggcatttaaaactcagtagaaattaaccacaattgcaatgaagtaaaattcaactaagagttcccacaaaaaataagtacaacagtcaccattccagtcatttatagagctgatctgaatccagaggtaagtttccagaattaaagagctgttttatagactgcgtctttctacttcacgagtgggtagaaatcatctttattagaaaaaaaataagtgcgggagggcggggggcagagagaactatttcaaaaggtttttccctgtttgtcctaaatcctccagagcaggcagttaaacgttgagtccagcgtttcggagcctggccagtctattacaggccttggtggtgaaaggcagagtggcctcatccaagctttgtctctcgtcagcaatgctacctgtgctggcctttccgccttacttcccaaactcctctcccatttctcatttctgctcccatttccccttgttccctccaacactacgaaggcaaattatggggctcaatactgagaagtcctttccaccttattgataatgaatttctttcctgggaaacacctgggaaagagaccaaaaattcaggacagtacagcctaatctgaggtatctgtccattcttggcaggtatgcattgctaaaagcatgtgactactaccgtatatcagagagcccttttatggaacgtggctctctgctccatgagtgggtggaaataatatttagtgaaaagaagagtctcggcatcttaatgaaagaaacctagataggagatgagtcatttaaaccctctctctgtcatcacacagaaatagcttgaagaaagaaggagtcaactcaaatgcccaaggagggcaatggcaacagagatttgggaatcttttccagggtaaaaacaactgggatgggctaggggtgaataaggaagttccatcctgtctaaaggtgtctgttatggggtgaattatgttccctccaataagattatgttgaagtcttaacccccagtaccctaaaatgtgaccttatttggaaataaagtcactgtagatagaatgagttaggaaaagatcacactagagagtaagtaggcccgaaattcaacatgactggcatcccagtaagaaggtggccatgagaagacagacacaaggagagttccacatgaagacgggggcagagactggggtgatgcaggtacaagcagggaacaccaaggacagcctgctgccaccaggagctacgggaaagaaacggaacagtctgcctcagaaggagctcaccctgcccacacgccctgatttcagacctttaccctcagaattgtgaaaaaaattttgttgttttaagctaccctgtttgtggtatgtcaccatggccgttttaagaatcgaatacagcatcccaattcagacttaaaaaacgcaagatgaccaaacccagccccggcagctagatggtctctaattccaatgctcactattcagtgggcagtcacatttctgtcaaaaacaaaaatgcagttacaaaacattttctggctaaacaatgcattctcctggatctcacacatcagaattatcttccagatcccaggggtgagaagcgcagcttctgcgtcagacaccagtctagtggacatcgcacgctagccctgccactcgccagctgtggggctttgggagctctgtgcctcagtctcctccacctataagtgggaatgatagtgaagtcggcctcacagatgaggatgcagggcacactgggaagcctgctgaattacaacgagggggagaactcagcaacccaagcggcatgatctctatcacaggctgcagcactggattttaccttactgtgcatgatttttcatttgctttactgtgaactcacctaggacggggtccaggccttggtcacttttgctctccttgcacatgtgtggcaggtagtcagacatgcctcgggaatgaaggcaggaatgtacttcatcgactccactcctgtgatgtgagatccctgagggcaggacccaagtcctacatcaaccctagagcccagcaccaggtaagaggccacacagagggcaacgaagtcattgtgttggaaggacgtctgtagatgtattgctcaactctgccaagctagcatgggagcaggaattaaatgcttcattccagtttcaaggtctgagtttgtctgtttcctttctgcttatcacacacatgacatgtagaacaaattagggtgatgcttcctcactgaggctttttgggaaacctattaaaccaaggtggaaaaaataattcaagaacatgacaaatgcagctgtcagtaactctgcaacaggcagcaaatgctgagaaatgcacttattctctatggctgccgacgttgactggaaagctgctttgcagtctgggaaacaaatccctactccagactgtatgatatggattctgtctcagtggattggcattgtctagactagcagtcaacaaactacagcccatggtacctcggccactgtttttgtaaatcaagttttgttggtactcgtccctgcctttccagttatgtattgcttatggctgcttttgagctacaaggcagagtaaagcagttctaagaaagacggtatagcccagaaagcctaaatcattcactatctgaccctttagagagaggtctgttgatccctaacttggagtatcccactgtgattacacttaaaattaagcttgaagaggacagaaaccttgtttatctgggtcagacctatctagacgatgacctacctgatttatagtaggtgctcaataagtctgcaaagaataaacatgaggccaaataaatattgaggttttaggacaggtagtgccaacagcacacagtgctaaggggatgcctgctgggctagaccagtgtcccgaagctctgccctttttgagaggatgaggatctgccactgctgggtgtcccttggttaactagctacctgagagccctctgggagccctgggctgcacagacaaccaggacatcttcattttaagaattcaatagcattgagctgtcaggacagattaaacctgactaagaagaacctttcagaatccttctatgtatatacatttacattagaaatgttttaaaggaataaacacttgcaaagcggtttaaatttaaaggttcccttatacaactgaacccaaaacagctgtcagaaaccaaacatttataaatacaaatgctcaaggtaccaagtgaaaaaaagatttttagatctaaaagaaaaagtccaatctatcctgccataacaaaagcaaagaaggaaacagaaaagccagactttctgagaatgatcctttaatgttaatactgaaagcatgtgtaagttctggctccaataaagttgtttatggttagagttaagtaagaaggggtcctttaacttgggaaacgattacatagaacttgttgcagaaagaaagaattccatactatttctctttttctattttgtcctctcaaagaactgttgcttccatgcatcaggtcttcaaaccaggcttgggcaggcgagtctcccagccctccctccagcctggctctgggtgcagacccacggtcatggggaccttgagcacgtggggtcttcttttaggagggtttgtggaactgtagctctttacatagcccagagacattctccctttaaagtttttgggtaatgctcaattccatctttaaagaggtgggagttttaatagcacagctgtaatagaatcacatttcgagtttttgagacaggatcttgttctgtcacccaggctggagtgcggtagcatgatcacagctcattgcagcctccaccttctgggcttaagtgatcctctggtctcagcctctggagtaactgggaccagcatgagccactgcagctggctaatagttttttgtagagatgaagtctcactatgttgcccaggctggtctcaaactcctgggttcaaacaagtgtcctacctgggcttcccaaagtgctgggattacagatgtcagtcactacatctgtcccacatttatatttaaatagaagtagcatcctatagtctcaatttctgatcaaatgtgaaacaatcaaaatgtcagtctgagagttgatctaatataatagtaaaggctcacttataggctaaatacttccatcaaataaatcttaaagtaacattttctaattcaggttttgttttgttttttactaatccccttctaaacccacttaatttgtatttaattcatattcccaataataaaatcaaggaactacggaaacattgcatattccactaaactgtgtttacaatattaacaaaatctatttactccatagaataagcaaaaactcagacaagaattgactcactgggttcgctttgaggactgttatattccatttagaggtaggatttccttatttctttcgtagccacacctttggagatgtggccaagcattctttacacgaaacaagaaacacttgcaaagcggttcaaattcaaaggttcccttatacagttgaatccaagactgctgtcagaaaccaaacatttatcaacgcaaatgctcaaggtactgagtggaaaaaaggttcttagatctaaaaagtccaatctacccttccatagcaaggagctggggctctgcatgatggtagatgacttccaacgtgatctttccccccatgctaccagctgagaagacctcatactgaaggtcttcacagagacaagatgcctcatctccctggccttattttgtggcagctttcgggacattgttttcagttataacttttcagactctttcaccccatgggggttgtgttcccatattagaattaatataaatgcattttcatcaaaaggaaagaaaatagaaaaagaaaattaatgactagttacagcaaattcattatttcccctaaaaactaaacacatcaaaatgctgcttctttatccaaattcttcaccatattgaaatcatgaaatgaaacgacaaccagctttcatgaccagctaagaaacgcatttgatgagatcaaaagtccagcacgtggccccctgggacccacgaccagatgcccatggcagatttttaaattgtttgacttttcttcttaaaaatctacgtcctgttttgctgttgttcatttcaaacctcctgtgtgggagtgttaataaaatctaacatctgtaaatttctcatattggtttgatgaatccttgctcaaacattctcctttattctggctctaaatgatgtgatctcagccatctcctgaaagtatccaaagattaagacaaagatttaaaagccccattgaaaccacaaacaaaaagcccctgaacacctcaagactgagtctcccaacacaggctatgatggaatcgtttcggtttcaaggaatcagtagcaagaagaacagtcagctcctgctgagaaagggccaggaggaagagtgtaatgagggagagaataaaggtatgcttcagcttaaaactaatcatattataggtcaattagaatgcaacatttccaaaaccttaaatgtgtatttcatttgagtaaactcaatcaagtctactctttttttttttttttttttaaatggagtttcgctcttgttgcccaggctggagtgcaatggcgcggtctcggctcactgcaacctctgccttctgggttcaagcgattctcctgcctcagccacccaagtagctgggattacaggcgcctgccaccacgcccgggtaatttttgcatttttagaaacagggtttcaccatgtcacccaggctggtttcaaactcctgacctcaggtgatccgtcccgccttggcctgcccatgtgctgggattacaggcataagctactgacccagcccaaccctactctcatctcaggattcaatggacaaaactgcttcctagttcaaaaagaaaaagtatgtcatcaggaacaaagcccatcaacttcacaaccatgcagcacaaatctatttgtgcctgcgcccgcagaagcacctcccctcctgtgcaagggcatgtgcactcacctgggccctggatcccactgttcctcttcatctaggacaggagctctccagcttgagtgtgcgtgagaatcacccagaaggctcattgaaacacaggctgctgagctccaaacccagagtttctaattgagtaatctgaagtaaggactggtaatttactttgctaacaatttccaggtgatgttttatgatcccagagcagactctgagaacaactaatctaagacctgctacactgattatcctctcatcctacatttttgagtctctcctttcatattgcttctttccctaagcatataaacatgttcaaatttgtcatcttaaaacataaacaaaagtctccctgacctccctgggaatgtagtgtatttctctttccttctgtacacatgtaggttcttaagagaatgttctccatacaccacttccatccgacttctccttgctctgtaatctatttgccctctcaactctgctgaatgtgcacatctcacgaccccacatgaacttaacagtttccaggccaatggatacttcttaagtccctgtttgactctctgccttacctaccatcgctcacctgaccacacagcattccctcctcccttggattttataacctctccctatcctggatctcctaccacctccttcactgcctcccttttggtctcccgtcctggaatatctgcttttcaccatccctataagtgctggggatcccttgggacctgtccttggctctcgtcttctgatgccatacattttgcctgagagttctcatccatgcctgtctttcacctataatctatatcctaatggctctcaaatctagacttctcttctaaacttcaactacatagaatgatcatcaattagacaattatatttgtccaataggcatctcaaagttatcaatacttaaaagtgaacccattaatttctaccttgttcctgttccccttcctttattttttacctaacaaaatggctcctccaactgctcactcatgcaaaccacctttatgtccttaaggaaaaacatgtccttacgtctcaagcacaatcacagttcagaggtgggtccaatccacctcttaactgtctcaaatctgctcccttattcccgtctccaagactgttgctccaacttcggtcaacatcataatacttggttcttccctttcttaactgcatttctagtcacctccttctcatattttaagctccaataacaccaaaaactagttaatgatatctttgaatgtggcatgctctcttacaatggaaaacttctatatattttattccctctgcttggaaaattattaaaatccctgcaccaacatgttctttccaaaaccttcccaaatgttcttgactttggactcctttctggctctcattccacttgaaacctgcctccattacagcaattacctgtttccaagcctaacactgcgccattcaaaggtaaatccttgaattcctagtgctgataatacctggctcaaaataggagccctactaaaaagtacttttatacaacatacatcagtgattctgaacaaggaaacacactcccctggcagtagagtaagcgagtctaccaaacattttaggatcgtttttagcgtttaattctcctcctacagaattttagataactaacatcacatttatttcatctcaactttaacatgtttcatctcttgtttacttcatttcttcaaggaactgagagaggacccactgaaattcagtttggggatgttaggaacctgttggaagattttctggagaagttttctcattacaacagtgtttcctttctagtcattagaagaatgaagggagctgagggaagcagatacttgagagttttacattttctgtacctcagtttgttctctaccatttcagtaaaagacagctactcccaaatacatttttgctgtatgcaactgtgctgttattcctgtagctggtccaagttttatagattactcacacagccccctagtgagcccagctgcttttatactattatgatgccataaacaaaattacataacattttaaggccagtaataaatgcctgaactagctgactggaacatgtagcatttgggcattttcatggtcttcagtgacggttttactgccctgaaaagccctccctgtacgttatcaaagaacaggaagtctccatgtctccactctcggttgttccagcctaaaggtgacccacccacgcccacatgcaaggctggcaagaacgggtcatcgtcaaagagaatatgctaagtgcattgaaacaggctgtgtacaaccttcatcaagcttcaagtagttaaaatcgtgccttacaagtatttttaaagaaaactggtataggtggatacagcaaataaacatgtatttgaaaatccagagacaaatataagtaaaacttgatgaacatatttgcattttatgtaaatgtcaatgtacatgttgtggaacaacttggctctctgctggagagcatacctccttttaaatgagtcaccacttgcggatgaataggaaaacgctgacagatccatgcgagataaaacggatcacagcagtcttggaatcaacacacttttatgatgaaaccaactcatattcatgcctccaaacacagcttaggcttgaaaccaagttgcagaacgtccaaaaattcttgaagaatccagatgttcccataatcagccactgatcaatttcccaggagaaaaggacttaaacaaggatgggaaattccaagacgtttaatacccagaggatatctgcacccagagaaatgtcacactcagaccacaggaagctatagctctgctgttgactgatgtagtcaggtgtctagaattttatgccagcctctacccactacacaccattactgttttgagataaattagcaaacaccaaaaattagaggtaaaaaagatctagaaaaaaaacaattgaaacgaactaaagaagccagagccagggaggtttaacaatcattagtaacaggtgatatccactgaaacttttccatgttcttccagcttcacgctaagaacttcacgttttcttaacttattcctcacaacgatttttaatttaaattgattattcccactttataaatatgaaaactaagacttagcaatattaagagatttacccaaggcacacgacttatcaacagtggagacggaatctgaactcagtctttctgattccaaagtcccggcacttaagcaccacactggagcctgaagcaaaggctcatgggtgaccccagtcttaaacatctgagggtttgtaacatggaagacagaacagcttcgttgtattctaaagcaggagtcctccaaacctgtttgtactggagaatcatctctgaaacttaaaaagaaaaaagaaaatccagtttctacggtcccactcacagactctgcttcagctgatctggcatggaggccagaaaactgtatttttataatgctctgctgggtttgagaatcaccgctccatacctcagaactagaataaacgcagaggaatcactaggaggcaggtttggctttacgttattaaacagacaaaccaaaccaaacacacacacacacacacacacacacacacacaccgccacccacaaaccagtcctaaccacagggctacacaagcctcccctgcccagtcctaaccaacagagcttcccaaatggagctgtagctgcctgctcaagcgccacgatataatggagacaacccagtctctggaaacagaggctgccatttccagttctgattcagccattctcaggtgtgtagctctggtcaagttattttctctgagtctcagtttgctcaactggaaattattggagaacacttacctcaaagaattgttaagaattagagacaattaggtaaaattcaaagaaccgtggctgatgtggctgatggtgctcataagcaaacggcacctgcccacttgaaatgtaaccatcttcttctgtagcttctgtagcgagcctctgcatgtggacagcgtgggccgcctctgcagcacccttccccttattcccaccattgtcccacccactgacatggccacgtcctattggcttcaagcccagattttagcaatgggctctgactggcctaatccaatcagcccacacctggcccccttgccacagccataggcagggaccagagcccaggccaatcagcagatggtgttcctctggcagagaacggtttgggaggaggctgagcatgtgtccaaaattgggccaatcagagtgaactcaaaggctttttttgtcagtaggaggaaagggagtatctcctcttccagaatgtatgacacatcagcctgagagctgacgctcagcagccattctgctaccaagagcctttatcaaactatgtctgaagcctgggctatctccatatttttgagatctgtgaaccaataaattccccgtatcatattatttaagccttgaggttgtttttctatggccaaggctgaacacattgtaacttatccagaatcccctggctgggagtggtgagatgtaaccacttagatcatttctaacttcatgattccatgacttcttagactttatccaattaatacctgtcttcacatttataacacttctgacgactggtttctgcagcctggaacatcctgtccccctttctcttcttaagaaatcctgctcaccttttaggacccaactgaaatgggtccactgctgcaagatctttgaagaggagtcagttaatccatcttcctgtgcactcccccagtacttgaccatttcctctcttatccttaatttcattgtgtacttttctcactcctatcttcacctatgtttaggctgtgtgcactttgaagacaacacccccttccctaggcattacttgttaacaggccaactgtgcagcaaagtagcacaaatccagcttgctgcacatgtccaatgcctaagatgaggctgggcctgcagcaggcttgcaagaaacaaccactcattcattcaatgccacatgagtggttaactggatacaaaggagaagcaaacacaacgaaggcttctgccttaaccttctaggtgtcctaccttgtaccttgaagggattagagagaaaaacattctccatcttgcactgctgatttccaatgacaagtggggcttcccccctcccacagaggattacaggccaacttgggtatggtagggttttggggactggaggtggtttagagttttttccaatcttattaaacttactcagagcttaacatctattaatgaaattatgttttctataataaaagtagagactcaaatcctatagatgccctgaccttaagatataaaaattcaattttaaaaaatattacacataccaaatacaaaagatctattctgtgacctcttctctaacaccaacaactgtaaatttaatatcatcctgtgttacctgaggtagttggaaggtgtttcttctacgtttgttgtatctagctttttcttttcagattttattatttatttatttttgagacagggcctcagtctgtggctcccaagctggagtgcagtggtgtgatcatggctcactgcaaccttgacttcctgggctaaagtgatcctcccgcctcatcgtcctgagtagctgggaccacagggatgtagctgggactacaggcctgcaccaccacacctggacaattttttattttttgtaaagacagggtctcactatgttgcccaggttagtctcaaactcctgggctcaagcaatcctcccgcctgggcatcccaaagtgctgggattataggcatgagccaccatgcctggccagctttttctttaagtgagaaaaatggtgagagagaactgtctcctactcctacttccttttggtcacacagctatctcgaccttgaataaaatttctggatctgacatggtttcagtggctgcaatgagaaaggaagtatacagcacaaactaggagtagatttgttattcatactccaacacctgattaccttctcaaaaaccagggtatttcctgcaacccagattcctcattgacaggaatcatcttggtctgaaggaagggatcaggagccaagaaataagagtggcctctagaagctggaaaaggcaaggaagcagattctccctagagtgtccagaaggagccggccctgccaacaatcttgaattttagtccagtgggactcatgtcggactttggacctacagagctgtaagataacacgtgtgtggtttttaaagccattgatttgtggtaatttgttatgacagaaacagaaagtgagtgcactgacttccctgtaccagtgaccactaactggcatctacactagtccctttccaaacagtagtgctgtttaaaaaaattgttatgtttatcaacatgaagcatcataagaagtcacaatcgtaagttgaagtcaattagaaaaaagaaaattctaacaattaccaaagatccaaacaagaaaaattcagtatcaaacattcctcttatattcacaaaagagacctgaatacacacatgctttaactaaaatgatttctttcctatatgtggaaaaaatgcacttattcattaattcaacacataatttacagagcctctcccacctgccaggcactgtgaagaatcctgagggtttcctgccatctatctgagccagggcaggtgtggaaaaaaattttcacattagttcattaatggtaaaataggaaaaaggaatagagccacagcttaaaagttatgtcgttatagacagagataccagcagagaactaagccacgtgcatttgttatctgtttctgagcagcttaaagcaaccagctaagtgacttcacacagttctgagggtcaggaatccaggagtgtcttagctgccatggttccgcctcagggtgtttcaggaggttgcagtcaaactgtcagccagagccacagtcaactcaaagatggacaaaggctggggcatctaagctcactcctgtggttgctggggaacctcagtcactccccggctgtttgccaggggcttgggttacttgccaggagggcttccccttagagctgctacaagaaggcaggtggcttcttcccaagtgacccgagagagagattctgaccaaaacagaagccaatgtgttttacaactgaaccccagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggtcacacacaccaactgtgatgcagtgtgggaggggagtgcccaagggtgtgaacctcgggatgcaggaatcattgggatcaggttgaagcctgactaccacaccatgttcttccaaaacatttcaacaaaggagccatgtagtaaaatcagcatggttctagaatggcagtcatggggcctggagtagccatggatcggccacttctagaatggcggtcatggggcctggagtggtcatggatcggccacttctagaatggcggtcatggggcctggagtggtcatggatcgcccacttctagaatggcggtcatggggcctggagtggtcatggatcggccacttctagaatggcggtcatggggcctggagtggtcatggatcgcccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcagctactctacaatctatcaaggcctcggtttccaaagccgcaaaatgacaatggagtcccatctattaataaaactttgggaggtagaagggctgctgcttctgcactcaacgtttactgggtgttcatcatgttccagatactgtttgaagcgttacacccttattaactcactttcttctcatcataaccctctgaggtggttacaatgttcactgctgtgtaagagctgagaagactgaagcaaagagagttcatccatttgccaaagcctcaccattagtaagaggtagtcaggattcgaacctaagtggtttggcatctaagtccacattataacccactgtactctctaacagagggtatggaaatgatgcaagtcagtacactataaaatcatcagcaatactaaactttaaaagaagaaaccacgtttaaaaaattggttaaaaaataggagccaagcatggtggtgctcacctataatcgcagctactagagaggctgaggtgggaggatcacttgagcccacgagttcaagaccaggctaggcaacatagcaagacgttgtctcaaaaaaaaaaaagatagatagatagatagatagatagatagatagatagatagatagatagatagacagacagacagacagacagacagacagacagatatagattccatttacatgagggacctagagtggtcaaacttataaagacagagggatggatgccagggctgggggaatagggaatggggagttaaaatttaatgggcattgaattttagtttgagatattgaaaaagttcgggggatggatggtggtgatggtttcacaacagtgggaatgtatttaatgtcactgaactatacacttaaatgatttaaatggtcatttttatgttatgtatatcttaccaccataaaaagaagacattaaactacaatatccaatattccatccaggggcttcctcaaaatggaaaatccccatggttaatcgctttagatgcatagaaaatcgttccgttctaaggtgtaggaagaaatccaaaaggacttgtcttttctggttggtccatcatcgctctctcaacttcttttcattgcacttttcattacagaaataaaataaaatgtcggaagagtttctgttactcttatctttcccaagtcacattaagtaggaatttttaatttaagtgcattccatttctaaagccaggaaaatctgcccacacgaggtgcttcatagcatacacattaggaactcctctatggttctcattatttacacccttcctcggatgtgccctgtgtgttttgagagtcagagattggcccgacaaaatgaaagcgaaggcgtcagctgagagggacgcggggctttaggtaaaggacacacgatgagaggccctggccatcgggttactgttgtccacgtgtcggatggctagagacgctgtgagagttactctctctagaggtcagcactttggatgccctcaccctctgaaataagcattttctcccgggacatcaaggagctggggactccaagcattttcctcaccactctggtcatctcccacatttaggaggaaagttctacttccatgaggcctttgcttgcctcatttcagaaataggggagggccttctcataaaatgactttttatgccttagttaagagcatatgtttaatttaccactcacttccctctcattatccatctatgtgcggatcacagtactaggtggtatgaagtgagactgagaaagtaagagatgaagaaacttaaaaaaaaaaagctgtaaaaaggacacaggtaaaatctaaccttcggctgggcgcagtggctcacgcctgtaattccagcactttgggaggccgaggtgggtggatcacaaggtcaagagattgagaccatcctggccaacatggtgaaaccctgtctctactaaaaatataaaaattagctgagggtggtggcatgcgcctgtagtccaagctacccgggaggtggagcttgcagtgagccgagattgcgccactgcactccagcctggtgacagagcaagactccgtctcaaaaaaaagaaaaagaaaatctaaccttcgaagaaatggaatgattaagacacatgaataaataaaacaccacttacctagaagtttctaatgtccagtaaacaaattgtcatgcttgttaaagttacatatcacaggtggcttcataagcctcaggacaacctgagaagcagccctgtgctacacggaagtcatgggactagagtagaaacaactaggtccaaaccctgaattccgcattaattcatttgttgattacgacgtccacccatatgacaagtatttagcctaagtctgtttatacacctgagaaatggagaacagtaacaaatgcctgagggtgctataaggattaaacaggtaatttatgccaacgtgtttggtaaatatttacagatgatacaattatgaactgtagggctggatgatatttcaagatatcaatttgtgctcttctctttgcattgcctttctttttctcccacagatcagactctgctcagtgcctcaggggaggcatgtggcagtagagaaagcagaaaccatctgcaaaatctgggatgcagtagggggtgggggagagactaatgcagcctgcagggctgacggagcaggggcctaggccccagttctaagcagggctgccacccagaagcacaacttccccaggagggggatttggatagacagagacacatgcaactcctgagtcctatgtgtggcaaggatgcatcagagagccaatagacatgcacagggggcaggccaagagagccatgcccctaacagcttggtcctggggatgagcccagaaccctgagaagggagatgaagttttccaccacaccagtggaaagacaatcagccagaaattgggcagatgtatagaaaaaaaaatgaaatgttatttttggcacattagagtttggggactgagttttatacccattataatatttaacttcccaacacctaaaatcctcctggcagttaacaacgaatgcccaatggaagaaatgtttcttgtttaatttcataaatacatatagagaagccatcttctctgactaaaaagaccacagattgtgctgctctaatgaaaagagcattggcagggcataaattctgaaacgattttctatatgttgctagccacatagaggatgctaaataaaaagctgttggctgatgggtgacaaattgtccagggcagctcataacttccctagactcttgagatcaatggcacacacctgccaaccagtgggctgggattaggggtataatgtgttgtgatgaatggaccttttctccatgcaatgctaatgggtttatatagaatagaattcatgatacaggtgttattttaaacactgtgctctaaccccttgaaaactgaacaaatagacacatactcattaggccaggaccacatctatcaagttacctaatgcattcccagagcctagaagactactaggcacagagtaaaaattcagtaactatctggtgaatgttaactcacagaagacacaatactgcctctaacttcacctatgaaatgcaaagtagaggcgtaactccaacaaataaagccaagcccagtatttaaaagcccaaaacaaatgaagtgcaacaacagaacaagagctggctagctttccagtgtccccatccaaactagggacacctacagaaacacagaaagttcaaagcctatgggaggggaacgtgggggagggagagggacttatttaccagccccagctttacacttcctccatctcctcctcttctttagcaagatgcctctgtgctttccatgaagaagtcggccccagaacatgacctgcatctcagagaagttctgatttatgaattggcactgaggcgacgtcgctggtgcggaacaccatgacgtctgtgtctagggtatgcgcatatgctgcgtttttccgcaggtgcctcgcagtctgctctggctcttagggcttccgaactcagttcagggcatggattttaattaacgaaatgaaacactggccctacacgacgggacacttaatgaatttatttaatgatgccaaatatggggaacccctttagggagagaagcaaaaggaacaggagaaaaagatcaatttgttaaaagacagtcaaagcaactgagtgttactctcagacaggggggatgtcaactggggagtgatccccagaaaatcaacttcattgtgaaatcagaagtacgagcatctttctttcaactggaattcattgagcatctactgagctgctatttcagcacgcttgctgctgggagacacagaagacatccttcctcctcaacatgcttctgatagacattattaagaaaaactatttttttggctagcaatgcagtttcacctcacatgatttcacttccttggagccgtgaatcagcagtggcagggattatctcccctgaggaaaaccaagatgtgggctggctggctggggtagggtggtgagaggcagtgctgtgcaggaaaggactttctccaggccagcaggctatgcagttacacagaggagcaagccctgcacccaccatcgtgattcccaacccttccccagacctcagcacctccaccaccaccagggaaacaagacacagtcacggcagcggacagcactttaggacaaagggggaaggacaaaggcaggatgtgaggatggtcagggagtgatcagaactgctgggagaaagatcagccattgctaagtgtgtcttcaagccctacacttccctggagagatcacagctttctctggcagatgctcagacaagaggtcacggataggcactgttctggcaattgccagacaaaccaacctctttctgatcccactgagaggctggacaataacacagtctgtagacaaggaaattcaaagcatggcattcctccagggaaaacgctgtgctggaccaggaccagggcctgccaacacctgtgagcagacagattccaaaatgtacagtcacaggctggctcctctgaggcttggctcacagtgcttcatcaaaagaaataaagataaggaagtatcttcctgctatcagcccctgcttcggtggcaccccactcatctcttacccacccttggggagggaatggagatctttaaccctgggtaaagagtacaatgaaacttcattttctgagctcccagaggttttggaacgtgatagctcctacagagacatgattcttgctgaataaataattctaagtcagtgacctgactagggactcatgtctgaagcaccgtttgattcttcaattttcaatttttcctccttttatttactagccaatatttccatgtgacaaccacatgcccatcccattaggagggctattacaaaagaaatgaaaagtaaatattggtgaggatgtagagaaactggaatcctcgtgcattgctggtggggatgcaaactcctgcagctgctgtggaaagcagtctggatgctcctgaaaaagttaaactaccaaacgatctagcaattctgcttctcggtatatgcccaaagcaaacgaaagcagcgactcaacagatacttgcccaccaatgttcatcgaacattattcaatttccaaaaagtggaaacatcccaagggtccgtcatcagatgaacagaaaaaatgtggtgtagacagaaaataatattttgccgtaaaaaggaaaggaattctaataatgctacggcacagacaaaccttgaagagattatgttaagtggaagaagccagacacaaaaggacaaatactgtgtgattccacttacgagaggttctgagagtagtcaaactcacagagacgcaaaacagattggtggtgtccagggttgaggtgaaaggggagtggatgattgtcgcttcacggggtaggaatttctctgaggtaaggaaaaacttagaaatagatatggtgcacaagactgtggatgtaattaatatcactgaattatacactcagagatcattcaaatcacaaactttatgttagatatattttaccaccaaaaaaaacccacaaaaacaaccaaacatgaaaccaaactataaagaagaaaacaaggtggaaataaaaaaaaaataagagcttaagaaataaaaggggaagattgcaaaaagcacacagaataataacattagcaatgctgccatattaactgcatgtagatagtatttactctgtgccaggaattgttctgggtgctatccatataacaacttgtataaccttcatgggaaccccttgatgtaggtttttattattatcctcattttaaagttaataattctgaaaaccagcaaggttaagtatcttgcccaagatcacagagcaagacatggcaaaacctagatttaaacccagaaactcttgacctggaatctatgtttttaaacaactaagctggttgccagtataaaagacctaagagtgagtcaaaaaaagaaaaaaagaaagaaagaaaaaggatttaaggatagggatgtataaacaattatatactacctaaagcaagagagagagaaagagagataaagactaatgaaaccaacatactgcattcttatttcaaaagtcaaatattaattgttccataaatagtacaggatactactgatcttttaggctcacccaagtctctcccagaaaacaaacaataaagcagaaagagcacggaactcgaggttataaaatctgctttaaaatcctggctcaatgacttactttgcttacttcttcatttagcgagtatgtaatgagtacctgctaggcaccagggaacatgctggctagttcactcaacgttttgaatcctagttcctcttttataaaattggaataatatacctacttcacagggttaagaaagctaaatgagataggctatgactgttcttgactcctagtttacactcagtaatggttgactgaagatgttttctcttgcctagtttctcagaataaaaattcgtgatgatgataagatatataaatcatgcggcttgggttttcaatggaggcattgtgactgccaggctgtagacaaatctacacagctactcggctccttgtgccccaccctctttcttacccttaagctggcaagatgatgacacatggcagggcaccgataagtgtcggtttttttctgttcttcccagaaggggtgggaagagacaacagaaaggagaaaggaaaaggagacaggagaaaaaaggaacatggaagaaaaaaaaacagaatgtgaagatggagataggatattacttccttcccttctctcccactggggtagaaagggctgtggtctgcagggggcgtccaccttccatttctctctagaatgtcccatagcatcaaccatgcccctaaaccaaaaatgacacaaaccttctccagactctaaaaagcccctttggaccacacaggacttctctctgtttccccctcccctggacaccaccatacacacagttcaatgatgaccttttattttgcatcatggccaaaacagttattaaggagtttcatttccagggcgctcactaatcaagataacagagactaaaatacaaggcctacaagccttacactcatcactggtgattcgctgagttcaccttgtcaagtaaactgtaagatgctggaagacagagaacgtatctaacagaacatatctatcagtgagtatttgctaaagccacatcttgacttatgacatatggagtgtttggaaacagaagatcacatttctacattccacatagatcgaaagtctagctaacttagagactgctttattttgtccgagtaaggttttccttaatttctaaagttctgtgatggtaagaagaagcccaccaattatcagcccatttacaccacttcactcaagtcttacgaaatgaggccgctgtcctgcgcccccgacgaggagggaaacgagactgatgcaaatgatactctaaggccaacagacagaaccatatttaggatcctatcgggctagctccaaacgctgccttcccacctattcacctgaagttccttgtaatttgttagtgtgaattaaatgacatctcggaaagtgttgcttctgactagtgagaaagttttatgtcaagagaagatgaattgctccaaggagaaaaatatgccaggcaagtccaaacacgtctgcctacctacaagtatgattcccacaagcacgtcctcctcttgccaacccatcttcaaccttatagggtgcagatgtttttgaaagtttctccttgctccaggtactatggaagagacagtgtctggcttcatcctggaaaccatggggtatgtggcatccatcatgttttggagatgggccgtttttacattagccacccttgccaaaatctaagaagcatggctgtttctcatcatgtggtcgctggctctgcgagctgtggtttgaagacggaaacaataataatcctatacataaatgactaacattttatggggaagacagaaaatagtttaaatgttttccatgatcctctttttgaactacaaatgatagtcaaacaggggtcattgccctggctgataattttcagaattgcagaccctacagtaaataacattcacagatggttcctttctttgaatatcaatgctctgccttttgggagctggcagctactcagagaagagcattaaactggccagaaagagacctgggatcctctggatctctttcctttgttcagaacaagagattttgacagattctccggccgccagtcttccagctctggtttccagctctggttctgggcgatccccaagagatcacagatactttgtatactttccacatccaccactgtaattgcagagtccctatcttccttacgattctgtttactagaaccaaacccatcatttttgagacattgccaaattcactgcaggaacaagtcataagtccactgagaagcgcatgccagttgtgaggagactccggtctgacgggcaagatgaccacctcctttttattttattatttttttaaatggagtctcgctccgtcacccaggctggagtgctgtggcgcgatctcggctcactgcaagctccgcctcccgggttcacgccattctcctgcctcagcctcccgagtagctgggactgcaggctcccgccaccacgcccggctaattttttgtatttttagtagagacggggtttcaccgtgttagccaggatggtctcgatctcctgacctcgtgatccacccgcctcggcctcccaaagtgctgggattacaggcgcccgccaccacgcccggctaattttttgtatttttagtagagacggggtttcaccatgttagccaggatggtctcgatctcctgacctcgtgatccgaccgcctcggcctcccaaagtgctgggattacaggcgcccgccaccacgcccggctaattttttgtatttttagtagagacggggtttcaccatgttagccaggatggtctcgatctcctgacctcgtgatccgaccgcctcagcctcccaaagtgctgggatgacaggcgcccgccaccacgcccggcccattattatttctttagagacggggtcctgctctgtcacccagcctagagtgcagtggtgcaatcatcgctcaccgcagcctcgacctcctgggctccagtgatccttccacctccctctcccaaagtgctgggatcacaggcctgagcctccgcgcccggccacctcctcttacagtagttcccaacccattcttcggcctcactgcatggctcacacggaaacatctcagtttaccaccgcacgatgtaagtgcgttctacactcaccaaagagaaaagaagtctgaaggataaggcagagaagagaaaggttgtaggtaggaggattggtgagcagggaagagatatgatggaagaggcggagggaaagacggtaaaggggcgaagaaatgccaagtgaagatgtgtaggcacacagaagaaccgaacccagaaccagaaaggggaaaaactctattgttctgtggggctccaattcacaggtcattaggctttggaggatccccacagaaggttgtcatctgcttctcaaacctctggcaggggcatcaggtgtagctatgctaccacagcgccatctggtggagcggtgggacttatcatgacctaatcaaactcttttaggactaattccgtcttgcaacaattccaggcaataaatacaggtgacaggatatattattgaggaatatggacagctgaagttcacacattgttacgtcctatggattatctcctctcagaacaattgtagagtaactttacaatccacatactgaaagattccctccccattcctttttatctcttcccaccccattttgaacggctcagctatcaacaaaattttcaataagaaatacattgcctttagatgtacctttttcagcaatgtaaaactaccttgcttattattccaatgatctgaattttgagcatctctttaaattacatacagatcaatgtcatgaagcattaaatttattataatatgtaatataaatatctcacacatctagtcattaaacactaatatttactttgttgcctttctttctccacagttttcccatgtgattctcttaagaacaaaatataatacagtcgtgtaaatctaagtgatttattacacaagtgattatcctagagatactgggacccacgacttggggctccaccaatgttcctctgttatataagctcaggtatgagttctgggaagccacagggcatgggagcaaaaccacatgctttggctcagacctcgattggaattcgggcaccgccacttactaaggggccttctcaagcctgtctcctatctgtaaaatgggaatgagcctaccgacttcataggattgctgtgaggattaaatggaaatcggtacgcaaaatggccagcacagtgctaacatctagaaggtgctgcccagccccaaagagatctaccagagaaataataattctcatttttagtcaagctacaaaataagactcctcatttctgatttgttttataaaaatgcaaaaaagagagagaagaaaagccttccaagattctgataccgctcaccccagttttcacttgaaagtcaaccaatgaatgagcaccagggtgaagatggaattctgccagccacagtacctgcaagagtccacaacacacttgactttcattcatgtgtactacaatcctgtgggttaaagggccataaaagttgtcctggtttttcttatacttcaaaggaagcaatttaatggccatgaatgacagcctcccgattacactgtaactatgaaacacgactgttctggaatgatttccaggctggctccctcaccaaaggaacttcaaggtaagaatttaaacaaaataacctttccaggctttcatccagcttcctcatgcaagaggctctatccttgggagcccagggaatgtatgtgcacacaaagggttacgtagggttgaggccagacagagggtggtctggagagttgtgttgaggcagggcaacccagaaaatggacagcactgttccctggggaggcctatatgctacagacactataagaaataaaagaataagggataataattttttttttgagacagcgtctcactctgtcacccaggttggagagcagtggtgcaatcatgactcgctgcagcctcaacctccttggactcagctgatcctcccacctcggcctcccgagtagctgggactacaggcgtgcaccaccatgcctggctaatttttttgtatttttttctagagatggagtttctccatgttgcccatgctggtctcaaactcctgcgctcaggccatctgcccatcttggcctcccaaagtgctggtattatatgcatgagccactgggactggcctaattttaacattttaagggggaaacattacatgaagaatgttggttacaaagaaaaacctcaaaaatgtgggctctgcctatcttactgccattgcttaattagccagatagagcaagccaaaaatattcccattgccctatgactcagcagacaagtataaatgtttctcacagtagcaaagcaaacgcttacagctggaagaccatcacatatggtggagccaacgctgtacttggaactggatttgattttcaatcctggtttctcaattaactagctctctgaccttgggcaacttccctgaacattggtttgctcatctaaaatgcggatagtcacctgtctctataaagggctacccattaaattagaggatgtgaggataagcaaatcaaaactcccttggtatgtcctatgcctcctctcagctggaatacagcagggcctaggaaacaggtccagttttctgcagagagtcatatgggcatagtttaagcatgtaaaggggcacgcttacagtgatgttataaaagcaaaacacaagtacctgcttactgcagaatcctctcacaaacagagaatcctatgaaaactgcaaaagggataaagaaagaaaaagtgggggaagccaggtccttcaaacctccagtcagcagtcactctcaatcattaccagacgtcgtcactgaatttagggcccctgtcagaaccagcacacatatggagccgtggttacaggccagaacacacacctcttgacatttaaagatgttcatcttcaattggcctccatatgagatgtggagtttgagaacctaattgttcccaagctctgtgaatgggttttatatactccgaagacagctagatattgaaaggggagaaaaggcgggatcttgacatttgggaagcaattctactacactgttttaggattggttttaaaaattaaagacggtgatttgatgtttgtgttgaaagcacaaccacgtcctgactgctaaaagaaatctaacctatatgtcatggtcccccaaagccccaaagtggattttaaagttgttaaagtaaaaatctactttgtaggaagagcccgccttgctattctaccttaaaactgatgagcgagttggagggactgggatgttggaggggctggggtgctggaggggcggcggggggcgggacaggggagacacgggtggtgaggaacagtccagggatatccaggctggacccacgtaggttcctcttcctaccaaaggggaactgggacgtgctccctgtttcccagacggaactcctgggtgataatgtgagaagcccttactgcacatctgtctttccccacatacttacaaagttagggggaaagctggaaagtgatatgcagcccctgtataattctgacttattctcagaagattttttaaaaaactaaaaaataaatggaaatcagctgcagccttcctgatgtgtgaatagagacaatttaaaagacatcaagtgccaaatactgacctgtctcgcctaacaaaactgccctgtctttcagcccactgagaacagagggacacacaccacagggaggtgagctgtctcggaaggagccctccacgcagaccccacagctatattaactgtgcttaacgtaatcatgaacacataatcgcggggctattgaagactccataacaaacaagatcaaggagcctggagcctctaaaacatgaaaaccaattagcactatgaaatctaagagcagacacagccagagctcgagaaaaggcatgggcaggagctggactgctcaatcctgctcactcctcccttccttcctgttacacggttctgttctgaggtgctgctgagaggggcttcctctcctgggccagaactgaggctaaggcccgaagctgaggacagaaagtgatcaactccccacattctaaagaggctgctggagaagcggccacgactggggcctgacatccttctctagggattatcaggcagcactctgctacccatcccacaggaccgtaacttatccttcccaatccgtagaaagcaagactctgaagcatgtgcgtttgtctttggccttgtgggaggtttctattcaagaggaaaactgatgccatgaaggatgggatgaggtgctttctcttcccagaagggaaagatttgggtgcctcgtgaaagggagtctggagtcagctccctggtcaatgatctacttgcagagacaactctctgatctcaccttaataaatgagattcattcacctggcactttgggtttcatgtagggggagagatggaagagttaggggaataaaaggagatgaaaggactaaagaaaaggcagaaggaggccgggcatggtggctcacatctgtaatcccagtatttcgggaggtctatgtgggtggatcacttgggtccaggagtttgagaccagcctgggcaacacggcgaaaccccattctaccaaaaatagaaaaaaaaaaaaatttgccaggcatggtgccatatgcctgtagtcccaactactcaggaggctgaggtgggaggatcacatgagcctgggaggttgaggctgcagtaagccgtgatcacaccactgcactccagcctgggaaacagagccagaccctgaccaaaaaaaaaaaggcagtagggcatgacaaaaaatatactgtggggcaatttgtactcagacgtgggaaacaggattaaatgcattagaaaagaactaaactgaaatatttaaaaatgacagtaatcagttaacaatccattccccatggataagaaggctgtgatttttacaccaaaggaaaagtgtttaagtcatagtccctaccataggggcttcaacaaagtgatgccaaagaaagactactgtcctacgaagacagccatctggaggaggtcctaatggtatcacaagcgatgtgacaaaaatgaagtcccttcatttctctcagcctttccttacctgtaaacagggcaagaatggaaggctgaaatagccagaggttccaaacctcaatggtaatgaagaaacacaacctgtgcattgtattctgaaaggcctcggagaaactgtgtccttatccacagacgcacagagcggtgttggagaaacatcagttaccacttgcctaggatgtctaagggctcttgacacatcctgtaatgcgacgtaaataagaaataaaggtgggcctcactgaaagcagaactcctctcagccgaggactggcttagcctgagtttctgggaggtgatctgccctctgggcttcccctccctcggcccattaacatttctgtacttagaagtcggctgggatcctggagggcataagagctgtaagaatgccatgactatttttaaaattttgaaaaataaatactagaggctctggcagcaacagcgcttggggagtagccgtacctctgaagttttcctttcctttctcgagcaacgcagggagggagctgtttaatgaggagtctcaacaccggggaacaaagcagtagtgtttgcacacaaagcttggtgctggcaattttctcggtttcgttttttcatgctgccaaagtcatttgttttgaaaataagagcctctcctttgccctcagcatccctattaagacactaaaccacaggattaattctgtttaggcctgcagagtgaggtaaatcctctgagacacctcagcaccttccccaggtgagacaggagagtccggggatgaagaattcggctctggagtcacagactcaagttcaagtgccagccgtaccgcttgctagcagcgtggccttgggcaagtcacttggcttcggtttcctcctcttagctgcaaaatatgaaaaacgggcctgctatgaaacgactggcccatagtcaacactcagtaaatgataactatataaaataatggtggtaaaaccagcaaaaatcgacaggtgtgtatcgttgggccataatgtgaaaccacgctcaaagtactttaatatagcatccttcaaggcgctcacaatgctgcagactgtaggagcgaagtcagcaatacaggttggaattcatgtattgggggctatactaacatatacaaagtatacgtgatttgtctaggttgtttttgatgcaaaatagcctgaagctagaggacaccacctactcttatctacagtgtcccttctgtttctaggaagagtctacaatcctaactttaatgcatttttgtctaaactaagagtcttcacattttttgaagtcacagaaatatttgtgaatatatatttttaactgggacttgattactttgtaacatgtatgtgtgtatacacatacacacacgtacataaaagggtaacaacgcaaaaggcaatactggtttgtgtatatatcatatagtggaaagaatattagattcaagttagatcatctacttccaacactgcagatggccagagccgtaaggcaagtctctccaatcaggtcttagtattctccttatttaaaaaaggagaaagacattaaaataccttcaaaattattgttgtgaccccaggcagagtaactagaatgaagtagaagaagctattggaatatgacgttgtctcatgtaagatcttttttttttttttttttttttgagatggagtcttgctctgttgcccaggctgaagtgcagtggcgtgatctcggctcactgcaacctccgcttcgtgtcgtgagatcaagcaattctcctgcctcagccttctgagtagctaggatcacaggtgagtgctaccatgcccagctaatagggaggctgaggcaggagaatcgcttgaacccagggggcagaggtcacagtgagctgggaatgcgccactgcactccagcctgtgcaacagagcaagactccatctcaaaaaacaaacaaacaaaacaaaaacaaaaaaacaacaaaaaccccaatattttaaaacataacagtagaaattgtgtttgtgaatgtcataagaagtttctttacttcttctagttctctgttgagaaacaatacagaatcgtatgctctgtctattggggcaacaattcaatcacagcaggataaaaattgacttttaaaaagtgaccccctgctcttgttttctcctctccttcatcagttcactaccagacctcacaccagagatgaagcttctccatgcagagaaagacctaaaactctagcgtgatgtactcatggataagaattgatcaacatgtatccagagcccaatgatgccaggaagaaagcctaaacataatttaataaactccctctctgttttcttcatttcctactactttggtttacttaaaaatgagtgtttgcaggagaaatctgagtgcatttttggcaagcagctgagttatctttgcttattcattaaacgaacagtgtgacggagaaagtccaaataggaaagacaaggaaaaatggggaaaagttgacttctcatcccaaaatatttcttggattaaaaggcaaactcatccaatcttaaggtttagagggctaaaataattgttccatatgtagctgttagaaggcattagatattaactatggcatggtgtctatggatatctgcgtcatctatttagatagtatgtgctgaatatcaaaaacattaagctaaagaaggttaaggaaagatggtgtttccccaaggaaaggtgtgcttatcctagtttgacagtctcctaggaaaacttggatactttcttacataggaaggacatataacatgcttccagagtcacagggtttgaagacggctgaagacgtcatcttgtccccatatgcggcccaggaagagcgaagtctagcaccacattgggactagaaatctacattttaaatcgtattacaaatttagagatctaatggtgtattagcaagataagtttcaaatacatcaacaaaatgataggcagaaggaacctcaaaacttttgtgatctgaattccccatttcatagatggggaaatcaaggccctaagagctgaagaaattgccaaaggttgaaaaacactcctcaaacaccaccttcctcctctctgggacttcatattatttcattttcttttactattctgcctgagctttgactttctggaattttaaataccaatataggaatcatcagctggtgtcaatcctcaataagatgacttaaagtttactcataatggtttagcatggtcagaaagtgaacattattcataacggtttttcatggtcagaaagtgaacactacaggtttggcctatgtgcctgtaaaatttagaaaaaggacataaaaaggaggagaatttaaaaatcacctagaccactgtcgatgctgtgagtgggaattcctacttacaaaggccccagtgcaagctccctcttagttagctgccttctgacccagctatctcaacagagttcattaactctgttaaaaccactaacttatgccatggtaattcacataggagaatggcataactaattaatatgggtggaggggcactggctctagcattaaagtggattgataactcactgaaatctgcatgatcacacacaaactccttatcttgctaagtttacgcttgctccactacacaaactgaacaccagctcttagtaccctcaatagctaccctttcctcactgcagaagaactaagtttttcatcagacacccaaatgaaactgatactggccgtcagtatcattatccactgataccagctaccaattgcttgctggtactggctgtcaatatcattgtccactgataccagctaccaattgcttgctggtactggctgtcaatatcattatccactgatactggctaccaactgcttgctcgatgactgaacataagccaacgacactagccccaagtactttcctaccttttcatccaccattagcataaggaagagaaattcctttgttgtcttcttgagggaaaaactacacaaaatagaaagccttaggctccattacataaagcgttgaaaaccacacaccatgacaataaagacccaagcatgttttcaataaattattttcctcttatttcacactgtgaaaacccacatttgatagactattttatagcaaatgtaccggttatcaataaataagtagagtttccacgtgaggagagaggagaaatctactcccagcatttgcccccttcatgggtgcaacagaacttgtagcaattctctggtttaaacaacaggtggcagtgtcatttctacattttccctggcaagaaacctttgcagtttgtgatttcaccttccaggaggcattaacagttttgtaaccgcctctatcgacagcgtgtgcatatgttcctatgtagtaaatgcaaatgcatgcaggaaaacattgagatttgtgtaaatgcagtttcaccaagtgctactctccccatacccacgcccctccccacacaatagtctatgcacaggcatcatttcccttgaggaaacagcaaagcagggaaaaggcagaaggaaaatcgactccatcacatatgttctgatcctcaattatcatatacatgtctgtcacccacccattcctgccacacatacaagagaaaggatacactacaaggtcctggggcacactttgggcaaatgactgagaaagcgaagttctgagaaatcttaattcacatcaagaaaagcactctactgtactgacatttctggtaggcgctgttttcactcttctgctacaaaagagcatgctccatatttgaaaggaatcaacagaaacaggtcttacattcccacaaggaaaacacagaagtcaggaccattctcacatgtgccgagaagacaagaccacgtttcctagggtttttgtgtgagctttaaataggagaaaagtgccatgtcaagaattcctcattcaatatctatagctcagttttttgttcacatgcattattttattttattattatttttgagatggagtctcactctttcacaccagctagagtaaagtactgcgatcttggctcactgcaacctccacctcctgggttcaagagattctagtgccccagcctcccgagtagctgggattacaggcacgtgccaccatgtccagctaatttttgtatttttagtagggatggggcttcaccatgttgtccaggctggtctcgaactcccaacctcaagtgatccacctgccttggcctcccaaagtgctggggctacaggcatgagccactgcacctggccacataattttataatgtagcagcaggtactctgtggtttctagcctataatgtaacagttattggtttgatatgttacatttatttaattttgaatctgtggtgtttttttaaagcaatttaacaatgaaaatctcgtcaatgcagcagggatgagatcaaactgactgatgggtaaatcaccagcctaaagggacacgccaggtattagacagtctggcatgtgtagctggagaagtactcaaaaatgtataaaagtcaatgagcacatatacggagaattacacagaaaataataagcagcactagaaagagatgatgtgtgttttttgtactgtccctgtcacatagcatcaaacatccacattcctgctttctgagatgagagggttggacaagtaccctcaagaagctttctggtatacggtacacagtatcttattgttttataaatagaaaaaagagaatacagaggaaaaaattaaaatacatcacctagagttcagaggcattggaggaatttggctttcatcagcaattttgcattaaaagcaagtatctgtcggccaggcgtggtggctcacgcctgtaatcccaacactttgagaggccatggtgggcggatcatgaggtcgggtgttcgagaccagcctggccaacatggcgaaaccccgtctctactaaaaatacaaaagttagccgggcatggtggtgcagcctgtaatcccaactactcagaaggctaaggcaggagaattgcttgagcccaggaggtggagattgcagtgagccgagattgcggcattgcactccaggctgggtgaagaacaagactgtctcaaacaaacaaacaaataaaaaagtgagtatctgtcctaagcaacacattgtcaagtgcggcctatatgatttcctggtggtcagataatgttgcattcatgctttctgtaggaagtggggtttcatgaaacagcatgaactatgaactttgaacgaagagtcacgggcttatccctgactctaggacttagtagcgtggttaatcacagccgcattattaatgtctccagttctccaaaatacggtaaatgacaccataacagatcttttgtaaagctatggtggatatttttaaaggattatttattcatagtaggtgtctgataagagctacttttagacttttggacttgtagataacttcttttaatttcctattaaaatacccaggaaggtacagaatccagtgttggggctcataaaccaataccctaaaatacagcgctttgacatcctgaactgaagaagcctccaggtctctctggccttccactttacccactgtctctcaatcttctctctctcccaagcagacgatgaacttgttcattggagttcccttatctgcccaaactcccagacctgccaaagaagaaaacaatcacctctggctctttccctgcgtcttcagtaactgaactcctatcccaggaacaaagactgaaatctgtcaacacacctgaacagactcctatctgctttgcgggcccaacagatggtcccaggccatggtatgttcttcaagcccactgaattccctaaaaatcagttcctaccccgttaaaatcatccacacttccccatctccctttcccctaagaagaagggtgtatacatctgtcccccagggcgtggtaggtcatcactgtgactctccctcatgcacattaacaaacgtgtatgcttttttatgcctttagcagctgattttcagcaaaacttcagaggaaaaaggggacattttcccttggccactccactagccacagtcctataagctaaagataacagaagttcccctatccaacaatctcaggaaagtttcctttaagttcagcattaatcactgaatgttctaccatctaacaactgtatggcattttaaaaaatgtttaactgaggttaaatatatataatgtaaaatttaacattttaagtattcacttcaggggctacaaagtacatttatattgttgcacaaccatcacgaccatccatctccagaactttcttcatcttctaaacctgaaactctgtgcccattaacaataacgctccattcccgaccctctcccctcagatcctggtacccgccattccgtctctatgaatttcaaacatgaggtgcctcacagaggtgaaatcatgcaatatttgcccttttgtaactaccttatttcacttagcatgtcttcaaggttcacccatgttatagcatgtgtcaaagtttcctttctaaggctgaattccattttatatgtggcacacattttgtagatccatacatctgttgatagacacgtgggttgctctcaccaaatgtgtacaaatatctgttcgagtacctgctggattccaattttggggggtgtatacctagaaagagaactgctggatcatataataattttatttctaatgttctaaggaagtagagagcattttgaaatgtgagatcgaggcctaagcagtcattcttgctaactggaatgctggagtgctgagctggtcatggctaggctgatcccgtcagtggcggacagaaaagcattgacatgaggtctataaaaaaataagtatcagccaggcactctggctcacgcctgtagtcccagctacttgggaggcggaggtgggaggattgcttgagcccaggagttcaaggccagcctgggccacacagtgaaaccccatcacttaaaaaaaaaaaaaaaatagaatagtaaaagggaaaggaaacatcatgctaaagaaacagaactggctgggcgcggtggctcatgcctgtaatcccaacattttgggaggccgaggcaggtggatcacctgaggtcaggagttcaggaccagcttggtcaacgtggtgaaacccagtctctactaaaaatacaaaaattagccaggcgtggtggcatgtgcctgtaatcccagctactcgggaggctgaggcaggagaattgcttgaacccaggaggtggaggttgcagtgagccgagatcatgccactgctctccagcctgggtgacaatagcaaaattcagtctcaaaaaagaagaaaaaaaaagaaaaagaaacagaacaacagcattacctgtgaaaaatctttcaacacagcaaacacaagaaatcttgctctcagtaggacaaaggcaggcagaagcactgtggaagaggggccaggaggggctgagatgagggcagaatgagggagcacagcgagctaactaaggtcaaagaaaaagaaaacaaggaagctggaattatgttaccgagaataaaatagacattggaaagaaataatggaaaaacagttcagccaatgtgtggccattcagaagcatcctgccttgtcggtctaatgctaagaatgatgggagaaggggcttccaatctttttctatgattttttttttgtacctagttaaaaacccactgcatttacagttatcaatgaaactgttctgcttaataccataatacaagtgtctttccaaagttttttgttccctgaggacagaataacaaatgtcagaacatgaacatttttagggcttctgatacatactgttgccaaaagtatcagcaaggtatgaggccatcagcactgccaccattaatttttattctttttttttattttgaaagaatcttaaacttagagaacagtgcaagaatagaatagtataacttattttttcttagctatttgaaagttagttgccaacacaatggcccatcacctccaaattgtgtatttcttatgcacaatgacattgtcctacacctatgaaaaccaggaagttaacattgatacattactaccatccaatcctaggttcaccaatcattccaccatgatccttttcacagcaaaaggttccagttcagaatcaaggcttctgtttgcttgactttcatgagcttgacacttttgaagactagaggccagttattttgttgtataatgcgtctcagtttggggttgcttgatgtttcttcacgaatagattgaggttctgcatctttggcaggagcatcacagtcatgatgctgagttctcatatcctatcacgtggtacataacttcaatcagtcttattactgatgttattaattttgatcactaggttaaagtgttatctgtcagacttctccactgtgaagtttctcattttctctttgaattcctaagaatttgggagtggggagagttactctgagagaatgcatatatgacattcctcagcaaacttaggactttaagcactgaactcacaaattcctattttattcagtgagttataacctattactaccgttattttgatgctgaaattgccacagatttggctagcaggagcctcttcaagctgactcctatgtccttctgctatatcctcatctttggacatttccttactttatgaaacaagaagacatcccaggctcatcttctacttctctgtcccagccctggaatcagccattcttccaaagagcacctttaagtagcgaacagtatttagaagccaaagtcccagactaggtgtgcactaggtgttacagttcccaggtcctctcagtggacacagccgggaaatatacgtatgtggaacacacagacacaaagatctgcatctatgtttatttctacacagctctttctctctgtggaataccaagagttcacaccagtctctctaatgaacagagttttattccagttccttccctttccaaaacaaccagccgtgtctctgttgccctctcctgcccggctgccaggtttccacgtgaatgctctcactcccctgagttcagacactcagctttgagccaaagtggcttccctctctcccaggaccccacgctccacagtcaaggcactcaacttgctctgcctcatctcatgacttttgaactgagctttagagaaacagtaagaacaagacattatcaatttcatagatgagtctgaatattttaaatgtttgccatcatatttctgtaaaaattgtgcttcacgtgctttgtctatttacctatacacacctcattgattttaaactttttttctttgtttacagatggggtcttgctctgtcatttaggctggagtacagtggcaaaaatcacagctcactgcagcttcaaattccggggctcatgcaatcttcctgccacagcctcccaagtagctaggaccacaggtgtgcaccaccatgctggcttttttttttttttcctgtagagatggattttgctatttttcccagactggtctcaaactcctgtgctcaagcaatcctcctgccttggcctcccaaagcactgagattacaggcatgagccaccatgcccagcagatttcttcttgattagtttacgctgtatgtgtgttaaaggtatcaatgctttggcttaaatgttgcagataatttcttgatatcttatttggttcttgacttattttttttaatagaaaattgtattttgttgatttagaaagcctgaaccccttgctacttttctatttcctctgagccccatttttctctgagctttttgcatttctgaacttctccattactctccactccagtgattctcaatcagggctgattttgctcctccccctggaagtctggcaatgtttggagacatttctgagtctgaagactgggtaggaaagtatgattagcatctagtggcaaaggcctaggatactgctacacaccctacaatgcacaagacagcccccacgaccaaaggttatccagcccaaaatgtcactagtgtcaaacgctgctctggagtctctcaaacgctttacagctattcttttgatttcttccaaaacaagacattagaaaagaaaggctaaaagaggaatatttttcatgtaggcaatgactttttctaaatcctaggtctgagttacaaatactggtcatagaaccttatagaatccaaaagcattgtcaaaaagaccaaccaaaaaaaccctatctttgttatttccacaaaagatgatcgtagctgtgttcttgacataaagggactcacctaattcataaagttttaaatctgtgtttgtcatgtggtcaagaattcatatctagattacctaggtccatctgtgctatcttaaatgccaatgaaagaaaaatgtaattattaatttaattttttcaaatcctataaggccagtaccaaggtactaaatgtaaatatatacatacatatatataaatgtacatatataaaatacatagttttaaaaataaagaacagtattacaaataaaattgttgctttcttggaactcaggcctttgaaagaaaatacatatatagcagcatggcatgaagcaatttaacaagatatgtaagatatattagaaagaaaggagatttttctcttcacaaacacaatatatatcttcttggttatagacttgttacttgcctgccagaagagtttactatcatcttcacaagtattcaattctcagaaccaagggatttcacagcctcctctacccaatcaaagcagtgtcttatggggtccgtctgaacgtaatcctgtcctactgacggatttgacatctatttctgccaccattgcacaagaacacagcagactgctgactgcaataagacttatctagaggctaacaggcaagcaaaatctatactgatttccttttcttcagcacaataccttttaaaaagtaccataaataaaacagtgttctcaagacctgtgattttcaacgagaaattactaaacacattggggaggcttcttgtggtcttgatttcctaatgagctatgggaaattacataatgaagagaattcttcttggcttcttaggtttcaaaagcctacaaagtctgtaaattctgtttcctttccaacaaacactaaacctaacttggtattcgaaactttaacctctccatttcaaatgctttagttttggtcctgactcattacaagaaaggaggctgttagaatagcaaaataataattatgatgaaatcataacaataataacagtagctaacacttattgaactgagcgctatatgtcagatagtattctaaatgctctatcggtgtaaactcacatcattctatgataagctacaaagtagatactcatcataataatcagtcgcattttatagataagaaaactgaagcccaggagtgtgaataggtttttctaggttagaagcagaattgaagtcagaaagcctgactgtaaactcatggtcttaaccacttttctggctctctgattcccaccctctcaacttttaacgtgactgaatctgaaactcatcattcattatagcatcaaacctacatctccctcttcttaaggcctacctgcatgagcatgtacctgttcatacagctcccagaacaaacgtgtataggtttgtctaagtaaacagcaaatttgattgtaaacataaaaactaaagagaatatcattgctttgtaaaggtaacggtgaatgattctcaacgccaataccagaaacatgtgacaatcacaaggcagtcaccaatttaacagagagaaggaaagtatgaagtgtatctctcagtctctgatagaagttcctttcttcacctcgggtgaaggtcaggagttccacttctactgcccttgctgtcaccaaacagcaaagttcaaggaagacagaggagctttgaagccttctgacatgggtacagaattctactatgtctttttgtttgagtacaaaatatagctctagcctgaagaaagacttagagttaatcttcctgtggtacagatggtatattctgattcctgatcacccacactgcgccacagagcccctgacacagaattgtctgtagttaagtaatgggaggtgaggaagtggcctcagagaaggactaacgtccacagacttgagttcgtacaaccacaaaaatacctgcctggccaactagccacccagtctagcataaagattggtcatgcagatttgtggaaagaaagaggtccaggaaatgcttcttggaaggcagaacatttacttattcatcattatattattgatcagcctccctacaccctgattaattatcactccattgatgaaaagctatctcaattcaattctattgctttctcagcaatacaggcaaaaattttacatagcaagttttttgtttgtatatttttattcatttttcagcaaatcaaaacccattcaaatggaaaatggaaagatggaaaaatgaaactgtgcatttcaatgtgatattgagcataggatatcagcagctcacttcgtgggttctgtgttgcttcgacattctgtctgtgacctcttggaaggtttgactggtaggggcacagcacttcaaactgtgacataatcagcgtttcctctcctaggttaagagggacactgatcgctggaaacatgaacatccacagcaactaagagtgagcactgctgaacacagccacagactgtggtccttcgttaaacaaatgaaagtctaaatcaaatgacgagagaacgcaaattcatgatcattatgaagcaaatgcattgctgtacttaagacatcagtccctctacagagaggccatcacctctttgcacaagtcaatatgggcaaaaattgttttcaaaaaccaggttggttctcaaacattaaaatgcacatatcagagaaaaatgctctctcaagcatctctatacgaagatgttcattacagaaatgtttgttatggtggaaaatgagggccaatgtctatcaataggagattgagtatgagaactacagtgcacagcgagggggtaagaacgtgggttctggagccacgcagccttgctttaaatcctgactttgacacacactaacagtgcgacctgaggcaacttacataacctctgtaaatcttggtttcctcgtctgtatataaagagtttagtaaaacacttgacatatacgagctcaataaatgttagcaattattattatgctacattatgtatatggacattttaaaaagatagggctgtatctatcagcgtagaaagatggcctgtgtcattgttaagaaaatgtttccagcaaattgtagatgggtataactaatataactctgcatgtgcaaatattgtgtggatacacatggaaagtattctgggacacataccaaattgttacaataaatccctttcaaaaattaggagtggctgggaggagaaggctttcacttcgcactttccatggtgccagggtaataccacctcacaacagtaaatagcaaaaatagcaaccttaactctagattttcttatctaaattttaattctgtgaagaattttccatttccctttttcaaatcaggatataggatgcaatttagaaagagtgagatcacttgttagactgtacgatttttaagcatcaataaagtataccaccgaacttctctaccaatccattctctaaacttcccaatcaggtgtgcctctccatttaggacacaggcaggtttttgttccaactcacagtgtaactgccctggtttcagtatccacggtgaatgagaacagctaagagacacaagtgctgggaattaaagaagcatctacttaaaaaccaagctcttgctaatcagtgagaagagtctcaagagatgatatgctgaaggcaccgagggagagctgtgttggaatgtctgtctgtgcataactgtggtccttcaaaacgagcaattagaaaacagagatgagataatatagctagctctcgcagattaatcaaatgtgtcttgttactagattagagaattcaaagatatgacagagaatattaaatgtctgaaaatgaccaagtgtagctgcttgaatcatttcccccacagttttcagtagaaaagagttgttctttcccattttccaaaatcattactattttagcattgtcaaggaaaaaaaaaggacttatgttttgtacttttcacagtgtagaggatgatgctcagaataaattgtttcactttgggagttatatttactagaagaatgaagctcttgctttccactttaagacaaagagagggacatacaacaaaaaagacggcacgttcaggggctacaggggcgtgagttcaaatcctggatttccaatttccagctatgtatctttggtgagtcatttaacctcagaacccacttcacaggactattacaaaactgtgtgtgtgtgtgtgtgtgtgtgtgtgtgtgtgtgttactgaaaaatatcacccagtacttagtacacacctagtagttgttagctactatttcagagagacttctgtggatggcatatactgatgatttggttaaaaaaataaagaataaagacagttaattctttcaaaattattatatgactatcactgttaggtgggaggggataaaatgaggaactacagagatcactgaatttacagcaaatgtcctggccaggtaacctagaggtcaaattgagatgaaaatcaggttgcttctatcatagtccaatattttttcatactccatcagattctgctttctgcaatataatatggaagcgagaaaacaagaaatattccaggatacagtcacagatgtactatatagcttacattttatctttttcccaaaaaagaggaacctcattctgcctgaacaacaaaaggttaaagatgtattggtggacagcatctaggaagagagatacaggaagtggacagcatctaggaaggagatacaggaagtggacagcatctaggaagggagatacaggaagtggacagcatctaggaaggagatacaggaagtggacagcatctaggaagagagatacagcaagtggacagcatctaggaagggagatacagcaagtggacagcatctaggaagacagatacagcaagtggacagcatctaggaagggagatccaggaagtggacagcatctaggaaggagatacaggaagtgggcagcatctaggaagagagatacagcaagtggacagcatctaggaagggagatacagcaagtggacagcatctaggaaggcagatacagcaagtggacagcatctaggaagggagatacagcaagtggacagcatctaggaagggagatacaggaagtggacagcatctaggaaggagatacaggaagtggacagcatctaggaagacagatacagcaagtggacagcatctaggaagggagatacagcaagtggacagcatctaggaagggagatacagcaagtggacagcatctaggaagggagatacaggaagtggacagcatctaggaaggagatacaggaagtggacagcatctaggaagagagatacagcaagtggacagcatctaggaagggagatacagcaagtggacagcatctaggaagacagatacagcaagtggacagcatctaggaagagagatacagcaagtggacagcatctaggaagggagatacaggaagtggacagcatctaggaaggagatacaggaagtggacagcatctaggaagggagatacagcaagtggacagcatctaggaaggagatacaggaagtagacagcatctaggaagacagatacagcaagtgaacagcatctaggaagggagatacagcaagtggacagcatctaggaagggagatacagcaagtggacagcatctaggaagggagatacagcaagtggacagcatctaggaaggaagatacagcaaatctaattcagaagaaaagaaacagattgccctgaatatgacagtggccatcagaaagggagctgtaccctccacccaaatgtgtcccaaacacaaagacgtctcacatccctctaaaaaccgaaaagaggtaccagtactgtgacggtcattttctggaattcattaattgaatcatgaagagaattatgtaaggtcaaaacactcatacctcagaaaaagctgcgtcctatacactaggctagcccacaccaaccacaaagaaagcacagacagaaatttccaggacttggtgtctttgcaaagacagagactccagccataagcttagcaatgtaccctcttgatgaaggaagtgagcatgatctctccctttgtcatctgagtgatgtatgattaagctcaatagaggtatagattcagtgatgttactgagaggaagcaacagaattttcagtgacctaaggtgctatatgtgagagtcccaagtgttctaaagaaaaacctggcccagcacagtggctcatgcctgtaatcccagcaatttgggaggccgaggcaggtggattacctgaggccaggagtttaagaccagcctggccaatatggtaaaacactgtctctactaaaaatacaaaaattagacacacgtgctggtgggaagtcccagctacttgggaggctgaggcaagagaatcgcttgaacccaggaggtaggttgcagtgaaggcagagattgcagtgagccaagatcgtgccactgcactccagcccatgtgacagagtgagtgagacttcatcccccacccgccaaaaaaaagaaaagaaaatgaaaacccataccagaaaaaaagtttctctttcttcaaaaacagtccttcttttgaccttccctaggtcttgcagaagagagcataaagaagtcttagatcaaatactcatttatatcagtgacttctaagtaattacctgcatctataggatatacagagtttaatcacatacccttgaaagacgcactccactaaacaaaattataagtacacctcattgcgtgtactgagcttcactctgctgtgcttcatggatcttgtgtttactagatagaaggtttgtgaatcctttgttgaacaagtctattagcaccatttgtccaatagcatgtgtgcacttcatgtgtctgttgtcacattttggtaattctcacaataattcaaactttttcactgttctatctgtgatgcttatcagtgttctttgacattactactgtaattgttttggggcaccatgaacagtgcccatatgagacagttaacttaatccatgaatgtgtgcattctgacagcttcaccaacttcattcctgtctctctccctctcctcaggcctccatatccctgagacacaataatactgaaattagcccagttagtaaccttacaatggcctctaagtgttcacgtgaaaggaggagttgcacatctctcgctgtgattcaagagctagaaatgatgaagctcagtgaggaagacatgtcgagaactaagataaactgaaagacacatgtgttgcacaaaacagttagccaacttgtaaatgcaaaagaaacactcttgagggaaattaaaagtgctactccagtgaacacacaaataatcagaaagtgagacagccttattgctgatagggagaaagtctgagtgatctggacagaagatcaaataagccacaatattcccttaagccaaagcctaatccagaggaaagccctaacttgcttaaattctataaaggctgagagaggtgagaaacgacagaagaaacggtggaaagtagcagaggttggttcatgaggtttaaggaaagaagccatctccgtaacttaaaactgcaaggtgacgttgcagcaagttatcaagaagatctagctgagatgactgatgagggtggcaacaaggaaaagcagactttcagtgtagatgaaaccgccttatattgggatgagataccatctaagacttccataactagaggagaggtcaatgctttgcttcaaaacttcaaaagacagaatgactctcttgttagggtctaatgccagctggtgactttaagttgaagcaaatgttcatttaccatttaaaaaatcctacagcccttaagaactgtggtaaatctgtactgcccatgttctaccaatgtaataacaaagcctgggtgacagcatatctgtttttaagcatagtttactgaatatctgaagtccattcttgtgacctactgctcaggaataagattgctttgaaaacattactgttgattgacaacgcacctagtcatccaagagctccgatggagatgtacaagaagacgaatgctgttttcttgcctactaacacaaaatctagtcttcagcccatggatcaaggagtaattcaactttcaagtcttattatttaagaaatacattttgtaaggctatagctgccatcaatattgattcttctgatggatctggggacagtaaattgaaaaccttctggaaaggattcactattccagacaccattaggaacactcatacttcatagaaggagatcaaaatatcaacattaacaagagtttggaaggttgattccaatcctcatggatgactttgagggggtcaaatcttcagtgaagaaagtaatcagaaatgaaaaacaaggcattacaactgataccacagaaatacaaaggatcattagagactgttacgaacaacaatcttgacaatgctgacaaactgaaaaacctaaaggaaataaatcctagacatacacaacctaccaaaattgaattaggaagaaggagaaaacctgaaaaaatcaataatgagtagtggaagtcctagtcagagcaaccaggcaagagaaagaaacaaagggcatccaaattggaaaaaaggaagtcaaattgtccctctttgtgaatgacataatcctatatacagaaaaatctaaagactccaccaaaaaactctttgaactgataaatgaattcagtaaagttgcaagatacaaaatcaatatacaaaactatacatcaataacgaagtagtgaaaaaagaaattagaaaagcaattccacttacaacagctacaaaaacataaataaagtatctaacaataaatttattgaaggaggagagagaactctagaaggacaactatgaaacactgatggtagaaactgaagagaatacaaacaaatggagatgtcccatgcttataaattggaagaattaatattgttaagatgaccatgctacccaaagcaatctacagatgtaatgtaatacctgtcaaaataccaaaccacatgtttcacagaaatatttttttaaatcctaaaatttgtatggaaacacaaaagaccatgaatagccaaagcaataatgagcaaaaataacaaaacaggaagtatcacactacctgacttcaaaatatgctacaaagctataggaaccaaaaccatatggtactggtataaaaacaaacacacaaaccattagcatagaatagagaacctagagataaattcacatatttacagccaaccaattgtaaaatgtgtcaagaaaacagactgaggaaaagacaccctgttcaataaatggtgttgggaagattccatatccaaagcagaagagtgaaaggagaccattatcactgtatacaaaagtaaactcaaaatgaattaaagatttgaacataggacccaaaactataaaactactagaagaaaacacttcaggacattggtctaggcaaatattttatggctaagacctcaaaagtacagccaacaaaaatagacaaatggcactatattaaactaaaaggtttctgtacagcaaagaaaacaatcaagagactgaagagacaatctgtagcaataaatatttgcaaattacatgttcagcaaggaattaatatccaaaatataatccagttaaaaagtgggcaaatgatatgaatagaaatgtctcaaaagaaaatatgcaggccaggcacggtggctcatgcctgtaatcccagcaccttgggagacagaggcgggcagatcacctgaggtcaggagttcagaccagcctggccaaaatggtgaaaccccatctctactaaaaatacaaaaaattagccaggcgtggtgacacacgcctgtaatcccagctacccaggaggctgaagcaggagaattgcttgagcccgggagacagaggttgcagtgagccaagatcctaccactgcactccagcctggctgacagagtgagactctgtctcagaaaaaaaaaaaaaaaaagaaagaaaaagaaaaagaaaatatgcaaatggccagcaaatatatgaaaaaatgttcaacatcactaatcaccagggaaatacgaatcaaaaccacaatgaaatatcatcttaccacagttaggatggctgttatcaaaaaaagaaaagataacatgctggtgaaaatgcagagaaaagggaactcacacactgttggtgggaatgcaaataggtacagccactgtagaaaagagcacagcatttccacaaaaaaactaaaagagaactaccataggatccagcaatcccagcactgggtttcctttctttctttcttttttttttttttttttacaaaagaaaggaaatcaaagggatacgcacacccccaatgcgtattgcagcactattcacaatagctaagatactgaatcaacctaaatatccatcagtggatatttaactccataaaagacatacaagtaacaccactctactttcacgcatgaagcattaatggataaagaaaacatagatacagacatgatggagtactattcagccatagaaaagaatggaatcctgtcatttgcagcaacaggaatgagcccgaaggacattatgttaagtgaaatatgtcaagcacagaaaaacagatatcacatattctggctcttatgtgggagcaaaaaagatgttgttttgtgctcatcaaagtagaacttgtgggtattggaggctgggaaatggaagaatgggagggaggttgtttgatggatacaaaattacagttacatagagaggatggagtttgcgtgttctgcagcattgtacgctgaatatgctcaactgtattatatttttcaaaaagttagaggagagtattttttaatgttcacaacacaaataaatatttgaggtgatggtatagtgatcactctgatttgatcattacatattatatacacatatgaaaatatcactctgtatcccataaatgtgtacaattattatgtgtcaactaaaaaggaaaaaaggagttgcaccatcgccacacctgtcacatagatcataaatacaaacccgcacacaaattacgttatttactatgtatcattgatgtcagagccctaaaaagccttattaagcctcttgactacagttttcaaacttttttttgcagtggaacgcttacatcaaacaatgttacgtaaatcccaaaatagaatcccccagtaacagtgatctcatgaaatcaaggcaaggcatgtggacgtgtttagtgggggtgcacaagcatgcctgtgcttgtagggagaggacagggctgcttccccaaaacactgtttgaaaaaatcactgatgtattacaagcttcttattcccagacaaacttagtatggaatcacctgccaggtaaggaacttgcttatacataaagtgagggctatagactagaccttttatctgtatgtttctagcaatgttttatgacactattatacagggttttcataggaaatcacataaagaaaggaccattgatacgataatcattataataaatcatactaaatgatcttggtagcaaactagttgtcaagcaaagaaggattatgggtttattcagaccaacttctggaatcttatttaggtattaaatatatattaaatatcaaggtcagaaaccaaatgaagtattaactggcaaaatccattattacaatagaaataacattgatccctggaaataaaaattatttcagattaaaaagaagttatggggccaggcgcagtggctcacggctataatcccagcactctgggaggccgaggcaggcagatcacgaagtcaggagatcaaaaccatcctggctaacgtggtgaaaccccatctctactaaaaatataaaaaattagccaggcgtggtggcgggcgcctgtagtcccagctactcgggaggctgaggcaggagaatcgcttgaaccagggaggcggaggatgcagtgagcagagatcgcgccactgcactccagcctgggcgacagagcgagactttgtctcgaaaaaaaaaaaaaaagttagtgaagaagctgatttcaaagggttttactgctatgaagataaaattaggttggtttcattctagctttattgtagtctgcagagactaaattgaaatcagccattttaattcagaaacaatatttaggctgtagaaagcagagtgataaccaccctgcctttgtttaaaatctctgagacagaagggatatttcctgtagcagcataaattacagagactctaaagttacgttgaaacgacccttacaccctcgaagcaacgtgcaattttgtggctgtaattttctcaaactgcttaataaaaccttctcctttttatcagaaaaaaagaataaacaaaataccaagaactccataaaaggcatacaaggaacattactccactttcagccatgaagtattaataattaactgttgggcaggcaaactgagttagcagtcttttcccacaggacatcttcctgtcaaaatgtcacccagaaataaccctgtagattacaggaaggggctgcaattccccacagtgcatctcataaccataaatggcctcagagtttcagtacctgtcatgatcaggtcacctaacacctgggaatctctcactctccccctcctctacccacatatttgccgctaacacaccaataattgatagtatctgcatttctgagcattaccagccatgagctgcctgccctagcactgaaggagagacagatggcagccagacagaacgggatggagagctcatatccgagtcctggctctgcccttgattcactgagcaacaacctctcaccaaagatgggatcataaagctccattccctcgcattcaaatgctaggaatcctaatttgataatttctaccatgaactttggtgtcttctgtactcatatttgctttctgctcttttgaggaaaaaaatcagatacaatattgtgactatgaaatcatcttctcatttttagtgattcaaggtcaggtgaaaacagaaccgttagtttccattccaaacactgatacatgtaaaaggttatatactttagcagagtcctcactggaaaagatgtagatttggagagttcaggcagacatgggttcaagtactggctccactacttaactagttatgtaattttgggtatgtgaactaactactctaggctttaatttcctcaaatgtatataataagaatgataatcatgaatgctttagggatcgctgcaagttgcaagctaaacctgctaaatatgcaactagcatacaaccgagcaatttgcattcctgagcatttatcccaaagacatgaaaaaccatgttcccataaaaccagtgcatgaatgtttacagcaactttatttatagtaataaaaaactggaagcaacacagatgtccttcaaagggtgaaaggttaaactgtggtccatccacaccatggaatactaattggtaataaaaaaaaaactagggataagggcaacaacctggataaatctctggagagttattatcctaagtgaaaaaaaaacccagaaggttacacactgcattttctatttatacaactttcttgaaatggcaacattagagaaatggagtacagattagtagctctacaggttaaagagcggttgggatgtaaggaaagtgaatgtatctataaaagggcaacgtgaggaattcttgtggtgatagaaatgccctgtttcttgaccatatcaaatgtcaaaacatcaatgttctggccgggtgctggctcacacctgtaatcccagcactttgggaggccgaggcaggcggatcacgtgaggtcaggagttcaagaccagcctggccaaccatggtgaaaccccatctccattaaaaatacaaaaattagccaggcgtggtggcgcgtgcctgtaatctcacctactcgtgaggctgaggcacgagaatcgcttgaacccaggaggtggaagttgcagtgagccaagatcacgctaccgcactccagcctgggcaacagagtgagactctgcctcaaaaaaattaattaattaattaaaaaataaattaaaaatttttttaaatgtcagtgttctggttgtgatagttttacagttttgcaagatgttgccatctgaggaaactagataaaggttacaaagtcctctctgtgttctatcttacaactgtatatgaatctataattatctcaaaaataaaaggtttacttcaaagaaattaaaataatcatatttcagaatatcactgcaaagattaaatatatagaattgagcaataatttaaaaattattacgtatatgaaaaattgcctagcacagacagttcttggcaataacagaagctcattaaatgttaatttctttcctctaagaagttgtacatagacagaatgcatcctagtagatttttatttgtggatcaaatgaagacgtaactccatgaaagggtctgatcataacatacacactttttggaacatttagcctttttttccctatgaatctgaactttgaggaagtattatttcacgctaaataacattcatccacattcctacagcaaaactgtacaactcaggtgccaactaatttcttccatcaaaaaatatgaccagtggagcaggttgtaggggattatgatccagttggttaagagtcacagtcaaaaaagatgaatcaaggccaaaaattaattggcatgctcttttacagacaatgaagaaagaacatgaaaagaataaagcttggtttcatgtgctcaagagttcacagctagttaagacaggaaaagtctcatatatgaagactcagagaacaagtggagaacagaccatcagtgcaaaaaatctgcagaagaggtggaggtgagcatggctgggggcaaatgagtgcagaagagggaggtgagaggtgagcaaggctggggcaaataagggaattgggggctgctggctccacacagcactgtcggactgcgtgaagaactgatggcagacgcacgaccttggccttctggaggaccgcggcaatccttagtactttgccgacgctgcaatgtaatcccacctttcccagagttctccatcccctgctgccagatccctgccgcacaaattcgcttgtatgaagctcctggctactttataagtatactttataagagaaaatacagacacacagacaccttcctcccccaatatatgcagacagtatgaagcgtcatagtgttccggcctcaaaaataaaattaggaggaaagcctgtggcacagcaaacgtctccccagcctcccacctgaccctacccttccaggtcactgcctcaggagataaaatcacccaggaggccctgtttaaactcaattctaagttaaggcctgaaaggatccatacactgtccaactctttttcatgccaaaattaatatagtaaacatatctttgtttcagcaatcaaaacctggcaatttgccatgtcaacccccattccacagccacgtgtctgaagaacatatgctttcagaatggcgtttatgatctcaatgccatcttgctgcaagccttccagctaggatgttccctgtagttgaaataaacggaaaggaagtttctgagttgaagtaaaccgaaaggaaggagggtcacagccccgcggcacagttcccaggatgactgctgtgccactcacaaaatgagccttttgactgactccagcagcaggacgggactgtcgtttcacgaggtgagctacgggcagacagatgtatccgaatcgcattaattggaacatcttgtcacaggataagagaatttccatttctctgcggatgcctgtatgctacacatggtatctggcaggtgtgagaacctcgtctttgattgcctatattcccaatctcctttctttgcctattttcctgctgcaaagcaattacggctgaaaatcagtctgcaacatgcgctcatccatattcaactctttccacttcaggcaaatcttgcccagaaaaaaaataataaaagagagagacttataaatccagatttgtcttttattttgatcctctgattgtccaggtgtttacttgttgataatccaccattttctccacatcaaaataaatattctaaagatgcagctctaaacaactaaagcatgtacctgtcttaagtgacaaggagggatgacacacctacaaaactttcaataaatcgaaccaacagatgggagcagccagaaccagttgaaagtgcaaatgacggagcatttaaaaaatatacagtgtcattgattttaagtatgttgaagaaaaaaatttaagaaacagtacctgggacttataccaacaggccaaggttaaaattgggttgaagaggagacagggcttcctcctggaagtccttcaagttatcatttcacattggatttgccaatcagcttttcagatcttatctgataattattgaaagccacaggcagggactagaattttgagatgtttctcaaattttcagatgaaagctgtttacctggcccttaaggagattttaaacttattttaatcagtattcaaaagacacaacaggatgaccatccccccatccacccccgcagtctccttctccagaggcatccaatttcatcatttcttgggatgttattttatacatacacaagaacatgctttatatcttccttttcttcattttttacacaaataaccataaactacacatcctattttattttctctgtactcttctttctctcttttttttttttttgttttgttttgtttttttgagacggagtctcgctttgttgcccaggctggagtgcagtggtgcgatctcggctcactgcaagctccacctcccgggtttacgccattctcctgcctcagcctcctgagtagctgggactacaggcgcctgccactaagcccggctaatttttttttttttttttgtacttttagtagagatggggtttcaccatcttagccaggatggtctcaatctcctgacctcgtgatccgcccgcctcggcctcccaaagtgctgggattataggcatgagccaccacgcctcgccttttattttattatcatcatttagttatgaaagccaaagctgagacaaattctctgtactcttaatggcataactgagcgttgatttcatatgaggacacaaagagcttcctcatcgttttttatggcttcagagaattcccttgaatggatgtagcataatttatataaccagttccctacagatagacatttaggttatctccattgtattcctattacaaacaaggttgcaataaataaccttacacataggtcatttcatgtattagctaaagtatcatgtattagctaaattcctataaatgtaattgctgagtcaaaggatatatgaatttataattttgaaagatattaccttcatatatacatatctgtatctatatagtacctgtttccctatacccttgccaatacaaggtgttaacattctgctgtttgccaatctgataggttaaaagtgacatttcagtatcatattcatttgcactgctcttattatgaatgagctgaggagcttttcatctgtgtcataggaagctcacccctgaggacagcatcacctggactccctcctctgataacttctgggaggcactagcaggaggttagcaggtggaaggagagatatctttcccatttccatcctgcttcaaggacatatttctcacagtggctacatcctccatgatcacagccttcttcggatgacccatctttcctgctccggcaatgccgttctctctctttgtccctgccttcaatcccagggatagtaatagcttcccacatttgcaggtctccgagcgtcacaatgtcattccctttttgtccccaaaatcctgccctcacctctgtaagttgccccatttggggagaagaagcatttgtggagaaacctgtttgctattgctttgttttcctgagacactaacaaacatatctcctgcctatttttctactggtttgttggtcttttcatattgatttgtagttgtagcaactccttattcatcagagcaagagttggcaaacttttctgtgaagtgccagataataaatactgttggttttgtggaccataaggtccctgttgcagctattcaattctgccaccatagggtgaaagcagccacaaacaatatgcaaacaaatgagtgtggctgtgttctaataaaacttgattgataaaaacaggcagcaggccagatatgggccttgggctgtagttcccaaccccagcattagggaaattatcttttctctgagatataagctgcaactatttttctcccagtttagttttttacttgtcttatagtggctttgccatgcagagttttaaagatctcttattttacgtagtggaatttatccgtaatttatggcttctagtttttatgtcagagggaaagcaaagagttagtaaaaccacaggaaactcaaagaggaaagactgtaccttaagctagtcagaccatgctaccaccaagagtcttcttaatgagacaactactcatccttctaagacagaattatcaaaaactctttcttaaaaagcaaacgaacaaatgaaaactttcgacggaaggctgagacacaaaatggagcgagcatcctggtgggagccaggacgtacctatccacatgtgcctcgggtaactctcaggccactgtattctagacgttaaaaaacacttctcgacacaaatacgaatcctatcaaaagaaaattagaaaagtgttttctaggtgatcgctgtataaaaatttcacaaatcacccattctatcaggctttgcctagctccaacatctttccgacatcagtgacatgggggcatctgttagagttcttacaactaggggatctctcgggatttccacttcatactcattcttctgttcctgcatgactgtgctccagggtctaaaggctcctagccttagtttgtaatgaatttagtttttgcattctataaatttaaaacaaatatctttgtggaaattttgtaagtagaaacagggaaagtaaaatgttgccaattaaaatacatgttatttgcataaaataggcaagactttcaggaaaaaaacactggggaaaggatgggaaaaagaacaaacaaataaacaaaaattggccgttcaagtctctaccagagtttaatattttaaagtcacaatttcctttccttgttttctcctaccatggagaagcagacacagttataagtgaaggaacaaaacatagaccgtggaaatttggaggtttcagcatggatttgcatcctaaaaaatacaaatagcaatgtgtaataacaatttaaaatctctcttgttgaattacaaaaattatcctggcaattgtagtcggttgctctgtcctgaccaaaacaaagttattcatatttatatgccctcatccccatatacatgcatattgagatgtatattttatttatatgttcatctagatgtaaacataggtatatgcagatatgcacccaccacacttcactatactgtctacaacatgcatattagaaaatgtgtatttaccgaaaccaacatataaaaccaaagtggcaaaggctttggggaataagaaagacacagctctgtaataagtctaacacctgtgaatgatctgtagcagccttcgaaatgtgggattgctgtatccctcaaactgatactacaaactgagatttcatgtctccatttacacaaattgattccataaattctactaagcgccaatgggtaagactcacagcatgtgagatcaaaagagtaggagtaactggcgacagtttagttgagccacaagatgacaaacatcagtcacagggtagtaaggaggggagaatcatccagagaaaagccgtggagaggcgttttctcaattgattaggtcatgctgtaatggagccaagggcgcaggttcagtactctctgccaatgacctatattgtatttcaaagacacagaccaggcccaatagttctcaacatcttgccactagatcaaaagggatatgagaagaagagtggctaagcccaagcttatttcaagtactagaaaagtaacaacattaacgcagcattgattagtaccattgtcttagcgtaagttacagttaacgtccgacatgatctgtgatgtaatagaattaagtaagacatttctcccggctagtattaaactgtatttattcagtcaaccttacaagatcctatcatgaaacagaaatagcattcacttttcaaatagctgtattctaacacgtggtttgcaattaatattgggctgttttggatatttcctgtattacatatacaaccgggatattaataacaacaaagatgaaaacagaagaggatttatgtagctccggaggggttcaataagtaggaacatgacccggattcaagcttcctggcacagacaccccaccatcacagcttattcagaaattaaatacttgtgcttcgccaccacaaacgcaagtgctgccgcttatcttttttctcacgaaaatgtgaccttgggctcagaatggtgctgacccaacgtctcacttctcttagaagaagtatctcaatgaagctgatgctgccgtctgagcactgctttctcgtaggaatttgccaaattaacccaaaatgcagccagccaccaaacagagaaacaatttaagtttagccacgtggggataaatccttctggatgtcaaggtcctcagctggggcttatattaaaccagtagttaccgactccattccccagaacaaaatgactcatggggctcccgtatctcctttcatttgaaaaggtgctgaggtggtaaaatattctgaaaactcctgtagtcattgattcctcagttcttatagagcgctagaattttgtggtctacatgtcactgattgtaacacatcttaatatttgctgcttagaaatatgtttgaaaatcatgtaaaatatcgcacaaatagcaaataactagaagatagatggttgtgtctttttccctctctgatatatataaattctccaagaaccacatggtagaaaaaagacagatatatagtcacgcactgcataatgacatttcagtcaaggacagaacacacatacaatggtggtcccataagattataatactgtatttttactattccttttctatgtttagatacacaaatacttaaccttgtgttaaaattgcctcagcattcagtacagtaacatgctgttcgggtttatagcccaggagcaagagacgatacttcacagcccaggtgtatagtgggctataccatccaggtctgtgtaggtacctctatgatgtttgctcagctatgaagttgcctgaagatgcacttcccagaaaatattcccacccttaagcaacacacgctggacccaccatcctgagggtggaaagaagctctttagagtccccacagagtgaaatgacttcatgtttctcactctctctcctcagtgcggacttcaaaataaaaatactaatcatcaaaagacaaaattctgcatatgctgaaacctacataacagcattctgaagtttctaatagtaagtttcttattagcttgtcccaagttaaacttcttttgtgaaaggaaagtctctgtgtgtgtgtgcctgggcatgtatcccagtgttgccagggccctacgtcgtatgcacacgataagtccaagacctgtagtgggtaaactcagcaatgttcatactctctaagtaggtaacgctaaaggaagagagagaaaaacattcatagcctgagtgatcacataaactgggtatatcagaaaaatcatgacttctggttctggaagagaattggagggggtataacctctcttccaatggacggactcagagttatacctagctcaatctagatggtatgtaatctttattgggaaaaaaaaaaagggtgactaaatacatacgctttaatcataatttgtattcctagatgaaactaccaataaaaattgctacctgcgtatttcctgggcccttatgaggtacactctgaaacactttttctaacactctccaccacaaaattggttttattgctttcatttcatagttgagaaaatgatggattcaaaaagattaagcaatttgttcaaggtcttatgactgataagtcacattttgaggatgggaccccaagtccatttgatttgaatgcccataatcctctaactgcagaaagcttcaagttttctgtgtgttctggaaggcacagctacaaagaaaagctaatatttccctctaaattctacctttatatagctcatcatttgaatttataacactctccagcagtaacaaatacttacgtttctctggattcacagatatatactaaatattttaagaatggagagaaactaagattggaaacaaattaatatgacaggaaaaaaactgtggaggaaaatccatgggaacgtataagaatataactgtaattcaagagccacatactcagggtttgtaaaaattcctaactgcagattaagcagtgaggagctcagcaccttccacaggttcacactccaagccacggagcactcagtggcaccggtctgctctttgggaacaccgttcaattacctctctccatgtaaggacttcgcattattagtgaaccgattctaacacaggaacctcctatgatgtcttaagttcagaatatttctccctgatcaccccagaagaaatcagagctgcgttaatcaatcattctcttacacggtttcctttgtatagaaccactttgcaccctttttggtaagttacctccttcttaatcttcaggactaagctcaacacacacttcaaagcctttctgaacccattctagtatggctgccctgttttgtcttcccccaaccccagaaaccctgtatttaccttcaacaaagctttgaccacacattctctgctatgttttttactggagattaattttttactcattttgttgaggctatttccaggggctctgaatagtggctactcttaataaatacgtaaatatactcttagggataaatgaaaaatcaaatggtccgagtggcctaacacaatttccagaacacactgggaaatgtttgtctcttttttcagccattgtcactacttctttatccccacctctatctacacataaataaacacatgccaacacctgcacttaagtatgcacatgtacacatatacacagcatcgattactccatggattaactctgcttcatctactacctttcatgtaaaaacaagacaaaggaagaaatttaagaatttatgatattcacacaaaatcacataatctaccaaagtctcctcatgcattgcctttattcagactaatatttactgagcacacagtactatgtaaagcagtagaagccaatcaattaaaatgctcatatgttctgaacataaaatgcttcaacacccactacagacattcagaaagatccaaaaaagcaaaattaagtcctgcccatattgaaactatatcttgagatagaaccaacacaaccaaaacaaggtgactattttaagatgaggaatggctgggaacacaggaaataacccaatgggacatgagtgtggctctcagcctttggacagatcatgtgacaacaaataaacacacacgttctcctgcagggcataggtttctggtgaagaatcagtggtgacttggagcaagacaccagatgataatttgataaatgctgtttacctttaaaatgtgattaaacagcatttatgatgaacatgctcagccaatgatgaataatatgtgcagtcaagcacaacagaaagtaattgtctgaggaggtagttcttccctggcagcttcccaaagctctcacagcgtgccttccccttcctcccaaacactggagttggagttagagccctgccagaggagaaaacctggctacagagagtggactggataatgactcgcaccaacagtttcggggatctccaggtacagggaagcctgttcgcacattcacctttaggaatattcaggactcgctctacctgctgcagtgtccgcacgtggttcctggtgtggtttatttttctctcacacctcagtgaggttctttcacagcctctttagtctaagatttcaatttttaaaacggagagagatcattccacaaaatattatatattccagttttcttctaattcaacagttctacgaataaagaccaacttgaactgattcacagtgcatttttataaattaagaggagtttctgtgcaaaaaaaaattcattacctcaatttagttctcagtgcaaattataatgattcctggttcaatttatagaaaatagtttaaacaactccatgtccatacacaccaaaataacatgttctgggtaagatacacaggtgttcatacagtaaacatgagaactccatgtcaaatggagatatcgcatgatgtctattttaccttcagagaaatgtgcacaaactgggtaatgatgatgccagtacaagaacttgcaaataaatgggttgtttgggcaagaaattttgtaggtacgtaaaaccagaactaatttatagatcagtcaggctccgtctcatgcttggcagagaggctagaggtcactggtcactgaggaaaaaaatgcttacaaactgatttccagcccagttagcaattttaccagaactctttattctatcaaggctgcagaagagaggtaatgaggtcccatatgtacaggtgtgcaacaaattaggtcaataaatatgtctgttaaaaatacttaaataggaaaggtaaaaattacttaaacatgataagaaccattcagcaaaattcaatagcagacttaatgctcagtggtgaagtgttaaagccatttttattaaaatgacaaactggactaggataaccattattgactctttataaaatattgctttgagagtataaaatacctaggaatccaacttacaagggatgtgaaggacctcttcaaggagaactacaaaccactgctcaacgaaataaaagaggacacaaacaaatggaagagcattccatgctcatggataggaagactcaatattgtgaaaacggacatactgcccaaggtaatttatacattcaatgccatccccatcaagctaccaatgactttcttcacagaattggaaaaaactactttgaagttcatatggaaccaaaaaagagcccgcatcaccaagtcaatcctaagccaaaagaacaaagctggaggcatcatgctacctgacttcaaactatattataaggctatagtaaacaaaacagcatggtactggtaccaaaacagagagatagaccaatggaacagaacagagccctcagaaataatgctgcatatctacaactatctcatctttgacaaacctcacaaaaagaagaaatggggaaaggattccctatttaataaatggtgctgggaaaactggctagccatatgtagaaagctgaaactggatcccttccttacactttatacaaaaattaattcaagatggattaaagacttacatgtcagacctaaaaccataaaaaccctagaagaaaacccaggcaataccattcaggacataggcatgggcaagacttcatgtctaaaacaccaaaagcaatggcaacaaaagccaaaattgacaaatgggatctaattaaactaaagagcttctgcacagcaaaagaaaccaccatcagaatgaacaggcaacctacagaatgggagaaaatttttataatctacccatttgacaaagggctaatatccagaaactatgaagaacttaaatttacaagaaaaaaatcaaccccatcaaaaagtgggcaaaggatatgaacagacacttctcaaaagaagacatttatgcagccaacagacacatgaaaaaatgctcatcaccactggccatcagagaactgcaaatcaaaaccacaatgagataccatctcacaccagttagaatggcgatcattaaaaagtcaggaaacaacaggtgctggagaggatgtggagaaataggaacacttttacattgttggtgggactgtaaactagttcaaccattgcggaagacagtgtggcaattcctcagggatctagaactagaaataccatatgacccagcaatcccattactgggtatatacccaaaggattataaatcatgctgctataaagacacatgcatacgtatgtttattgcggcactattcacaatagcaaagacttggaaccaacccaaatgtccatcaatgatagactagattaagaaaatgtggcacatatacaccatggaatactatgcagccataaaaaaggatgagttcatgtcctttgtagggacatggatgaagctggaaaccatcattctcagcaaactatcgcaaggacagaaaatcaaacacagcatgttctcactcataggtgggaattgaacaatgagaacacttggacacaggaaggggaacatcacacaccggggcctgtcatggggcggtgggagtggggagggatagcattaggagatatatctaatgtgaatgatgagttaatgggtgcagcacaccaacatggcacatgtatacatatgtaacaaacctgcacgttgtgtgcaggtaccttagaacttaaaatgcaataaaatatatatatataaaatatatatattttatatatttttttaatatatatattttgctgatgtaagaagaaattttatatacatatatgtagcaggtgatctttatttacagataagattacataatttgaaaatccaactttaataaaaaatccaactctaataagagaatgtacttagatacaaagatgtaagacaaatatacaaagaaatcattagttttctctgtaccagagataaacagctagaaaatcaaatgaaaaatattttataaaaagtagcaacttatatcaaatgccacacagtataaatttaacaacaaaatatatataaactctatataacaaacagaaaatattattgaaagatataaaataccatatgaacaaaaagataaacatatgttcctgaagaggaggttactttcttaaaatgtcatgctttctaaacttaatacatacatttaattccatatattccaattagaatccagtggtattttttcttctccaacttggtaaagtaagtttaaagctcatttgcaataatgtccatacagaacagtaaagaaaagtgtgcaaaagaatagtgggagtggaattgtcttgccagataccaaacttactacaaaccatggggaaaaagaaaagaaaagagaatgattctagaacagggacagaaaagttgaacaattaaccagatagcacagaaaaaagccaagtgttatgataactttaagccaagtgttaaatcactcaattgtgacttttcaattgagtggggaaaagaaccatttgtataataaaaaggcattagcatatgtgcatctccacctgtggaaaaaagaaagctggattgtattacctcaaagcatacacaaaagaatttctagatagactaaatatctcaatcttaaaaattattcaccagcctgggcacagtggctcatgcctgtaatcccagcattttgggaggctgagggagtagatcatttgagcctatgagttcaagaccatcctgggcaacatgatgaaactacatctctacaaaaaacacaaaaaaatcagccaggcatggtggtgtgtgcctataatcctaactactcagaaggctgagacaggaggatcgcctgagtcaagggaggtcaaggctacagtgagccatgatcctaccactgtactccagcctggcaacagagtgagaccctgtagcagaaggaaaaaaaaaaaaatgtgaaaataattatatagctttgatataagcaaagatacccacgacaggaaacccacagggcattttttaaaaaaacctacatagtcatattccagtgtaaaaaatgtaaaatttgttagtaactgaagtcaagagacaagtgacatcctagcgaaaatatccgtaaaatgttgaacaaagtgttgatgtcacaaagaacacctataaatcgataaggaaaagaccaaaaattcaccatgaaaatgaaaaaatgaatagtacacgtgaatcacaaaaaaggaattgcaaataaccagtatataaaatggtcttcaacctcaagaacatgcaaactcacgttagttaacactatttacccagtagattggaaaaatatttcatttcaagcatttcactggtaaaatacattgtgggtgaaattataatccattacaaacaatatttcttggggaaatttggcaacaccttctagaatataaaattcacgtggccttgaagaaaagaaaattctactttgaagagccttttcagtcaaaataaaagggccagtgtgcaaagctgtatgcactagaatgtctatcgcatattttagtgacaaaaaagtaaaaatactgggtccattaatggggcatgactgaatatatcacattacagccatttctacggaacataatgcacacattatgcaaaaaaactgtattttgctgcagtgagatgtaatatagtatacagtagtaagggctctagaggatggaagcccgacagcccattccaagtctgggcttcaccacttcctaaccttgtgaacttcagcagcctccttaagttctctggacccgtttcctcatcagcaaacagggagaatgatagcaacttcacaaggttattgtaaggctcaaatgagataaagtatttaaagcaaaaaaaaaaaagtgttcttaaaatcaatttcaagaaaattaagtcacaaagtaatgtctgttgtgggattccttttttgtcaagataacagatcttatctcacttaccattgcctgaacaaaccaggacattgtccatctgggatggtttttgtccaaacaggaggcgatagttattaattaaggaagcgagactgggtttggactgtggcatacgacgagaggatttggctagttcttagtaaaaggagaccatagcaggcatgcagcattatgtacagatgccctaagagactgagaaacaaggaaaatggggttggaggcattttgaggggaggagcaagtgtgagcatgagcccaaccctgagatccttcaagagcccagttctagttgcaggccacaagtatcctgacaataaacgactctgtgcttcttagactctgcaaggggaagacttatcaaagccacctcacaaaaaacagagtcgttaaatatatactatgtgttttttttgtttgtttgtttgtttgttttgagatggagtctcgctctgtcgcccaggctggagtgcaggggtgcaacctcagctcactgcaagctctgcctcccgggttcacgccattctcctgcctcagcctccccagtagctaggactacaggcgcccgccaccacgcctggctaatttttttttttttttgtatttttagtagagacggggtttcaccgtgttagccaggatgatctcgatctcctgacctcgtgatccgcccatctcggcctcccaaagtgctgggattacaggcgtgagccaccgcgtccggcccatactatgtgttttaaacacaaaaaacacagtatgtatttaacagacgtcaactgcgctgtgccagttcagctaggctaggcttctgcctgtaactgaaaaacaaactagcatttcaagtaaaatgagtaaaaaatataaaaacacattgtaaattatcattttctaatacttaagtcagcttatgagattcctcccacacctactcagtggctcacaaaccctcggaaggaagaagcactgcataacccatctcaatgtttcagtcattacttaccacttcaatagcccactaataaacagtggtttccaccaagataaaatatacaaatttttcaatagacgtagtaaatactgaacaaaagtaaacagaagttgactataatatcaaaaagcagtaccatttagtattagtctgaaagcaactagtgaacgcattaatataaccaacaaacaacctttcacgaaatacttagagattagggccataaactacaagctagtgttcttttcactttgaaatgaaagatcagaggttccatataggccttaattagactcatagtctagaatttttctttctttctctaattaagaggatcacgcaaaaacactgaagtagtagtgccaagatgattccagccaggtagcccagtgcaacacacacaaaaatagttcacagagataatgttacccaattatgaattcagagagactcaatgtacaacatatttcttaagacacagctacaagacagagagtagggcatcatccataaaaggttgggcaaaagatgagggcctcaaagccaggccaaactgggtggtttttcacctagaataatataaggtagtctgcctagaggaacaatctctatcactgttgaggaagaaagccaaggtatataaatgaagaagaggttctaagtgtcaggtccaacgtaaatggtgaggtcataaaaagcaaaaggaatttctaggccagacatgatgaagatgagaaattaaggggtatgaagataacaaattgggtctttgtaagcaggttagaactaaaatggtgaacgctgagactgccggaagatttttgttgtgttgtaccagttggatagtgtgtttgtttgattatgcaggtgcacacatgtatataaacaagctgggaggtagcgagctcctcccaagaggaggtgtaagtttcatggcttaaaggagtcaggcaaaaccaatgttccacctaatattaactatcaaattatattttaatattgtcccttactgaataacaattcaggattgcttgggaccaatagtaaactgattgaaaaaattatccaaatggggataagctatgaatgttactaggatcatatgatgagaggtaaaaggatgggcaaattcaaggctacagacacaacttgattcagaaaatatgaaattacgaagaggaagacataccaagtactattctttggaaagatgagatgtttgttaagcagagcttaatattaacttctttttttttcttactcctttttttttttttttgagacaaggtcccactctgccacccaggctggagtataatggcgcagtcacagttcactgcagcctccacctcccaggctcatcacctcaacctcctgagtagctgggaccacaggtgtctcccactatacccagctaatttttatatgttttgcagagacagggtttcaccacattgcacaggatggtctcgaactcctgagctcaagcaatccacaagcctctgcttctgaaagtgctgggattatagacatgagccacctcacccagccaatattaacttattttttaatataacagactagggagtaacacagaagttggtcctcatatctaaaacagagtaaaaatactcttgactatttacattcaaataatgtaactaagactaacatgagtcactttccgttttccaatcaatttatagattaaatgcttatacctgacaccagaaaaaaatagcaattaaactgtaggccataaaattaatttcttctgcagtacaaaaaaaaaaaagaaaaatgtaatttcatttctttttgacctagattatgccaattgcattagatgttttatttcccatatgtatcagaatgttcaaatagtatataggctactaaaaagaatcattcccaaatggtactctccccaaacaacaaacttctcttattaatcatgctgaaactgtatgcttacaaaaaaagtgagcaaaattggaagcaagagccttccaaaattaaatgaccaactaaatcagataggcagatttgaatgttttttaatcaggcactgctggcatgatcacaacatttaaaatacccaaatgattctacataaatctaactcatcatctttcttacaaaaagtccagagctctaatgaagtccataatgatctggataaaatacacttaattagattataaactgcaacataaaacggctgcatcatgccttttaacatttttctctctgaagatcagaggattgaaagggggttataaaacagcccattcatttttcttgtcttttaaaggaaggaaaaaaccattaggcagaactaaagttccagacaacttttaacaagtgacatccaagtaggtcacattcttagacctcctcagagatgcagggaacgatgatggggtcaggtgaccaacacatcaatgggacggcatgtgatcagacaactctggggaatgctaatgatttcctatgtgatgctgatagtacaagatgtactttatgcttgatgatatctagatgagatagataacaggaaaaaaaaaccaaggctaattaaaatgcatttcaaagataatcctaacatgattttctaatagtacgcaagtccactgtgagtttgagatggtgaattaaagacgaatctattcatccacagatacatctatccactcatacaatttatgtgtttatttttggttgagggagacaggaggtgagaaacaagcatgcaacaattgctaaaaatgtctttaaatatttatctacagaattctcaaatgtgttatcttgactactagagactaagagcatggcctttggagtgaccagatctcctttgaatcccagttccaacatttgttggctctgtaacgctcaggtgcagttatgacatctgaacacagtgagaacaatccatgttcaggaagtaattatgggagattaagtgtaaggcactttgtactttgcctgtcctagaataggtgttgcatacattaaatcacaatcaaaacagacaagcacatttgggataaactaaataagatctctaaataaatgaaagggccagcctcagtggctcacgcctataatcccagtactttgtgaggctgaggcaggaagatcgcttgataccaggagttgaagaccagtctgggcaacatggcaagactccatctctaaaaaataaaaataataataataattagccaggcacggtggtatgcacctatagtcccagctactggggaggctgagatgggaggatcgcttgagccctggaggtcaaagtgagaccctgtcttaaaaaaaatttttttaaaaaaagggacataccatgttcacgattcaatattaagatgtcaaatctcccctaagtgatctacatttcacaccatttcaatcaaaatagcaggctttttaaaaagctaacaagctgattaaaaaatgtttatgaaaaggcaagtgaaaatagccaaatcaattttaaagagagaaaaaaaaaagttagagggcatacactacctgatttcaagatttactaaaaagctatactaatcagaatggtgtggtactgaagaaaggatagaatagtgagtccagaaacaggcctacacaaacatgggcaattgatctccaacaaagatgaaaaggcaatttaatggagaaaggaaagtctcttcaaaaaaatgatgcaggaacaactgtatatttgtgtggagaatcaagaaaacccttatgccataacatattcaaaagttaattaaaaatggattatagttgggcatggtggcaaatgcctgtattcctgctactcgagaggctgagacaagaggatcgctttagcctgggagttggaatccagcctgcataatgtagtgagacccgatctctatggaaaaaaaaaaaagattataaattgaaatgtaaatgctaaaacagaaaactcctagaaaatatttgtgactttccctaagaaaatatttcttaaataaaagaagaaaacacaaactataaaagtaaaaattgatcaaatgaactttattaaaattaaaaacttcggctcttcaaaagatgccattaagaaaacaaaaagacaagtcacaagtaaggagataatatttgcaatgcatatctgacccaggacttgtatccatgtcatataaagaactcttacaactcaacaacatgaaaacaacccaaaataatataggcaaaagattgaacaaatacttctcaaaagaaaagatacaaatggcaaaaaagcacttaaaaagataagcagtagcattaactaattagaaatgggaattaaaaccacactggactgccaccgagcacgtattagaatggctgaaattaaaaagactgacactaccaggtcttggtgatgatgcagagcaactggaactctcatatactactggggggaacacgaaaagtcacgactacttcagaaagcagtcttgtagttttttataaagttagatataatactaaccatataacgtagccactgtgaccacagatattttcctaagagaaaacgtatgtcatacaaagatttgtacatgaatgttcacagtgaatgtccatcaggaggttaatggataaataaaatgtggtatgtctacacaacacaacactattcataaacagaaaggaatgaattactgataggtccaataatatgaatacatctcaacaccattatgctaagcgaaaacagttggatgtaagggtacatactgatttcactttatgtaaaatgcaagttgatgtacagtgacaaaaaggagatcactaatcagctggggctgggggtgggtgagggatagactgaaaaagggtacaggtacaaagaagatatatagatggccatttttatgcacataaaaagatacttaacattagtaatcattaggaaaatgcaaattcaaaaccatgataaaataccaccttaacactcattaggatgactataaaaaaaaaaaaaaaaaaaaggccaggtgcggcggctcacgcctgtaatcccagcactttgggaggccgaggcgggcggatcacgaggtcaggagatcgtgaccatcctggctaacatggtgaaatcccgtctctactaaaaatacaaaaaaattagccgggcgtggtggtgggcacctgtagtcccagctactcagtaggctgaggcaggagaatggagtgaacccgggtggcagagcttgcagtgagccgagatggtgccactgcactccagcctgggtgacagagcaagactctgtctcagaaaaaaacaaaaaaaaaaacaaatgttggcaaggatgtagagaaactggaagccttgtgcgttactggtaggaatgcaaaacggtgcagctattgtggaaaacagtctggcagttccttaaaagactaaacacgagctgggtgcagtgatacatctgcagccccaggtactcctactctgcaggctgaggcaggagactcatttgagaccaggagttcaaagccagcctaggcaacatagcaagacctagtctttaaaaataaaagaagacaagaaaaaattttaaaaaataattactatatgatccagcaattccacttctgggtatataacctgaagagctgaaagcacagattcaaataggtattggcacacctttgctcgctgcagtactattcacaatagccagaaggtggacataacccaaatatgcatcaacagatgaatggagaaatcaaatgtggtatatacatacaatgcaatattattcagccttaaaaaggaagggaattctgatcaatactatcatattggtgaactttgaagacattatgctaaattaaagaagttagacacagaaggacaaatattgtacgattcaacctatagaagtacctagaattgtcaaaatcagagagacaggaagtagaatggtggttgccagaggctggggcaaaaggggaatggggagttatcatttaatgggttcaaagtttcagttctggatgatgaaaaagagttctggagctggacagtggtaacgggtgcagaacaacatgaatgcacttaatgctactggattgtatacctaaaagtggtcataatggaaaatttcattatatatacattttactacaataaggaaatagtaaagaaaaaagtggcacagaaatattttggaagtaatggaaatgttctctatcttgattgtgactgtggcttcatgggtatataaaactgtcaaaattcatccaattaaatagattcatttaactgcataaaattattgctcaataaagttgatgaggggaaaaaaagacactagcaaattagcaagaatatattttatgcctctcctccctgcctttcctcatttcatcctgcaatgcctaccagttttctatttcataggaagcaggagaaaaagaaaaaaacggagggagtgcgggcagggggacattcattcaacaaatacttagataacctccatttcatatgttactccaataagcctgagtgttacaggtttatggatgaggaaactatatgaagtttggtatgaagtcgtttatccaggtcacacgagattaagtggcaaagctcagtttgtaaccaccgtgtttctaagccttcacaaatgtgcattgtaaaaatgttctccctacgtgtgatttcaccagacctacatacatgaggggaaataacaagaggcaaagccatgaaaattgtgcactatcaacaagataaaaagtgtggcaaaaatgataaatgttcaagctgatggatatgctaattaccctgatttgatcattatgcattatatacatgtatcgaaatatcactctgtagcccataaatacatgtaaactaaaaagaaaaaaaaaggacataaaatgtgtggaaaataggtacttctgttcacatttaaggacttcttgcaaagagttattgaaacctttgtcttttgtaatttctccttacttaacaattgggcacacagattaagaacacacactccacagtcacacttcccaggtcccgtcctactgctgtgacctgacgtgatctccctttgcctcagttttctcaactgcaaaatgcggattataattgtaactatctgggcacagtagcacctgcctgtggtcccagctactccggaagctgtggtagaaagatctgactccaagttcaagtccatcctcggcaacacagtaagacattgtctataaaaataacaataataataattgcatctacctcaaagggcttttgtgatgattaaataatggatgtgaagtgcttaacatagcgttagaggcatacgaaattctcaataaatattagccttcctcttccatatagtctacctataacagctatggtctatctgtaatagctaggtacaggtagagttacatgcagaactgaaaaagaaaaagctacttttacaggtagtggtttgaattcactaatgttgtccttccttccttctttcctccctcccactctctctcccttaaaatgcattgctgttcctcaaatatagtttttgcattaaaaatgtatgatggatacagatggcaaatacgcatatgaaaagatgctccacatcacatgtcatcagggaaatgcaaattaaaataacaagaagataccactacgcacatattagaatggccaaatccggaacactgataacaccaaatgctggcaaggatgtggaataacaggaactctcgttcactgctgatgggaacgcaaaatggtacagccacttgggaagacagtttggcaatttcttacagaactaaacatactcatcacacaatccagaaatcttactccttgttatttacccaaaggagttaaaaacttatgtccacacaaaaatctgcatgtggatactgacagcagctttattcataactccccaaacttggaagtaacccagatggccttcagaaggtgaatggataatcaaattgttgcacatccagacaatggacaattatttagcactaaaagtaagtgatgttatcaagccatgaaaaggcacggagcaatcttaaatgcatactactaagcgaaagaaggcagtgtgaaaaggctgtatgatcccgattatatagcattctggaaaagataaagctatggaaacggtaaaaagatcagcggttgccagggatgagagttgagagagagatgaacaggtgaggcacagagcacctctgtataatgccataaaggtaaatacatatcagtattcatctgtccaaacacggaatgtacaacaccaagagtgaacgctaacagaagctgaactttggtgataatgaagagtccatggaggttcatcagctgtcacaaatgtcccactctggtagaggatgctgagaatgagggaggctgtgtgttttgtgttggaggtgggggaggagggcaggagggatatgagaaaactctgtaccttcctctcaattatgctgtgaacctaaatttgctcttcaaaaatcatctttttaaaaaacatgtatggtggaaactatgaatgatgaaagaaaaccccattcagtaacctgaagcagcacgttatcttacgaaataataaatgattcatttatctttggcagaatcgggtcattttcctgcctttctctttctagggaaataaaaattttacactttctcaaacatttggaagattgtctttcaaaagccagtacaaggaagcttgaggaaagctttttatagccaagtataacagctggcagtctagaagccatatacaacattttgctgttctacagaacttatagcagctcacaaaagcaaaaccatttttattgaggaaacaataaaaattgttggaaattttcaaaattaaatagtatagaaggacttttattgtaataaaagtaatctatagataatgtttctcatagttaacaaaggtgcccatttacctactcaaatccacatttcttttttttttttttgagacggagtctctgtcgcccaggctggagtgcagtggcatgatctccgctcactgccagctccgcctcccgggttcacaccattctcctgcctcagcctcccgagtagctggaactgcaggcgtccgccaccatgcccggctaaatttttttgtatttttagtagagacagggtttcaccgtgttagccaggatggtctcaatctcctgaccttgtgatccgcctgcctcggcctcccaaagtgctgggattaaaggcgtgagccaccgcacccggcccacaactccacatttctaatggactgcaaattcaccagcggtaaaagtaaacgagggaggcaatagatcctttgggtctgatgttacagccaactcaagtggcaggcttttgctagattttctaagccagcagaggcagggataataaaacacatttacctagagaaaaaaaaaaatcaaattaagatgactttaagtattctatactaacagaagaactattaaaagtagttaaatccattgttctgaaaaactgaacagagatatgaccaactggaggtgttttgtctctctcgactccactggcactaggacctttttctcctattttattatcaagcatggtgagccagccattgccatgcccaagtgctgcatatcttgtgagtctaaactgaaaacaacatatctcagacgttatcttagacttgaggctgaggaacagatggatttaagaaaaaaaaccattcctttccttttaaaaggtcttaaaaacttttgagaagcttcaggaaaaaggcaagtaagatacgattattttgtggcataataagatttcattttctgaaactcaatcaggagaactaatgaagaagaaatgtgccccttgcttgtggaagccagcttaaactggtaagagcccaatcactcacagtatttgttaagcaaaatccatttatgttggaacagtaggcatttaagcattaatatgaaagttaaaatagagaagacagtacagaatacttaagttacaatttcaaattcgacagtgttgacagagctactccagagaccactaaatatattgctttaaaaaaaaaagttggcggggcataatggctcacacctgtaataatcccagcatattaggaggccgaagtggaaggatcacttgagctcagactcaggatagaccagcctgggcaacattacaagaccttgtctctactaaaagaaaaaaacttagccaggcatggtggcacacatctgtagtcccagctacttaggaggctgagatgggaggatggcttgagctcaagaagttgaggctacagtgagccacgattatgccactgcactccagcctgggcaacagagcgagactgtctcaaaaaataaaaataaaggttgcgtttttttttttaaacattatatatctgagaagatctccatatataaatatttcattttaaacagctaattgaaaagttccatacatttatatgtgagaacatttcataaggttttaccttatcctaatcatatcttaactctaaatattccgtttaacgacaaaaatggcataacattcccaaagcagcaaaatgtctttcttgatttctgaagataaaaaaggaaaaaaatagaaaaagcagaaaagcaataaactgttattcattttaataaatttttatgatccctcagtcattactaaattggatcatatgataatttctcctttggttatcatttttattgacaagttttcagctgttttttcttcatttgcaaaatgagtcctagatctcatgtctggcataatcactcagctcccataaagaaagacatccaggacccactttatcttcatgttacttttctaagccagcccatcaaaagtctgaggagacagtcactcttactgctactgacaataccaactggtttagtgtacactaactggctgactacacacatctattccttttcattcctaacagaatgctgattttattcacatattcattctcattagaaataaatgttttaggccaggcatggtggctcacgcctctaatctcagcactttgggaggccgaggcgggcggatcatgaggtcaggggtttgagaccagcctggccaacctggtgaaaccccagctctacaagtacaaaaattagccaggcgtgctggcaggcacccataatcccagctactcgggaggctgaggcaggagaacggcatgaacccaggaggcggagcttgcagtgagtcgagatggcaccactgcactccagcctgggtgacagagcaagactccgtcacacgcacacacacaaaaaagaaatgtctcaagtgcttaaattcttgtaaaaataactgcaaaaagatatatgagtaaggactggtaggtaccatatgactatttcagcaaacacatatcacctggaaaaaatgtgctgatagagtttctttaggatcaaatgcgtggtagggaaatccacatcaagtccaataaaatggtaaaagaaaaaaagaaaaagccaggcacagagactcgtgcctataatctcagcactttgggaggctgaggtgggaggatcacttgaacacaattcaagaccagcctgggcaacacagcaagacgccatctctacttaaaaaaaaaaaaagaaaagaaaaattagctagtcatggtagtgcatgcctgtagttccagctactcaggaggctgaactgggaggatcgcttgagcgaggctgaggctgctgtgagccacgatcacatgactgcacccagcctgggcgacagagtgagaccctgtctcaaaaataaaataattttaaaagttaaagctaacaaaatatacacaaaaacccagaaacagtgatgtgaaagaagcttttgattcgttagtgatgaaatgagagctgccttgatagaccggcactattacaaagacgtgcattgcctgatcaagaggtggtgcttctcagagtttctaaaccaaagattgaattcttatttttcttcatggagggaaaaaaggccacaacgttacaatataaaaatctgaaaaagggaagtgaattgatttttcatctaacttaataaaatgacttatttggctgatatttccttaggatctcaacaacctcaagccaaaacttcatagtttttcagggcagcacaaacgaatcccacaggttaaatgaagagctgctcattaggactgagaatcaggaaagagccttagttcatccacatgtgattcattcacatcattgacttaaagatcgtcaccattcattgttcctgagtggggagaaaaaaatccacagaatatttccccgagatcataaagaggttagtcactgatttggggatctttatagtctaccatttgacaatgacttggcctttctgcgagaaaaaacatccatcaggagtaccactgaaaatgtgctgaatttagagcacctctccacagtgactgcaattacagaactcctaaatcactgaaaacactctgaatcttggttttaaacatcttgtgacaccagaagaggacaaaaattgtcctagtgatgatgaacctaatatgtggtgtgtctgttttggattacaattttcccaattacaaatgctagtcatttggaccactaacccaagaatgccttggttaatttctcaaggacaaaatgtttacatattgatatattttaacatttcatttttgaaatgaatgctattttatttttcaaaggcagatgatgtcttacctacccagtgtatttataacccctttgaacacttgacccatattcctaagcatccttatggcacttaaaatgcctaaccagttccaaatgttcaataacgtttcagcaaatgcttgctgaatgaattaattaatgagcgaaggtatgttgaaaaaaattagattttcctggtaacttaattttgaaatagaaaacatataataataaatgctagctcaaaataaccctagtaaagcaatataagtgactaccttggaaaacttacagcagaatgcatcactgctcccactcccaaacctgctaccacttttgcgttctttatgctatgagaggtaccactacatccacagctgactgcatcaggaagagcccaagaccaccttcagtttcagttatctactaggcagactctcagggctcggcacacagtcgtactcacagctgcagtttattacagggaaacaacaccaagcgaagtcagcaaggggaaaggcacatggggagaagtctgtggaaacagagtgggagcctccaagggccttcccccagggagtcacaagggaggcacttcactcctcctacaaaaagctgtgataacgtgagaaatgtcccagtcagggaaacccattagagactcagtacccagggtctttattggagttcaatcgcctgtaggcagcctctaattttggactcctggaaggacagcaggggatcagcataaaccataatgttgacacaaacagtttaggcactgtcagccactcttaccagataagggggaaacacttgctgaaatctcagttgctaaatgtcagccaagggccaaacttgtgggcctgcccttccttcctttcctccttccttcccttccttcccttccttccttccctccctcactcccattccctcccctcccctcctctcccctccctctccttcccttcctccctctctccctccctttctctctctctctcttaacagtcttcctctgctgcccagactagagtgcagtggtatggtatcagctcactgcaagttccacctcccaggttcaagcaattctcctgcctcagcctcccgagtagctgggattacaggcgcatgccaccatgcctggctaatttttgcatttttagtagagacagggttttgctatgttccctacgccagtctcgaactcctgacttcaagtgatccacccgcttcaacctcccaaagtgctgggattagaggcgtaagccaccacgcccagcccaggtcttttcaaggataagcagtttaggcctgctaggttaactcttttctgcacagcgactaggccagaaaccaagaaataatcccaattcctacttcttcactgtccctcatctcttctaggccaaatcctgtcaattttgctcctgagtaacttccctgtactcccttcttcctgtcctcactatcgggctttaatggaggcctctgttctctcttgctcgcatcactgccggaactcctaccttgtctcctgcctatccttccatccattctccacaggctctttgccgggaaggctgcccactgccctcaacctcccgagcatagtggaaaacagggcctttttctgatgtgcccaagttttctctctaatttctcaacactttctcccttttgtactctctgttctagtcaaactgaactattaaatgcagttctcagaaagcatggcactttcttacctttgtcactttgttctggctacttgtcctctacctagaatgcatttccacttttgcctgggttaagaagtatgtaggctttagaagtcagctgaggcaccaacacaaatcttccccagatatccccgtctcccagtctaatacctcatgcctactcccctccacggcatttatcccactgcactgcaatttcagtctattttattgatctatcccctatactgtgtgtccttaaaggtgggactgcgtatccccagtgtctagcatggtcactgacaaattgttcatgtccaataaatacttcttgactgaataaatgtcacaacttcagcagggttcccctgaggtcagctccatcccccggccttctagaccggactgaacttagacgattttggcacagacactgggaaccgtgcatcgttcatgttatcctctttgcattggctttgttcaaaagctaacagccaaatatgtggtggtcttcctgtgaccgtgtaggtctgcagagcctataatctgtatactaattacacttttggtttcgacttaccttccccaacctcttactctgattacttcacttacactttatttgtatctttgtgtgtgtgcatggttttttccaaagctgaaattccttctggactaaagcaggatataaatagatatgtatatagtcccaaagagatgagaacactgtcccattgtttagaggaggtgaaacctcagtttttctcagtatcccattcctagctaaatccaaagtctcctaaagcacaacttacaaaaagagctattttcctcctagttcttcagctcaacttcatgcaatgaagttactctaaataaaggaatgcatacgtgcacccatattttcttcacaagacttaggagcaagactcaaaaaagtgaggacagatgcgcgccttactttatccagtcaatgtgctgctgaaaaactgggtaaaatgagttgtttaaatagaatcaaaatgtcagtttactagagatgctcactacttacagaaacaccacggcaaatccatgaagtaattatggggtgaaagaagtaatcaccctaaaacttatctgccttgtaatcccagatttacaggctgaggcaatgttaaagtatgcttattagaaaaccctcaagttctactgtgtataaacatgcaatcctcttcgtttgtttcatcacctataaacgtaactcaagttaataaccagccagaaaattcaaattaatattaaatactgaaacactgttatcaccaaattcacaccagaaattattagcacttcaaatgtgagaatgttctcaaagccctgttaattccttccttctacccctacttgacagacattccttgacaacctcctaagtaaaacattccttctctacatgtcaatagattccacctaagaaaggcaaagtccttgctgtcaaggaacttatagccacgtagagttcactctttttgttatatctgttactaacatgagacttttttcttctttaatccaaattttcatttcatttttttctcctttacatctgtttttgttgtaaactgccactcaggagataactttcattaatttgccttataaaatttctaccaaaaccaactaaaaggacaagagaacatagaagaaggacagtacatgcagagttttaaaaaccttaaggaagattaaaagctcgtcaccacataaatgtctaaagttattactaggccctaccaatttgaactttgggatgaaaactccttatgaattcattacagatttgaatttttaaggcaattcagttcaactcatctcaagtacgaacacagtcattcaaaccgggctaataaaaggcagcttagtggacatcctaaaaggttgaattttcatgaattaacagattggcaacgagcttctcaacaatttggatgtaaacaagacatttagaaagctgctgaaaactgtttcttcatgtaggttaagaattagtcttccaatattttttacattacaattcttatttttcaaatttttttttacaaacagtgaaaaggtagtgtgtctaaaattctctgcactgctaaataagtacagattgaaactatcttataaatgaatttgacaatgacctgtgacctagaggcaaaagcagacagtgctgtttaagctgctcagtaaaatttgagctaaactcgaaatgtagaagcaaatactttctagaacacctgatagatcaatgttttaaaatccttgctaattgcttaagttttcattcttttgtaatctgctccttgtgtgtacttaacctactcacaggtatttatgttaattcattagatccctcagggtgggccgggcagactattatctgaaagcactggtgcatagcttcctgggtcagggacaaataaatcttttcatataattgcatgtcgttttatgtgttgctgtcttcccactgggaaaaatgttaaaatatttaaggcttactatctggtgtgattgtgattttataattaaagtctgggacaggaggagagagtggcagaattcagtactttatctcagtaggaacagtctttctttgaagcggtaaacttttagatagtcaataaaagtaaaaattccggtgaataagagctggtagagtccttttgaagtcacgtaccaccatttgatgacaatctagtttaataaagatagagctaaaagaataagaaggactgtatatgtcacaaagatcgtgattctcttcagtgataaaatcaagtaaatattgtcatcaagctaaaatatacccaattctaatacagcaactgtttacctatttccaaatttgtctacataccagacagccagtgggggagaatggttttattttgttcttaattagaacagtatttggagctggaactatctaatgggcaagtaagccaagcattctctcatccactcactcccttcagcattcttctcttacccctatcttctggaccaaaaaataaaaagtctagtcaggaagtggggagtgggagttgcgggacaaggtatgagttggggagagcatctgggttttatcaccaggtgtgtcaggatttgcagtttcttgaaaatctaaatcttcaggttgctgtgcagacttgtgcctcctggtacaaataatagctgcgcccacacacactaatgcccccccacagcccacagccttggggcgctccaaggagagtgagttcaataccagcagtaagggcgactcgctcctggacgtgaatctagcatgcaagatcattttcattaaacacgtaactgcacagcgacgatttacatctcctcttatttcctttgaatgagaagcagacgcataacagcaatctggaatagaaagtggagcttttacaggctgttgtatgtgcaccaaggccgggagaggctgaggtccgtcagcatcatgtggcaggaaaaccgcaaatagttcgaaaggccacactctccggcaccgactgagtagctgctgcaggaagggggacaaatggtcctcagcaagaccctcttcagaaggaacaagagaccgtgtggagggcccatgagaatgaatttgtggtttgcaactggtttgtcatgtctcaaaataagtaaatccagtatgtgtgactgtttagaaaagcagttaagggcggttgagtctttcttggttaattaagtgattttcatctggaggtatgtttggaggaaggagcctcctggaaagtaggatcagaaagaagtgtttagtgtgaaaaaatcagttccagatgattttgtgtatatgcctcgtgtttaaattcagactgttaagtctagacactggaaatcaaactacaggtcagcaaaaaaaaaaaaaaaagaacacccacgcagcaaaaagctgtcatttcactgccacctctgttaaaagggtacaaatatgctatgcttgcttcaaatctatgttttataattctcttctttataacaaaaagtcttctgacaacacaatcaaaaacgaatagtcagaagtaatgatgatctaaacctaaatggttaaagtctttgctgatggatgcagagctcaggagggaggctatgactgggagggggcagaaaggctgagggaagaacaagaacatagagacggagcgcagggtgcctgcaacctgctaccagtcaaacccctaccacagtttcctcatctcgacaaaaagcataatcaggtacatgagtttactgttcataataatgaactacagaagcatttgttattgttacactaataaaaaccacaataaaaaatactactcttattagtaacaaatcaaagaacctccttaatatgaagtcagtgtgaatggttcttggaggggagccagttccgcaggcataacagccatccttttgcaaagccatcaatccagaattaccagtcatacctccaacttatgccttaccttaccccttatgtcttaccttatgcttctgctgaaaaagcgaatgaaaagctggtctcccttttcaaaaatgaaaccatcaaaaaccaacatgggaaggagaagaatcactgactaggatatgtctgtgcagaaaacaaggtggctctcatctgaaaatataacatgacaaaggcgaccaactacatagaacatcatttagattctctccaattttgagatgctgtagctggagcacagagataaccgcccccagtcacacagcctgtctgcttctggactctgtattcttagtcatgaccttgtagctgccttatcatgttctaccataaaaatgaaaattgtgaaacagaaaatctaaatcaaaatgttttaatttgtaataaaagaaaacaaactgagaatctgcaaaagttgtgaaaattttcttctgtgtgaggaaagcttcgtgccagatatcttaaactcaacataaatatccaacacatttcacataaaacagaacaatactgccatggtaatgacgctcctcagttagacaaaaatctcaagagcaggcctgtctgctgatgttcatcactaacctacagtgtatgtgcatttgtttttgccaataaactatgctgttgccagagattaaacataagttcctaaatgcatgtatgattgtttgtaattacttaatattaataagccgaactgataaacacaatcccaaatcaagaaagaaagccaacataaaacagaaagatggcattgctaaatcccggaagacatcacctcgagcttttcatcatgccactttgaagttcacccccatccaaaccctttgtggcttcctctgaagaatcctgaggcagaggcagcagcaggctcactcctccagctgcctgcgaaggctgaattccatttattccatttggggttggtggtgggcaggacgaatgagactgttgtcattcttcccaggaatgcttagatggacagtgagctattggactgccccagataccatcatctcccccacatccctcctacgtggagccttagtttggggggaagtgaatctcaattgcccccttccctctccccgtcaatgaggcaggcttgtggaggtgctggccacttcttaggcctaaatctgtgttcagagagtggatccatgctttgagagatggttgccctgcccgtcctagactatcttgaagggtgagaggcacaggaacttagagagtcaaagactaccaagagacacaccgaaaactagtgaggtgggaactggcaatttctaaacctacggcaacagcagtctctggtccttcttttcatttcccgggacctccatcctgagggctgaactgataacattcatcttacttttatggatgatgaggaaaatgccacaagtgagtttaattctcaaaggagaaagagaaagtggtatctaatatcgattaggtccaaatatactctcttggtgttttagccagaaatacatctgggcatttctgcagcaatctgtaagagactttatacacgtatccatctcaaaataatgcgcttttagttattagcttttattcatttccattttgtctttttaaagtgacatccaaaatgatgaaaagcttcagggtactacaacaccataagataatcttcctgtattcacttccccaaagtacccagagatgggccccaagaggagtcctcctcacgaagaggtgaagcaccgacctgaggatctgtcagaaccctgatcaaaaagcaacagaacaaagtgaatggcgagataaagtggagagggagccattgtgtttacgttcacctaagcaaagtcctaattagtgcccagtcctactggaggatggttttaatggcatgcaccttttatcgcctgcaaatgcttaagggtcagcagaacaagccactgccttgttagataatgaaacacagataaaaatttatgtgtaattggtatgttttaaactggtatttaaaagctatttatctcttagtggggacaaatattcttttaagtcattaattggcaaccataaattttaattctattctaggcataattattacagatttcaagtaagtaggctccaaaacaatgaggctttactggttcgatcagaaatacttgttgaagggtttcctaagaagattacaataggataaattaattctatcagcagaagcactggagtatagaatgtcaaatacagtaaatccatatgtaataaacatagatatctaagatgtgtaagtaagtaaaaataaggatgttgcagatatatatacaatatggtgctgcttatcaaaacaacacaaaacaattttttgtgtgtgtctgtaaaaaaaaattgtgggagtggggatgtgtaatgctgaaggtgaggtgccaaaatgccagcagtggctacttctaggaaggagggtaggacggtgggagaaaacagggattaaggacaatgatgaaggggaattttgcctttgttataaaatgttttaaattatttaaaataaagttattgcatttatacattatttgtgcaattaaaatatttcaaaatttcagacttatttatccccactataatcacaagtagtgattactgagtatgggaagagcctagtacctaggggtggtgccattataatcccaaaggacacaatcctgaatgccatcatccctgaaaatattggtatacaggcctttaaaaacaaaaaaggcctgagagtaaaaattagcctgaagtcgaaatctctgaaatcgaaaatcctgaaaatcataatccccaaacactgaaaccccaaatgctgcaatcctgaaagccaagttctggggagggattcgagtgctttccgctgtgctcactgtcgctgcatcctgtagttctggggagggattcgtgtgctttccactgtgctcactgtggatgcttcctgttagttctggggagggattcgtgtgctttccgctgtgctcactgtcgctgcatcgtgttagttctggggagggattcgtgtgctttccactgtgctcactgtggatgcttcctgttagttctggggagggattcgtgtgctttccactgtgctcactgtggatgcatcgtgtagttctggggagggattcgtgtgctttccgctgtgctcactgtggatgcatcgtgtagttctggggagggattcgtgtgctttccgctgtgctcactgtggatgcatcgtgttagttctggggagggattcgtgtgctttccactgtgctcactgtctttgcatcctgttagttcgggggagggattcatgtgctttccactgtgctcactgtggatgcttcctgttagttctggggagggattcgtgtgctttccactgtgctcactgtggatgcatcgtgttagttctggggagggattcgtgtgctttccactgtgctcactgtcgctgcatcgtgttagttctggggagggattcgtgtgccttccactgtgctcactgtggctgcatcctgttagttctggggagggattcgtgtgctttccgctgtgctcagtgtggatgaatcgtgttagttctatcatgttagacaggactcttatcttgtggttgtcttcatctggaaattagctatggtttaagatgtgtacaggtgccagattcacaaggggtagacttgtagacttaattttcggtgtcagcttgactggattaaagagttatctagtaacttggtaaagcattatttcagatatgtctgtaagggtgtttccagaggagattagtacatgactctgaatggagtaggtggagatctgcctaaaatgttggcgggcaccatccaatcagccttgggtccagagggaacaaacacagatggtaaactgctttctctctgagagatgagacagacttttcttctgccttggacgtaagaaacattattccaagtacacgcattatcacaatgctgctttgtgtataagcatggtgcatgtacataaaaacactgaaacttcttccataaatgaagaactgccttttttctgtgtctccatttgtgaaagataaaatttcttgagaccttggctctttgagtgactgtatttgtggcagtgaccagaggtttttgatccatctcatcaaaacatgtctgtcagggtatttttgatgactgcagttacaacgatggatgcatacaatttccaaccatagtaataagcgttcacacatttcactttctgacctatttctttataaatacagtttgtctgttcatagctataatagctgagtgactcccattagtatatctgtgtgttgatgcttgcaaagagaacatgtatggtattgttgcctattttactgtgtaaagtggcctataatgtgttcagtcatgtatttatatgtctctaaagtcttcttttaaaattgtaacaaatgtattttaaatatttttaaaactttattccacaattatatttttgaaattttggtctctcagaattgtgatttggggattttagaatttagggattttaggctggagctagtgaatcacacctataatctcagcactttgggaggccaaggcgggcagatcgcttgagcccaggagttcaagaccagcctgggcaacatggcaaaacccgatctctacaaaaaatacaaaaattagccgggcatgatggctcctacctgcagccccagctactcgggaggctgaggtggaaagattgctggagacccggaggcagaggttgcagcaagccaagatcacgccacggtactccagcctaggtgacagggcaagactctgtctcaaaataaataaataaataaaactagactttagggattttaatctttcaaaatttcaacatttggaattatggcattcaagatagtgtctctcaagattatggtccaaacctccatagaggtactggaaagcacaacgccagatactacagaagttccgtatgactccattctggcgcaaccatatgcccatgtgtcaggcacaatttcctaagaagaaatcaagtgtaatagatggcaaattggtctcggcctaggtcaagcttgtccaacctgtggcccagcatggctttgaatgtggccaaacgcaaacttgcaaactttcttaaaacataagtttttttgtgtgatttttgttcttttagctcatcagctatcattcatgttagtgtattttatgtatggctcaagacaatttgtctccttccagtgtggcccagggaagccaaaagattagacacccctggcccaggtcagtagcaccagaaggatatctagataagatcaaactaaattaataagcagtctgcagctccaaagcattgactttgaccagtacttttgagaatccttaggctaattcctagtaaagcatgttttgcaaataaaaaaaaattatcttccttttttattggtttgccaaaaaaaattaaaaaaaaaaaacaaactgtgaacatacactagaagcaacaaccataataaaacttctggtaataataaggcagctcctcccatatataacataccaaatataacaactataagctctggattcgacatttaaaaaaactaactgaaggtactagagagtggccaaaagcagacagaaactggaagggagttaacacttgaaaataaatgaaaaacactagatgagtttcttgtttataaagctttttaaattgaagccagaaattttctggctgtgccagctggggcaactgcaagttggatagaaatctgcagcttcttaaagaaacaaaaggaaagtgacaggaaaaaaatcccagtgagggccagagtctagtgcataaaatgcctgaatctctgggtgacccctactatccacatgcattgaggagaggcccagcagtccggaaaagtctaaaagaactgaaaagtgatttcagttgctgcccttcacaggggtaacaaagttggagcacacatctgccaatataatagcatgctaaagcaatacacacacacacacacacacacacacacacacacacacttcagaggaatataagagaatccagaaacctataacatattaaaaatgttctgaataaaacccaaaattactagacatatgagggaagaggacagggtgacccattctcaagaaaaaaaaattcaatcaatgaaaaccaacccaaaatggcccaactgcctcaaaaactaggtaagaatgtttatagtcagctttcattactatgcccaagaaaagacaggaaaatatgcttgtaatgaacaaataggaaatatcaacaaagaatcttaaaaatgtgatatgaataaaatgtgaaatgaatgaaaaataatccaataaaaatggaagaggaagagaaagacacaaataaaagaaccagagagacggcagtgataagaactcagtcttacatggtaagaactcagcatgatattgttgcctgtgaagacaaaaggaattttccattttcttatgccactaagtttgtggtactttcttacaacagcaataagaaacagaaatgtgctgaaagagaaggagaagagaagctgccaatctagaatcctctatccagcaaaaaattgtctgcaagaataaaggcaaaataaagacattttcatataaaagaaaactaaaataatttattaccagcagacctgtactaccggaggtgctaaaggaagtccttcaggctgcaggacaatgagactagatggaaggctgaaatttcatgaaagaatgaagggtgctggaaatggtaaatacgtagggaagtataaaagactctttctctgaatttcttcaaaatatatatggctacttaaagaagtaaaatgttgtattgagggagctttaaaatatgcaaatataatatatatgacatctgtaagactgaggagttcatattttacatgaaatgggacaatgttaactttagactgtgaaaatttaattatctgttttataatcctagagaaaccattgaaaaagaacacagagacatatagcaagaaaaaaaaaaaaaaaagctcagccaaaagaactttggcaaaagaaccgaaagataatatacaataaaaatttttttcatggaaaatagttttggaaatgctactatgaaatctcagcaaattctatttcttgccaatgtattcatctgcataagaaatggtaagggatacatctgtagatttaaacacgcacataaacacataagtccactaaaatggtcagattttctactcctcattcaattaaaaaagaaactatataaagaaagcaccaaaagacaaaataccaaacccgtctctacttcagttctctgttccattcacaattctcacccaggaaagagaaattcaaagaaaagacagagctggaacttcatttcctatatatagttagccagcattcttcagtgttgtctacacattcacccacatccaaatgtactgccaacagaccaacacagagaagtgctgagttaggtttcagtgtgtttctaatatatcccattttattcaagacagaataaaattttgtttcaatgtgactcctctgggtttaaaaaaaaatccaaaatcttagacttaactatatagtcaatcaactagtacataaacaaatgacttcagtacactaatgctgatagccaaaatagtaaaaaataagtctaaggcatgtcacttacttgctctttctggctcatttattttaactgctcccactagcattctgtctggttttgttttttttttctagattaattcaattctcttccctttggatgagatagaaaacagaacaaaaaaaatgaaaaaaaatgctttgcttcacaatcagtcagtatttattgaatgtctttattgtcacacagtatttattgaaatactatcatttgccaggcatagaagaagacgagataaataagatggccccttatcgtctaagacttaagtaaaatacataggatatatatacataatagatataaaacaaagctgactgtttcatgaaagcagaaaggagagagacaatcttttcagttggagaatcaggaaaagtttgtccttgcaggatgaggttttcagaggtaagctgggggtggggaaccagaagcagaaataggagaccagggaagtgtaggacaattcagggaaaggtgactggctcagtatggctggagcatacaggctacactggtggaagctgtgagagaaaacatggcatgtctaattatggtggctcttgaagccaagctaaaggtcttgagcctcatttgataggcagtgaggttcacagaagatttttttaaattgtggagtgacatttttcatcatttaacaataaacagcctttggaagtattatgtgccaaaaacatgcaaacaagtaatagtacatcaaggaatcccacaaaatccaacctcaggcagactgcagttgagtagggagctaactatgtaaagagaacaacaagttagaaagccttagtgaggattatgctattgttctgtctaagccaagatggcaagcctgggattgccttaccaaattcaagctcccagactacatatgacacatacatgaaagaataatttaaaatttaaaaaaaagagagaagaggaatcttttttttttctgtaatcagaatacctatcatccaggaaaaggtcataaaacagtgcaaaataacaccacaggactaaaaaaagatttttttttaatgtggcaaaaattaatacaggatttcctttgcaaattatccaggctttttcccattctggcgtagatgccactactctatgtgcccataatgtcctgattcttcctctctgtaatgacagttctcatcccacaggattcaagttgcctgtttatgtatctgacacctctgctattttatcaactctttaagggaaggaattgtgttttatgaatgacattctcatttttaaaaagaaaacaatcgtttgtcaaataaaaacaaaatctgtcttcctttctttagactttcaaaattagctcaaataaaaatatattattgttgacattcagtaaagtacatgttggcagcctcttttaaagtgcctttcataaaacaagcagaagatatacacacagatacacacatacactttttaaaatttgaaataatataagtgctcttactgtaaaatgtcagacaacttttatctgaagcattcaaaaatttctcccctgccccaaacactccttattgggctattgttatcccagtttcactcttagaagacttaaggagaaaaagcattaaatagaatttatgggaggtcattgatttggactaagctcctacactaggccccgagacacgaagccaacatggagttattgagactaaagttccaaactgaaaccaacttgtttaacctgagaaagtaggagagagataatagtctaatccccaaccaggccacttttaggcaccgtgataaggaaggcttcttctgttttaatcttctatgaaaaagtaactttgaaatgaccggccttcttgttccacttctgcttcttcagccgtcttctgcctatctagaccatctcctcctgcgaggatgtgaagtccatccatctttcaaggtcaagaagtttagactttattaggaggcaatggagagtcgaagaagaatagttcaattcactttctgtagaagtgactgaaggaagggtacttccacaactgcaagcacagaagccattaagaggttgattcagcgacccatataatggtggcctcaattaagggactggcagtgtggctgaagaaaaacacctagctaaaagagaacaggaagcagaactaaccagatgtattgactgactgaatgtaaagataagggagagggaaaagtcaacgatgatctataggtttcctctaaacagtcattaaacaattatttactgagcaccaagtatctaccatggttccaggtaccagagatacatcatcagacagaagaatgtctcatttttatggaggttatagtttagcagaagatagacagtaaacaaataagatgtctacaaaaccttctctcatcattctttttttttttttagagtaaagtgaaagcaactttattaagaaagtaaaggaataaatggcttctccataggcagagcagccaatgtgatcattctggccaataggcttcttttgtcttaggtgtgccagagtacaccacgcattttggaactagatggcacagagcagattcacatcatatgtacagcttcactgggaatccttcatcccaatgaagctgataaagtctgaaataggacatacacgttaaaagaatgtctgaatgattgtaaggatttttctggcttctagcaaaaaagtaaaatattgtttgtacttctgaacaatttaaggaattttgaaaagaactctgactctacttttttcccatcacataatgaagattgatgtatttattacttggtggtgtgaattagaaatatgataaatttaaagtctaacttgtttcccatccaaacttcccaactagactgcactgtattttttatttttctctaattgttgtacatgggtaagtaaaactcgtgtaagtttccgcatagttcacactcatgggaaacaaaaactgcgccttgtatatcatcatcccccgactgtctgtcactcacagaattcaaggcacatatgaagtgctcaataaacaagagcttagaggaaatcaatgaggcttagtgcatagccttattgcaaactgtggtctccaatgcaaaaacaaaataaaacaaaaaccccacaactaaaaacaaagtaggggatgttaacaagagaacaaggatatgaaacctatctcatgaaagaataaacatttcacacagaaatcataaatgttggtattaattttaaatgacatttgtcagccatagaaagtgatctctaataactcacgatagagcagtttaatgcccaaataattgaaaaaagaattggagaggtaacctaacggcagataagattaagtaaggaaaatttcaatctgtgtgaagaagagaaggctttaatttttcaaccctttgggacaatttggaacatcagggctctacaccaaaactcgactttatttatcctatatatatcctttatttaggatccctaaatttattttttactttcttcatgaactcgtaagtcagtctcctagggcaggggtccccagggctgcggactggtactggtccatggcctgttaggaactgggtcacacggcaggaggcgagtggcgggtgagcaggcatgaccaccggagctcagagcagtggcagcactggattctcatggagggtgagcaggcatgaccactggagctcagaaaagtggcagcattcgattctcatgagggcgtgaaccctattgtgaactgggcatgtgagggatctaggttgtgtgctccttatgagactctaactaatgcctgatgatctgaggtggaacagtttcatcctaaaaccatccatcccctcctcaccgccccatccatgaaaaactgtcttccacgaaactggttcctggtgccagaaaggttgggaaccactgtcctagggcaaccttgcttgtgtgggtaaagttctttaagaaaacgggagactctaggagaaaaaagaactattattattgtaaaaagaaagattaccaaggactcttcttttaccatacaaaggaggaaatccttactacaccttagtgtccaagttcagtatacctttttgatataaaatacacagaaaagcttaatatttgatttatcttagtgtattatctatctcccccctctagaatgcgaactctataaaggcagaaattttttatctgtgttgttaactgctgtctccccaatatctacaacaatggttaacaacactaggtagtcaacagtagctaagaatggacgaaagaatcaaggcttggataacaaaacagctcgtttatggaatgcatgtatattttcataaggataattagtgtgtgtaatcaaaagcaaagcccttctgaaagaagtccatcaccaatacagataagttaccactttgtttgattatcataaactatcaaacaatgcaacccactgaaaggaaaatgtgagacaaatttaactcctatgaccttagcgttgaggaaggaaagatttacatagcgtccattgattcgctctgggaagagtgtggttaccttcaaaatctaaagtcaaaatctaaatccctaagtcaaaacctaaaacctaagagctgaaagacttctctgtgtttaagcaggcatcctgttttcactctgtggtatctaaatagaagcttcaaaaggagactctgtgcttgtgtttacaaactgtgagactgctcaaatatagaaacggaagactttttgttgttgtttgtttctagtttttctttttttcttttttttgagacagagtctcactctgtcacccatactggagtgcagtggtgtgatctttgctcaccacaacccctgcctcccaagctcaagcaattctcatgcctcagcctcctgagcagctgacactacaggcctgcaccatgtcacctggctaatttgttgcatttttagtagagacaaagtttcgccatgttggccaggctggtctcaaactcctgccctcaagtgacctgcctgccttggcctctgaaagtgctgggattacaggcatgagccactgcacccagcccctagcttctattttttttaattactagtgtaccagctcaggattgaatacatctctcctcctgctagaaaaaatttaaaataacctgagcaatgtagctcatacctgtaatcctggcactttgggatgccaagggagaatgattgcttgaggcctggattaacactccaagacctcatctctacaaaaaaacttttttaaagaaagaatttaaaatagaagtatttatttctttcaagttagcctaaaggccaaatcgagctcctggatatttgaggagttctgaaaccacgtttgccaagatcatgacggtgagaggaatctggcgtgactaactttatcttgcttctagtctcacaggctggctgcccttgctcattcctaggcacaggccaagctaaccatgggagacaggaaggatggtcatagtccctccctaaaactaaacccctctttgctcagggaccagagccgcttttgtaaaactaatgaaaggccataagattagggttatgggaggggcctgcaatttgttaaaatgtaggcgtagtttctataatcccttactgctcaggagtcatgtggccagaggtcacaagatttgtgacttcctcaattgctcctacagataacattactattgtagtacctaagattggtctttcgaaacgtttttcagacgttagcatgctggcaaccaactcacccccctggacctgtgacttatgactcagttggtcccatggcccccgcccagaggcatactcagcatagcaggaccgtttcctaccctcctatgattttatccacaaccaatcagcagcacacattccctagccccttgcccgccaaactgtccataaaaaccccagcttctgagttcttggtgagactggtttgagtaataactccagtctttccacttggctagctctgcattaattaaactctttctttactgcaatatcgtgggcttggcgaaatggttttgtgtggggaaaagaaagagagatcagactgttactgtgtctatgtagagagaagtagacataagagactccattttgttctgtactaagaaaaattcttctgccttgggatgctgttaatctgtgaccttacccccaaccctgtgctccctgaaacatgtgctgtgtcaactcagggttaaatggattaagggcggtgcaagatgtgctttgttaaacagatgcttgaaggcagcatgctccttaagagtcatcaccactccctaatctcaagtacccaggggcacaaacactgcggaaggctgcagggacctctgcctacgaaagccaggtattgtccaaggtttctccccatgtgacagtctgaaatatggcctcctgggaagggaaagacctgaccgtcccccagcccgacacccgtaaagggtctgtgctgaggaggattagtaaaagaggaaggaatgcctctttgcagttgagataagaggaaggcatctgtctcctgctcgtccctgggcaatggaatgtctccgtgtaaaacccgattgtatattccatctactgagacaggggaaaaccgccttagggctggaggtgggacatgcgggcagcaatactgctctttaaggcattgagatgtttatgtatatgcacatcaaaagcacagcacttttttctctaacttgtttatgatgcagagacatttgttcacatgttttcctgcagaccctctccccactattaccctattgtcctgccacatcccgctctcccagaaatgcccgataatgatcgataaatactgagggaactcagaggctggtgccggcgcgggtcccctgcgcccacttttccttctctatactttgtctctgtgtatctttcttttctcaagtctctcgttccacccaacaagaaacgcccacaagtgtggaggggcaggccaccccttcagttttgtctgtgcagcagacaggaagagccagttgggtgactacagttcccttcacacagaataaaagttcctaaacaataacacagctaatctcacctacaattcaggtaagtcaaaactatgagccctttcccttactgagtcccaagtaagggggattctggtccaaacaaacaaaaaacccacacaatacacacataaaggtcacaatttgtatttgctcaagaatcatataactcattataaaccgaaaccaaacgaaatgaaagactttattagtaaaaattatgaaaaatttgaaaatatgtcaaaaggttacctttatattcttttaaatattggaccacagtctaaacaggcccacccaaggatttttttttaatactgtagtattgtttggcttactacttattatctatcagcataaggactgctaagtaacatattaacttgcagatttttgtccaaaaggatgtaaatgatttttgtgtgatagaaagatagccccaaagacaacagttttattgccctgtaagacattaaccaactgacaattcctttttttttttttttttcttttttcttttctggagacaagagctcactctgtcacccaggctgaggctacagtgcagtggcatgatcacagcccactgcagtctcaacattctgggctcaaacgatccttccacctcagcctcccaagtagctgggactacaggcatgcaccatcatgcccagctattttttgtattttttgtagagatggagttttgacatgttgcccaggctggtcttcaactcctgggttcaagtgatcctcttgtctcagcctctcaaactgctagggttacaggccactgcacccagcccaatttactgatcttacaatcttattctagcattctatcagtgcctatatataatttatctgtggaattttctgggaatcagcatcaccattatgttgattccctcattcatcaggcaaataaatttatgacacgcacttactatgtatttacgagggtcattgttttacctctgaaaaatatattttgatatcttaaagttttggtatattttcttcttagatgcctacagaatataggaaaggtaagctgttactggtctatcaatggcaacaaaagaatgtaaattgattgcattattcattcttcagcaggctgattactgatactatagtcataccattgaattatttagtaacaaaaaatctagtaaataattacaaattatcagtgactaccatattctttagagcacattattttacccctaaagatgcgcattaacattttgtgattagagtacctagaagactacagaaaagagcagaaatgatcactaaatgctgcatgtacctcctgtgttttactcctaatgcagctttaaagctgtacatcctaaagaatattgcattttctcttttaacaacataaattttatctccagcaaagaaagtgttacactatctatagtaaattttaaacacttcaatatagaagtatttccagtgtgatttatgtgtatctgggttagtttccactcacaccctaatggtattagttaacatctgaagtaccctaatgaggaattaatccagaggtggatgtttatcatctgacacatggtgaccatctgccacaatgccagaggtagctactgatggggtccaagacatcctaccccaaaatatggtactttggcatattagatattttaagctgaaggatttgagaaaacagaccttccccctccccttctcccctgaaaaaggttataaaatctttcctacgttttatgaccttccccgaagcaggtcaaaggaccctaatgtgtgaggtgccctccctatacccagaagaaaggggcatccttatctccaaacatgcagtgacatagagacctgaacaaataggtcttactaagcatcctccagtttataacattcagctcatcccccgctttgtcctatcacatttctctaagactctccactcttcatcaaacctactatgaaacaagctcacgtttaactgcttcttcgggtcttcatttccttatgaagtctcccatgtcacataaaacttgaataaatttctaataaaataaattttattagagggggtcccagctacccaaaataagtagcaggaaagatacttttcctcccctttgctacaaaacattttcaaatatctttgtttctgatcaaccttaaaggatttgataatttgcattatagataaaaatatttttccttggtgaaacaaggggtgtttaagatatgtggatggctaaaaacagtagaaaaagaataattagtttatttccttttgcctttgcttgaacaatgtacaagaatctagcatgccgaatgactagaattaccataggttgcaatttgcctgttacagtcccagtttacatttcttatcccaacataattattaagaatgccctctttggttctcaaagcattctgctttggaccacaaattatatggacaccccaccacagcatacctttcttaaaggccccctaggcttaatactaggatggaccctgtatggatttttgtcagcgaactgctactaggttagctgaattccgaagctaacgcactgtttcacctgcttcaagtgaatctttctgtgataaatttatagaacaactggtgtgacagtttttgcgcctgcctaataaatgtttgtatctgtgcatgagtcagtctgagacttgcttttattacaacacactgcctgggactgtgcttgcaggtgagaagaccttcagttttcatttgctcctatctactagaggctacggatatattttctttttttttttttctacacttcacttattagatttattactaagtacttgatgctttttatttttatttttagatttcagtaaaatagtttaatcaagtcactaaacaagcaaatgacaacaacaacaaaaaagcctcagagagagagaagggaaatcaatatctagttgctaccatatgacacctaaaatgccaaattttctttttttttaatttttttaatttttatttttattttaagttctgggatacatgtgcgggacctgcaggtttgttatgtaggtaaatgtgtgccatggtggtttgctgtacctatcaatccatcacctaggtattaagcccaacacacattagcaatttttcctgatgctctccctcccctcgcccttccgacaggcccagtgtgtgttgttcccctccctgtgtccatgtgttttcaccgttcagctcccacttatgagtgagaacatgcggtgtttggttttctgtctctgcgttagtttgctgaggataatggcttccagctccatccatgtccatgcaaagggcatgatctcattcatttttatggctgcatagtattccatggtgtgtatgtgccaccaaagctcctctatctggcagttccttgcagatgaaagctccccccatgattcagaataagtagagcttttggccagaagagttttcaaattcttgcccttatagctacaaacccatgagcctatttctagatccttcctgttattcttattatagagggaataagcatctcttgctactttttatcactagaccaacatctttcttccctactagacataagttccatgaagccaagaccgttgacttccttaatcatctctagaaccctgggttctagcacatttggtactcatcagttagtcaatatctgctgaatgagtaaattttaaaaagtgtccttgatttctcctccagaccattagttgttcttttcctgttcaaatagtcggaaagcaaaggcaaggaaaaaaaatctcagaggctcacacaaaaaaagctacaaggaaaaacaagttcagttagttgttttccgtggtatctatgaaacttttttctaaacaaataatgtgttctgtccaaaacactttagcctaccaacatagcaactctacgtgcaataacggcatgactgcactgattctgtgtcttgattttaactttcaacaagtaaaacaaacacaatttgcaaagcagaattccaacactgctgtcattacggctttagataaagcaccactgacaaggccccctctagattctacatgaagacttacgcggactgaaacccgtcctcagtactccaactgttaaccaaaccgcctcccaactctaaccaactacatcatagcaagcaaatctttatatgtaaacatagaaaattattatttttatctagttgcacaatgactttctaactaagcttttattgaaaaaacatacatctcactaataaggaaaaaaaagagcaatcacttgtttagaataaatgagatgctcttcgtcctctgtgagcccctttgactcatgaattggtttaacttctgaaacctccagtgtagactgtccctatctacagcgagcgccatgcacttatgagcaggaaacacccatgtgacaaagctcagaactgtcacggaaaggtaacccaggtaaaagcgcatcaaaacaaggacacacacacactctctctctctttctctctctctctccctctctccttctttctctttctttctctctctctctattcaggagttctcaatttcccatttctcccggcttaaaagttaagagtaatcacgcctgtaatcccagcactttgggaggctgaggcgggcggatcatgaggtcaggagatcgagaccatcctggctaacacggtgaaaccccgtctctactaaaaatacaaaaaaattagccgggcgtggtgacaggcgcctgtagtcccagctactcgggaggctgaggcaggagaatggcgtgaacccaggaggcggagcttgcagtgagccgagatcatgccactgcactccagcctgggcgacagggcgagactccgtctcaaagaaaaaaaaaagttaagagtaatgagggaaattccatgaagtagtccaactaaaattttattttatcctagaggtaagtctgaggacattgattagtgcttatttttgttttcagtacaatatccccaaaagtttgaaaaattagctttgtcacaatacacttcctatattacatccccttctaataatttcagacagcttataatttgtataggaagatggcaaatgtttttatctttatgaaatttatgtgtacatacacacacatatatattttatatccagaaaagttttagctacatttttagtttcagaggctttgaattcattgattattgtgtaggtaattacttgaccttatatttatttgagatgatcttttattttttgagacagggtactgcactgtcactcaggctggagtgcagtggcgtaaacacggctcactgtggcctcctgggttcaagagatcctcctacctcaacctcccaagtacctgggaccacaggcatgcaccaccatgcccagctaatttttgtacttttttgtagagatggggtctcaccatgttgcccaggctggtctcaaactcctgggctcaagtaatcctcccgcctcagcctcccaaagcgctgggattacatgtgtgagccactaagcccagccactcgaccctacttttagaaaattcaatacataaagatgacatttccctggaacattctttctcctataaccaaaacattaggcatgagttacattttccatgtccatgagtagcacttcatgttattatatttcctaagaactattttaattataaattttagatgcagtgaattattttgggaaaggtgcatatccaacccatccctatttcgagccagaatagcttagattcctgaaatcacttcagttgctcctttaagaccgtgagaaaggaacatatgaatcttcacaaaccttcacagaagcttgttgaagattttggtttctaaaaatatttctatttcacttgatccagattttcatgttatatttcttttgcacaccatgaaaacaagttttcaactactcaaccaaaagtctcgggtagaaaactgcccctttatctcatgatggtatgaacaggagatgagtagacaaaacttttagacctttaccggctgttcctaccccaaatgccagccactcacatgttttctcgccctccaaattgctcagttttcatgatgctgcatttaaaacctatgtctgaaattggtagtttgctttttttttttttttctgggggaggggtgtttttacaagggagatttgggggaaatgtgggtatggagaaattttctttccattttccactggctggcactagaagaatccagtcagtttttctctgttctttttctccctctgtcctcttggtaccaaagcagtcaccatcacaaattccctttctttctattagtggatatggaattatctagcattattaagaataaggtgaaactgtctcagacccaggcttaaattgcaaaatgacaaaatatattaaaatactagagtacaaaagaaaagatacagaaaaattctacaaaggtatatatgaatggccaaactgtccaacatacataatccttgcataagcacccagtatgtcctaacagagaaagaaaccagttccagaaaaattaagtcaaaataatcacatataagagcttctctcttttagcccttcagtgacagctgaacgttggtcattaaatgggcatggaagaaacagagagaacaccatcttctgtttgaacaaaatcctgatctccaccaagaactgaaattgggtcttctccacttggaagactcctctctctatagagaaagagagagagctgtttttctttctctctctcttttttttttttttagatggagtctagctctatcacccaggatggaatgcagtggctggatctctgtctgctgcaacccccatctcccaggttcaagtggttctcctgcctcagcctcctgagtagctgggatcatgggcgtgccccaccacatctggctaatttttgtatttttagtagagatggggttttgctatgttggtcaggctggtctcgaactcctgacctcaggatacacccgccctccgcctcccaaagcgctgggattacaggcatgagctaccacacccggctctttctcttttcttttgcctcttaactccgcttctaaactcctcttgtgtgttcatgtcctaaattttgctgacgcgaaatgacgaagcccaggtacgtaccccagacaacgtagccacttcatactgggaacctcgtcggggaaaccaaggtacagcagtcaccgaaatggtgagcagaggaacggactccaactctgccctttcatttcaaggctctcggcctaaatgttagaaccatatcaaatcagtaacaggcatccgtcagccagttagaaacgcggttagcacggctgctgttcaaagactgggatgccaggcgtactggggaaaacatggagaatctcccagcacccatgggttgctgggcatgttggccacgtgtgaacaagcttcctttcatgaaggacttagccatcgcttgaagctggaagaggttctggagcaactgaggatttctggctggggctaccgcccagtattacccaaaccctcctggactgaccccagcctccaccgctggatgggttgtgggcaacaggattccaactttcctatgtagtttcctcctttcctgtctgcacccaccatacctcctgtcttttccactcggaagacccctctctatagagagagagctggttttctttattcttctgcctattaaacctcagcacaaaaaaaaaaaaaaaagaactgaagtcggttctggactcatccagggaaaatgtgctttaaatttggctgtggtgttctccagtggtcaaggagaatatgctattgatttgtgctctggcattaccactgcacactgacaggcagttcttttaaacacatacttgcgtggtttagacaatgtctgtgtatgactgaagcttcacttgaaatcctagtagttcttggaaatatgtgagctcaatgagctaaatatagtgccgacaggtatgagtgattagcatggtgctaactctgcatcaggaatatcaactttgtgtttccaatgctactttcaactttaaactcaaaggttttttatataaacgtttaataatacctatagcctttctattgggcatgaattcaaaacagacaagaaaataggtgtcttaaccacattatcactgctgatcaccaacaaaactgttaataatcatagacacagaaatctggatatgtcctctagtcatttaacacaatttttttttaaaaagtatatgtagcttttactaataaatattatataagattctgttatccattcaaatcttactttaagaaaaaagtcaatttagactaaaggccatgtatgtggtattatacttcacttttgataaaatctgattaattataaggcataatcttactttttcaggctgagggtcattttaagtgcttattttttccaaagaagtgaggaaaaaatgctgaaatgatttcaaaattcttacatgcacagtgcaaatttaaattgctgttcgaaattacccaagacccatcagaaaagaggaaaccacaggagaactagaaataaacctatttccattcttggaaaaccatcctgtacattaaaaaatgtcacgcttctcataaaaactggcaaataggccagtggaatagaacagagaatccaaaaacaaatctgcacatttacggtcaacccatttttgacaaaggcaccaagaacatacattggggtaaggacaccctcatcaataaacggtgctgagaaaactggatatccatatatagaagaatgcaagtagaccccacctctcaccacatacaaaaatccaatcaaaatggatcaaggacaaatgtacaacccaaagctatgaagctactagaagaaaacattggagaaatgcttcagggtattggcccggcaaagatgtcttttgagaagaccacaaaagcacaggtaacaaaaccaaaaatagacaaatgagattatatcaagctaaaaagcttttgcatagcaaacaaaacaatcaacagagtaaagagacagaatgggagaagatatttgcaaactctccatctgacaagtgattaataatgagactatataaggaactcaactcaatagcaaaaaaaccaccaaaagcaggaaaaaaaaaacaaaaaatgggcaaattaactgaataaactgaatagacatttttcagaagacaaatgcccaacacatatatgaaaaaattctcaacatcattaatcattatgaaatgcaaatcaaaaccataatgagatatcatctcaccccagttaaaatggccattttaaaaaagacgaaaaagaacagatgcttgcaaggatgtagagaagggggaactctcatatcctgttggtgagaatgtaaattagttgagctgttatgcaaaagaaaacattatgaatgttcagtgaaaaactaaaactagaactaccacgtgacccagcaatctcacaggtgggtatgtatccaaaagaaaggaactcagtgcctcaaagagatacctgcactctcatgtttatcacagcactattcacaacagtcaagatacgtaaccaacctgtgcccatcaacagataaatgcataaagaaaatataatgcatatatgtgtggtggaatattactcagccataaaaaagaataaagtcctgtcatttgcagcaacatggataagcctggaggacattatgttaagtgaaataatccaggcacagaaaggcaaatatgttatgttctcactcacatgtgggagctaaaacaatttgaggtagagagtagaggggtggttatcagcggctgcgaacagtagtgggggatgaagagagcttacttaatgggtacaaaaatataattattacgtacaattattatgtatcaataaaactaataaattgaaaatgatttaagttcctaaaacttgataacaaaacctcagagtaataatttttcagtttatttttttttaattccaatagaaattctattagcagaagataaaattttaaaatggtaacaaagggttctgtgcatatttggatacatttaatatataaaaacaatcccattcattggcagtccccttcttacccgccaaatacttttttagaaacagaaccacacagcccatacaaattcctggtttactagaagtcggtgtagcgtgtgtttcactatcctgcatatatcccctatgcggacaggggcagagctgtgtctaactaccaaaaacccacttggccataagggaggtggggccgaacatgtcctaggaacacagctgtattctcactacaaggactactccagccgctgtcatgggggcagctgcctgcgggagaccaccaagatgatgcagtgtttgtgatattcatgttatttctaatcaaaggaaaaaacactaccatgagggctggtgataatgttacactgaaactaacaaagacagggaaaggtacctcatgtgccaggtcctgtgccggggactttccatacactgcgtcctttaatccacacaccaactccgtgtgggaaacacagcagtctacccagcagtatactaccctaggagggctctgataggttaagtaactttcttaaacttagaagagaggactgaaccataagcccagtccttgcacttccgcctgctgtgaaagactacaggatttaagttttgtatcattatgacttagtgtatctggatacttggggctctctcagactgatcttccagagagcatgtcccccgcctcgccaccaacagtccataactttccagacttttaaagccctctgggttgtaacaaggtcaaagaattgccgttcaatgcccaggcagatacacaaaggtccagagccactgctttttctatagcaaaacgcacaggatcactcctggctgtccctcaggattttaaagtgacatatcacatgagccatacttcatttcttcacggctaatgtccctccagaaataccagaaatcagtatcataacaaacctaacacacatcacagttcccacttttcatatctaacctgcatctaaatctgctgagcgtatctcggagcctctctccagtttgcctccttgccattccctccctccatggcggactttcctcttctgtggccctgagtgtttacggcaagccccgcattggtatctctattagaccctctgcccctcccagtgacgtcttgatcctcttctgctcgggcaccatcttcttcaaacagccttctctggtcccctcagctgaactgcaggctcctcttctgggcttccaaagccccgtgcacatatcatcgcatcaatgatgcccagcactggaatgtgtttgtctgtctctccccacaccatgggcttgcgggtggctagcacaaatacaacttcatacttctttccttcacaggaagcaaaacaattcgaaacaggagttaagactgtccaggagaaaggggaaggagcccatggccatttcgtatctcttcatagctactcaatcattaatttaacaaataacttatcgaacttatactgtatgccagataatgtgctaggcactccaagggcagaagtgagtgcacacaggggcaaacaacacagcagaggagtcagcacgcaaatgtaatatgcaacgataaggtgcagacaagcttctttgggagcacagattaggaagacaaatcatgtctaaaggattcaaagaagactgcacaaaacctggacatctgagcttgggactgatgcatctgtgggagttaaccagtaaaagacacaaggaaagggcaggctgacatcaaaaacaccagtcaaatcaatcaagccataaccaggccttaaacccagctgctttctttcaaaggagaaaagcagcccgagcaacacagtgagactctgtctgtacaaaaactcaaaactaagcctagcatggcggcacgtgccacagtcccagctactcaggaagccaaggcaggagcatcgcctgagctcaggagcttgaggctgcagggatccgtgattatgtcattacaccccagcctaagcaacaggcaagaccctgtgtcaaaaaaatacaagaacagtaaataaaggagaaatggcctgaacatcaacttcaactcctatttttcatagagcagggccattactaaaactcccttgaaatatccatacaaagacaccttctatcaagccatgattatagtattttcttcaatatttattggaaattacataaaatatttcccccatgaacagcacacgtgcaattctgtgagaacagagtaaataaaaccgatatatatcaaacagtaccttttctgcagttgagaggtaagcaaaagcatcctctgtttaataaacaagaaaaaaatgttaaggaagaatgtagaataggttgccaccaaatatgcaaatgcattcacgcttaatacctattcttagctgaagtgtctagaggttgctttgtgtcttgcgcatcaatctcagagcaagcagaatagatgatctgaaatattaatcctaaacgggtcttgccagtgggcagctgtgggctcgcagaacctctgtgtagacagtctcattacctacttgttcaggcctctttgctggcaaaaagtatagctgaataaacagaaagacaagatctgcaatgcctcagcgctcagaaaattatgacgatgggaagaatgaagctctgaggtcaaaatcttttaaacagcaataatctttgcactacatcagacacctggcaatctcagtccattgtacttatgggaatgctttttagatgttctgattaatacgggtacttgggagcctaaacacaaagacctaactagaatacattgcaattctgagcctcaggcaatgtatatgaaaaagataccagaactaacttttgttgaataaaaggattcacggttcttgcaaatggttatgattgtaacaaatgtttatcattgtaacaaatggttatcattgtaactctaattccagttacgtgacaacaagtacagtttatgggaaaagacatgtgcaacaaccaccaaatgatctgtccatcttaccaaagacaatgaaatgatgagtccctgctagtttctagatattatttatccaagttgttgatttgtaggtgctcattccattttctcctacataatccagtaatctataatccagtaagaaactcacaacatagacatgcaatttacagtttctgcatagggtcattaaaaattctttcattacaaagtatttcttggattcttaaatatttggaaaatgcacaaaacacgtgaaaaatatagttgttcagacaaagaaacgtcattctgatctcatgttttctccccaggaacagacttcacagcaatccattccctttacatttattgtttccttaacttgcaccaagcctgaggaggtcagtgcttggcacacattaagaaaacaataaatagggagggggttacaaactatgctgattccctgttctatgcctcactctgggtgaattcaaccgtctgaagggatagcaaagtcagaagtatgtggcaagcagcaggatgccgagatggttccagctcagacaaggttccaggagagagagcctacccatctttcccaggccaaaatgttttccatgtaataaaggtcaccagtggttgccaatatgcgtatacgaactatattggcttggtcagagttagctggaaaagcaaaagctctgtagtactccagagttctcagatagacctgtccaaaacctctcattcctttgttccaacctttaatttccaacccccacaatcccaccccagtttccaaccagtactttcaccgagagggctgtaccactgcctgagaagtcacacaataccttctgcttcgtgaccaactcagacttggatatctacctgctacctatcatatcaatatgatgtagaggagtgtccggggccctagacctaaatcactttgtgtggcacctgcatcagccttccttagtgacaatcttaaatctagttggttttctttgagaatttatttccttcccaagtatatttctgtgattaaaattatgtggtgtcagaagtttagtttcaattatattttacagacacccgtctacattaaatttaccttcttgcttttccaccatccttagttttgtcgtagtgtttttgttgcaaccctgttcttccttcctgtgtctaattatttaaaaattaccactaaactgatttttatattttatttccatcaagataaacaagatacaaatagatgccctcaaaaaagttaatgatcaattgggtaaaactatatctatacccgcacccaaaaagacaacataattcaatgcacacatgcaaatcaagaacaagaaagatgatggaattagctccaaaactactaaccttcacattaatctgcctcttgcatgtcaatagtttatttcaaatattcggtccctgtcaatctaagaaagtcctaaatccaaagccctgcgggaatgacatgagtttcctggtgtccagcacacgttcgaaatcctgctgtgtgaagagggttcagagaggccaaaaggcaccattcatggactttaggagaaaatattttgtattttgtgcatttagaaaaaggctacaatttgaatgtttaaatatttaaagccaataaacaaggagctattatttaatttttaaaaaatcttttttcaaatttccctggaatattttatttcatttacaaaataaatgtatgaagatgacaaaatcttagaacttttttgaggctgagtgacacactttatctatactgttctaaattttacattaacaaaattatgttcatcacttagaatgtgacattgtatttagaaagtcagcttcccttgtcctattaaaatggtatttagattgtaagtattttattatactcaacttttcaaaaacataattattatataaagaaagatatgtgtagttatatgtacatgtatatacactcacacacacacatttgtaatcctttcaggcttacacataaacacatgttaaaatattgaaaagcagctccaaaaataactaaaatgtcatttgccaaactacttctaggctatctctgggaatagtagaatttttggtcataaaaggaacaaaacatttcctattttgcttttctcccacccttttccagccaacctcttctaaccagtctccatctttaaataatgctagagacctacaatagttttcaactatcagatttaatctctttggttgtatcagactgataagttgaaaataaatggtaatagccagtttgtgtcgggcctatcgggcaagttgtttcttcagaataatattcaatttgatacgtattttgaaacaaacatttactttgtttcatggccggctgtgaataaacagttctctaagttattagtgaagggacagcaaaatttgaccattctatctacccatctgcttctctgtggcaacaaactgatttccatgggacgcttgaataaagcaaggctgtctgtccaaaagaagtagaactatgtcctcaataggcaatggaacaatgactgacactgagtcctagcactgtcaccaatatcccgaacaatcaagcttcaaacccaaaaaggtgcaaataaaatttaagactagtttgggtttggtcccaatggggctaagaaaaactagtgattgttgaacactggattcactgacaactggagagaaaaaattaaaattccaacattatgatgtcaataataatttcatctgcagcaacattcaggaagctgatgagatgatcctaacgggtgatttaaagtgaaagggaaaaaaaacacccttggcataatttaataagatcttcagactgaagcatattcaagggtttcatgaaagaccttctcatggccttttaatagctctttccaattccaattaactggttaaatgccaattctcattacctcatcagaaatccaaagccagtcttttctgattaaatcattaaataactgttaacagtacaatgactagtaagtatttatggacagcccagcactgatatgcagctttcagttctccgtgccaaaggaaaaactggagtgggcgatttaaaatcataataaattctattcatcttcggaatgtgctaggatatatttatctaatatattcactcttcttaattgttttactggcactaatacatagattgggaagacaggcatgatggctcatgctggtagtcccagctactttggaggctgaggtaagaggatcccttgagcccaggagttcaaggccgtggtgagctatggttgcgccattgcactctagcctggtgacagagcaagacttcaacgcattaaaacaaaaaaaagtttattttagattagtataagcttttcatactctctaaatagactgcagaaatgatgattaaaagggagttcatttttgtggaaaagccaggtaggtagtgaagaaatgggaaaacatgtcaactgtgacctgccgctgcctggcagcatgacgagtcagatggccccactcaggagtcactccaaggcctgtggacgtctccactgggcaattaccacaccaacaggcaatgcctatgtcaactcataccaaagctcactttttccacagatctgcctgcaacccttgctttccctcctccctgactgcttgctgacgctcaggactggacaaacatggctcaagagaccagggttctggttccaagtccaagcttgtcaccatcctcccaagacagaagatattcaccctcagagttggaaaaggtcggctctgccacgtcctctttccttttgcacttttattttttatattcctgagcatcctgggacagagctcctctgagaaaatgaatgcgactctccagaggacgatccacagcaaacccaaagcctcctttgcttacaagttatagaaagatcccacgaacactctattctctatgcaacttcttgtccatgcagtcttaccatgaggaggatattatcatggagaaaaacaggctttgacttaaaaaacaaaataaaataaagcataatcaactaaaactaccatttaacttatgctgtaggtcactgcagcaaagaaatgatcaagtttcagtatcttccagaaactagataaatcgtcatagcttgtttaaatgaatacatcactagtaatatgtatttttaggggttttttgtttttttttttttttttttttttttttttacagagtaagacgcttataatatgtgaagttctgtccacagttacctgagatgttagggttagttgagcttaaaatagatacttccaattagaagcagccaaatataattttttatgtgagaaaataactgcaatgctagtatgaccctttattttcctagggctaaagtcagaaaacagaaacaaatataaaagtatcacattcatgtcaatggcttagtgaagacaggaccttattatcctttaaatgctgcttaaaatgctcccagactcgcccgtttatctgctcctcttccagcagagtgtctggcacaaaatggctgttccttcaatctctgccaatccccatccacatctttcaactggcaggaatttccctaattaaatgctacctgcagtatttttatcacactctcaatcatcactgtacttaaaagcttagctcataactgtcttttaatactttaaaaaatatggcttatgtaaattttataaaaatcatttaattgtacattgaaaatggtattttatggcatgtaaattatgttcatatgcggttaggttcttgttctcaagttatttcattttgcttctttttctttaaaatttattcaacacaacagttcaaggaatgaaaagattccctctttttctttaacatcttttcactcttcccggtaggcaagcgtaagataaacattaagtgacacataaattgcctctttctgtcttttgagctcaatgccctgaaagcagcccaatctcctaccttttatgtttgttggtaaatttaaactgaagaattaaacaggatgcaggtgtttgaaattctctttgttcggcctacgtaaatacctccattatccattttaacaatctattcctaaatgctgatgattcccaaagttctatccggctttaatttctccacagacctttgcatctgagtacataactgcctgctaaagatctccaggcacctcatatggtttctggagctgaactcatcatccttcttcccagcacgcacaggctcttagcaatgcttccactatgtacgtagctcaagcttgaacctgtgtcacctcgaactccttgcctctctcctactttctgacttgaatccacctcgatgtcctaccaattttactttctatttattaactctttagtctgtccccaatattgctgctctagttcagattccaaatatttctcacctgaaccactgcaccgtctctcaggtgtctcccttcttctctacatctcagatccccttctccataatggccagcacaatcccactgaaactccatttggttgcttacttctccattaaagggtaaaccctttaatcgctgttcctctctttctcactcaaccacaaattctcacatgccatatagaacccagcctctgagaatctggccccagccatctcttcctctaaaccctacagtcccttcttggaatgtctctcttgttttcaccggctagcacgttctcatctcctaacagtattctaggccaggcatggtggctcacacctgtaatcccagtgctttgggaggctgaggcaggaggattgcttgaggccatgagttggagactggcctggccaacaaagtgagaccttggctctcaaaaaaaaaaaaaataataataataataatcctacctactccggaggctgaggtggtattaaacccaagtgtttaaagcagcagtgagctatgatcatacaagtgcaccccagcctgggtaacagaaggggaccctgtctctatcaaaacaaaaaacaaaaactattctccttcactgacattcatggccccacattctcagcaagatttgctaattttgctacggctcctgtgagcctatccactccaaccacactgctgtatttaagtgcctgtcctccactttaaaacgtgagctacctgagggcaggatttatgtcttgtatttctatccacaactcataatacaatgattcttacaaggtaagctgtcaataaatattgaagaatgaacaaatgaatatagggagttcaaacatgagaactaaaggtctatatcagaaaactgtcagtcaagattctagctgttataatacagaaggccccatcacattccccaagacaaatttatattttcccactgtccttaattttatttcttatactctcattcctgaaataatgttgattattttgagaacagaatattaaggctatcgagagtgatgcttctctctcctcttggatgcaaaaattatctgtatcttcatccacaggaaaacatgtccctccctgtgattcagtttgtccatgtaaaaagaaaaaaaaaaaagctcgtgctcctcacctggccccccatctcttcccaaaccccactcattcactttcacctctgagacagccctcagatttattccctcctctaaattcccagagccactgctatagttgaggtcgttatcatctcttatttagactgttttgacaacctcttaactaatctctccccttctagtctctccctttcataacccactctttatgcgcctgggctctaaccaaaactgatcatgccttaaaatcttctcatgtgaataagaaaaagctcaaaattattagtgtgaaaatcaaagccttatactgtcttgcttcattctacctttctaacctcacctccctgggtgcattctagaacccacccatctgctgatcacttctcagcaggtgctgtgtgccatctctcctcatttgtgctcatgcttttttcctttgactttatccctctgtcaccctgaaaactccctactcatccttgaagaaaaccttgttcagatgggccattcttctataaaacctttcaacctgcccaattacaaatcatgactcttttcagggtttctgtagcatttatcttatacgcctggtatggaacacaaactattagttctagctccactctaaaatgggagctcctttgaaagaaaagtctatgaattacacatctttgaatattcactggctgagataaggcaagaacaagtcttaccactgaattttcaggagcacctaacaaagctccaagatggagataaatttgtggaataaaagaatcacccacttgtaagagcgaatatgcagaactgggtaaatgagttaacataaaatactttgaaaacataaatatgtccaaaatgatttaaacatttactgtgaaacatccctggtatacaaagactagaacggtgctactcagagcatgctgttcaccagagactgttgtggatccactgtgaaataagaaacaaaataaaaagaataagtatttagaaatttctacagcaatgtgacacggctgatccatcaaaatgcaggctgagtgggctcgtctcctgggagaaggtactggctggttcgggtcttgtcgaacttgtgtataaaagtgacacatggggcaagagctgcaggctggtcatgttgcaataggacgatattcgtctgggacagactggaaatggggggaaaaataacacaagcctttcgcgagacagtttaaaaagcaaagggagtaaaataagaaactccagtgtaccagaaccaatttcctcatgtttaccttccatattcgcttgagacctttcctccccatgataaaaaaaaaattatagatacagttgaaaccacctctatgtccttccccaacccttgcgttccccctcctgctcctatatcattttttaaataggctactgtcaaaggaaaagcagagctggagagcagagcaatgaaaatattttttatcaggactacagcaacagggggaaagagatctcagtcaagaccccaggctgaatccaaacacagcatcggcaagtgggaatttatagccaaagaggagggtggcagtcggtgaatgaaaaattattaagaggcaaaatcacaggtaagaggacattctggccacaccatcctaacaggattcttgccaaagacaggccaagatgatgacacatcacccgatgggggatgaggaagccgatcagacactgagactgatcagatatgaaggactggggttctggctaaattgacttagcagggtccttgctaaaatgcacagatgggccctggtggggacagagttcaggaacctgactaaagtttagaaaagcaaagaatctttgtcagcaccaaatcccgtttaggaggatgaaattttcctgttgaggattagggtcatgttttatttcaccaaaaaaaaagcactaaaaatgaacaatgatcaatgttattgtacagactctagcctgctaaatattatgtgaaaaggtgctgtgcccccttgtctgtgacccttcagccacaactcatacaactcaactcctgaactccaagtgaaaggccctgtgctgccccaacctgcagagggagaaacaccttactgaaatgtctacaatttggaaagaaagactaaagagcatgttgtatggctgtagaaagaataacacagacaacggatttattgctaataaaacagactaagaacaatgggctgatgagacttaactaaaaagatgtttattccaatgttagaggttacctcagagaagacacacagagaaaagaaatgcccgaaatgccaggtggaaagtaatgggctttccacggttaatcaaatgggcactgccatgccaacgtgcctcctgaaattcaaaccctctatttttgcatggctgccaactcatttccaaaacatccactgctaatcaaacttgtttggctgcctccttatcgaaactttacaaaactttaatttcagcctcatgagccctgcagctgtaaattaattgaatgaaattgacaaacattatgcagtgagataaagcactttcaaagtcttttccctattcagttgacttagctgcccagcatgccagttttgcttgacatgagttcagaatccctggaaaccttcctaatcctactctctaggccttgtgcctattcatggaaccatgttaacccatatccggaaaattaataaacctcggatgggtttaagcactcaaaatactcctgatacttcttgccattcattacattgtagacatcctttgcaacaggagaatcctcctcaaaagaccacgacggcagcagataaaatccctgaggttataagcatacaacaaaatgtctcatttaagattactgcagtctgaagccaggaattaaatttgctgaaggtgcagtcacttatgccttagttaaataaagatagtcccaaaactgatttctgaacttacccatttctcaaagggagtgcaaaattatcatgatttttaaacagcaaggcgagtaaactgatcgcctctgtatctgccaactgaacaaatgagtcagctaatcagtggttacatacatcacactgacagagaggagagaagaccattaactttctgaaatgagaagtcctaatataccgaggtgccacaagtcacttaggatttccgtggttatgaaagaagaattgaaacgtctcttccctctggtgggttttcacagcacaactgccacagcttccaactgaggtctagtctctgaccttccctcttcatcaatgttatcagcatctggaagccctctggcctatgtggagccatggggacaatggaggcagtttcaaagcttctgtcttatgacagaaaacctgggtgtaaaacaacctctgatatgaactactaagggacttgtatagattccttaaactctccgaaacactgttctcaacagcaaagtgaggagaaaaacagctctcaagtagggttggtgtgaacgtgaaaaaagagaaagtaatacaagagttgggcatataataggctcttaaaaagaattttgaaggccgggcacggtggctcacgcctgtaatcccagcactttgggaggctgaggcgggcggatcacaaggtcaggagatcgagaccacggtgaaaccccgtctctactaaaaatacaaaaaattagccaggcgtggtggcaggcgcctgtagtcccagctactcgggaggttgaggcaggagaatggtgtgaacctgggaggcggagcttgcagtgagccgagattgcgccactgcactccagcctgggtgacagagcaagattccatcgcaaaaaaagaaaaaaaaaaagaattttgaaatggaaatgtatctatttttcctttctttagaaaacaaacagaaaatgaagccaacatatctcatcacagattgctctttaaatatgcgaccttataccaaaagcagacaagttcacaaagagattatttttataatttaatcacagaaaagactagactatcaggtagttggtggctacagaagtgactgctccccactgaagcaaggaatggatagaataagtccttgaaataaatgctcaggtcttcccttagtaattctggacagtggggaaattagctcattcaaacaaagtttattaaataaataaaatcccagcacttgtctctttagacaaaaaccacatggaaacaatacaaaagattgctaatgctttggcaaatgaatcactcttccaaatgccatttacaaaagcccaccagacctccagctgtgctgatgccatgggaacccctagggcaattataagtggatttaactcaagaccagaaacacaggagtaatttttaaagacccaaaaacttccaaataaataaatctggaaaggaattactgtttacaccacagagccacaggttcaaatagccaaacttaaagaagaaaaaacacacatgtatatatctacttcatcatgtaatctctgaacaataggaactttactgagttgtcactaaggaaagagcaaaatctaagataggtagtttctggaaaatgaaagtccagagaaacttggccataaaatgaaaattataacggacttacagagctcgtcttctttgggttaagaaacaaaggtcttcttgtgcaaaggaagaattcgaaagaggaattcttaagtagatggctgatgcatccacgtctaaacatccaaaatctaccaagcacctattacataactaagccctgtgtcagaggctgtggaacaagaaccactaaaacttatctctgacctcaagaagtttatagttcagggaagtgactgacaatcataatacagaggcataagggctatccaaatagggtcacaggttacgctatgaatacaggtatcacatcagaaaattaccgtacttaaaatctcagcaaagagatcacaccctcacacaattaatgttatcaacatccatccagtctctcaagctcaccctcttcaacaatctttgctttactgagttccgggtggactatttaaatatcatacaaattgattctgacatcacaatcactgcctgcttcctaaaacttgccctccaccgtctattataaatgctttccaatcagtgctcccattcttcattctattcaccacttagttactagaatgtttttctcaactatgaatctgacttcactccctttcttgaaaacctcctgtagttcctgttgtgtacgggataaaggtcagacaacttagtatagcccagctcagtccagctagcaaagcaaatactagctttattccctgcaagcaacgtaagacaaagacaaccacactaaactcagtattagcagaccaccatcctccctgaggcctccactgctttgcacacactcttctctttctcagaaggtcctttcccctcctcctgttggtgcagccaattctttctcttccttctaatgcaccatcttctgtgtagtcttctttgacactaggtagggttacatctttgctctgtgtttctataacactcttcatatgccatggaactgcattcattatattggtataattttatttgtcttttttcttcctagactgtgagcccctggagttcagggaccatttcttaatcatattccagaacctatcacaatgaatgacacgaagaatatatttgataaaaatctgatgaatgaaccactctaaaatgcaactctaataaagaaaattactgcctattcagttggaactgtaccatgttacaaacgtaaaattatgtatagtctgataaagaaatactataatagccttggaaacagctcacatacaattttttttataaatggattcattaccatataactggaccagcttactgaagagtagccctacagcagtcacttcgcagtttgcaattcatttgaggttcaaagctagctcaagggaaaacaacgttagtattaacaaacttatttttaagcttaaggtcagaatttaagggaaaataaataaatatagtatgttctaagaatccaaaggaatttttaaaaattgccccctgcagctgtaatttctgcatggatgagaaaaccttaattgcttgctggcttccaagaaagccattaacctgcatttaaaaattcagctttcatcaagaacaacctcacatatccagctctcatggaaaaaggaatagaagcctctgacctagttttcaattattaccaaactactgataattgatctcctggtctccaggtttgtttgttttactaaaataaattccctctggagctgcaggtgcttaccatggggctgcgcaggtggaaagcagcccagtcttactatgaggatgtccgtttgccatctgggaacaaggaggaagaagcagagacctgggcaagacctcagagtaagtgtcctttttggcggctcccaggggtccccatcatgtgttataggaaggcagaattatttgagataaggataggagctgaaataagcagtgctaatactggttaaaagttggtgcttcagctgcagtcacaacagataatgtctcttcagttatatttccaagctatttctcatttggcaatgtacacttacaccaaaactgtgaaactctcggaagtggcagaccttggcaacaagtgaatggaaactgtgaattacagtacatgccactgagtaaggggtgcacatctagaaaccagaaatcaggttctgtcttggctcagcgtctaactagatgtgtggacttagacaagtcatttaaccattggggattcagtctcttcatctgtaaagagttcatttagatgatctcttaagtccctaagatccccattgttaggtccagggtcaggttccagcccatgctgaggccggaagggagtgggtagatgaatggcagacagctgaaagaacactcagggggctacgggtaggtgaaatacaattttattcagcagctctcttacactgtgtgtctcggctgcttgttccagccactcccaagcacagatctctgctggctctctctccctttggggtcaacagcttaactctttccctctgagcgcaagcaagctgagctgtgtcctggctccccgctgcaagacagacagatctggtgctctctctctttctttgggtgcaagcacgcctgcacagtgtcaccagggcaattataccttttaaagacaacagtggcaaagagccaagtgatggccctcccatgttatggctacatagctgtttatattacacatggagttgcgcgcctgcgctacagacttgctgagtcacccgggatgtttacctcagcccatcctgcctggctgcagtgcagccatgttccttacacctaccaatttaaaagtactgtaattccattttaagggttctaaaccatgaaccatgttcatggtttaggattttagatatttctcatttaaacttaggagcgaactctgcattaggacatttctcctttcattgtccataagataactcaccaaatccttgcgcaaagagaaacaaatataaactacataagaaatgacaggtgagccttaccaaggaccctgacccatgcataacatcttagtatagcatatatatatatagtatatgatagaaacatgccgtgggctttcataccctctacaatagttcattataagtttcatcccccaaagaaggcaacttacatacttaagtttttctaaatagaatccaggtgctttcaccagtgatgctctccaagggatcccatcatagtaatcagtctagccagtgccaacttcagttctactaaatttaatgccctcttattttgactcaggaataaattatctcaatggctacttacatggtccagcatagcagaaaaaaaagccacactgagcaagcagtggtcctttccatgctacacaagcaagaaatgcctataaagacagacttgagtgcagtctaaagaatcttttgctttgccttaacactctacttctggatatccttgctcaaaaagaagtctactcaaggtgtgtatctttcctctttataagccctctggcctcaggaagactggtttcattcatgtggtcatgtttttgcacagcttaagactaaactgtatgatccttccttctgggctcctacaagggcatgccaaagtcccctcaaataaccaaaacggtgcacatcccctttgcgtcccacagcagtctgctagtttatgtaataccataatgacagctatctggagtggaacagtgacactgctttttcccagactacttcaccatgtgaggtaaacggtagaggcagcaataggtctgctcagtctatggctaatacaagaccttgcttatgatagacttcaagagcttcttattagccagctgttaattcatacaaactgcacagaaattcattctggagcaatattatttgtttcacattatacttaaccttgaaaaggttagtttttcaatgggggatgattatcctggatagatgcataccccctacaaacatgaaactggcaagttcactaaagatttctcaagagccaccaagctagcaaaagtcgcaaccaaataatattatatactctgcccttcagagcaaccttcttcatgctgaagtcttcagttcacagaatgactgacttattttcaaaagaggaaggctgtattgcatattgtaactctctccaaatctatacttatgagctaattcttcaaaaggtaagatcaattaccacacagaaggagaagccatccattttcttgaagctgtcaaaatttgagctgtctcccataggatttccactgacagttaatgaaaaaaatcagtatctgtcaattttggaagaaatttaaaagtggtaagatattcttataaatcgatgttaaaattttggtataattattgtatatttggattactttatttgctttcctccaaatcatttctttactaaatttccctaagttagcttaataatgaggttttcttaaggagaaatctgttggttatacacataaattgctaacaaaaaagggatcagagctaaatggatccaatttttcctccttcatatgctacaatacaaggctactgcagaatttacaccgtgaataatgtgtattttgaaaacccaagcttagaatagtagtattttgtttcactatcaaaagacaaagcaaaaaaataaaaaataggctacactaatgtacttttaaaaatatacttggaaaagaaacgaaactatttcatttaatgctgtcttatagaacagaaatgccaatatatttacacagaaataattcagcatcttgaagtataagtaaaaacactaatgaagaccaaatttttagagttatttcatacaaatagaataaatttaggcggggcacagtggctcacgcctgtaatcccagcactttgggaggctgtggcaggcggatcatgaggccaggagttcgagaccagcctggccaacatggtgaaaccccaactctactaaaaatacaaaaaagttagccaggtgtggtggtatgagcctgtaatctcagatactcaggaggctgaggcaggagaatcgcttgaacccaggaggcggagcttgcagtgagccgagatcacgccactgccctccagcctgggcaacagagtaagactctgtctcaaaaaataaataaataaataaataaataaataaataaataaataaataaaatttaataaaaagagactacccattgtttccactagaattgctgccaagggaaatataccttttaaggatcaaggcttagaattgcttttcgcttattagaataaaatctatcagcaatctgaagaaatacataaacaatcagcaaattctagttagatggctacaaactaggtaaattactaaaatgtgccacatgaagataaagttagtcttggtaagaacaaaggtttcaaataatttttgctcttagatgtttgctgacagataaaatagagaacttcattttcaccaagtaacgcaaagtataaaaaggcatcggtatagtgctgtgctgcttttgttaaaatggtacaaggaggaaaagagagtatcttctaaagtccttgaatgggaaagccgtagtttatcacgtcgtattatcactttctatttacacagcatttgtttctcccacagacagggaggttcctgtggacagaaacatctgcttcctgcttatcctgtatctcagcatctgaatggtcatgactggaacacaggcagacttcagaaataaatacataaatatctcatactcctcgaatcttttagaaaaagagtgtgggtaacaataaacatatctgctgagaaatgaccacctcactctactcttctgcagacttcccattctgtgccgagtcaccctcagtaggcctaagtgtgacgatcctctcagcactccctgtaaacctatttaggaatccgcgaaagaaagagaagaccaccaggcagactggtgatgatatttcttggggaggctgtgcagtttttcatagtgaagcctacaacttagattttcagcactaatagaaccccattatcaggaggagagaaaagcactaatttcagatgggctctgacaggggacagttttaagaatttatagagagacatttccgtgtccagccaggatgtaatcatggaaattggatttaccttcccatccatgtgtaacaccaacatccagtggtttttcatgatactgaacaaaggcagcaatcactgagagactgggaaataaacaaaaggactgccccaatttattaagaaagcttccagaccacaatgaaggtaggtggtgtggagtcctgacaaggtaagttagcaccaacaaggaagaggccagcccccgatgggggagaacaattgttctgagagacagctaatcacaaacaacctgcttgtacaacatcctgttcccaaataccttgctctgcatataccccagcagcacaatcctctctgcacataacccctccagcatggccctagaaaacttcctttcagcccctgcctcttggcagacagcctcttctctgctgtgccggccattgcttcccgctaataaacttgttctcgtttttgttgttgttgtttcgagatgaagtttcactctgtcgccaggctggagtgctgtggtgtgatctcggctcactgcaacctctgcctaccaggttcaagcaaatcttgtgcctccgtttcccgaggagcttgggattacaggcgcccgccaccacgcccggctcatttttgtatttttagtagagacggggtttcaccatgttggccaggctggtctcgatctcttgacctcgtgatctgcccacctcggcctcccaaagtactaggattacaggcgtgagcctccgcacccggcctaaacttggttttaactcgcacctgtttcagtaaattatttacttcccgtgaagccagccttagccagtcacgctcacaacaagtagaagccaggcggagcctgaaggaggccctgagttaaggtgacaaagttgagagtatagggagaccaaaaaaggctagagtttacaggacagaataccagagaggaaagaagtgtacagggagagaaatcaacaaatctgcagaaggtcagccttaaatattccacggagtactaatcagcccatgcacatgaacatactgcctgaagctgggacaggaccagctgaaagagttagaggtaacagtagcaggtgctcaaataagaccacgaatactgcctgctcccatcaaccagagtagaaaacctcaaggttcaaggggtattgaatagaagacccaaagagccttgcctcagtgacttgccctacactaaatactgctctggtcccacctaagaaagattaaaagcaagaccccttcccctacacacactaaataaaactgtttccaaataacttcactgtgttacagggggaaaaaaagctcaagaataatttgagggatacaaaaatagctagtacccaaaaagataaaataacaacatctggcattcagtcaaaagtcgcagcttcaagaggacaaatacacgtgcagggaaaaagcagcatggtttcactggacggcagtgcattttcactggacagttgtccccagtgtcatagatgaggtcactgatgacagaaaagaaaaacatttcttgaagaaatcagacatattacttttatacaactagtgctcatcaaataacaactaccatacagagagagaatgagatgactagcactggaaagagataatagatgagccactgagtactttcaataagaattaattgtaatcatggctgggcgtagtggctcacacctgtaatcccagcacttccggaggccaaggcgggcagatcacctgaggtcaggagttcgagatcagcctggccaacatggtgaaaccccatctctactaaaaatacaaaaattagctgggcgtggtggcacatgcctgtaatcccaagctacttgggaggctgaggtacaagaattgcttgaacctgggaggcagaggttgcagtgagccgagatcataccactgcgctccagcctgggcgacaagggcgaaactctgtctaaaaaagaaaaaaagaaaaaaagaattaactgtaatcctatacctcaagcaccctgagatggacacacacacacacacacacacacacacacacacacacacacacacattctgctaaatactgtaccatgctataaatcctaaccagtagagtacagctaacacttcacttctcactttgtaaatcacattgaggaggtttctttcacagcttatcttatgaaatggggctgaaacaagtcaacagattaaatttatcaaaatataaaacacacataatggatttggaacagaactgcagctgtatcttcactggctctcctgcagaggaagataccatataactcaatgactccttcttttaacttgtaagtcagtgaaaagaggcactagtttcctgttaaccactaaaccttgtccattatcttaaacatagaatacatcaaaacacctgataggttttcagtgagaagccctcagctatgctatcttactgtcctgaatcacaggaaaagaaatatagaatattaatgagaaatagaacagctttcatacatagcacatataactagttagccaggcccatcaacatgacttggccatcatttacagaaaaatagtattgctttaattaattaccacattttcaaaggttaagggcatgaaaccaatcagtcagcttaaaccttgttcctttcaacaaacgggaaaattttcacaggcaatactttaaaaataaaacaaaaaaattagactgctaactgactccaaaaccaaaattcagtcaaaaggcattaactcccctgaattttaacaagaaatgaaatggttttccttaaaaactcttactccagtggataaattataaatattagaatgaactgcaaaaacccactagagcatctgcttttctataaacacatagaatgtctactggaaaacaagccccactgaaagctgtactgaattacaaataatccactctacacttgcttgtcagatcttagaacaaaacacacaaatatatccacttcgcagtatctgtataaatggacaagtagaaatccgaatcatgttatctgaaaatgttttgcaatcatttttagaatttaataaataaaagataggactttccactttcatttccttgtagtgtatttacattgcacagcaccttccgttagaaggaaccaacacagatgtgggctttctagttggtttctctgctgcccccttctgcttcaacaaaacacagtaggcaggcaacccagatgccaaaaatacctctcgaagccaggtttcgcagaataaacaaatccaggatgactgattatctcattttttaaaagcattttcatattacaattgaaattatttcacgtgctttctgaaatctgatccaggtgtctggttatacaaactcagtaatgacaaggtaaggtttccctcccactcctgaccccagtgctcgctcttgcgcactctctctctctcccttcaacttagaaacccactatgtcatgcaggcagccagaaacttcaagaaccttttttatttcaagttccagggtacatgtgcaggatgtgcaggtttgttacgtaggtaaacgtgtgccatggtggtttgctgtgcctatcaacccaagaatcttttatagtaaaaacataactactttaaaaacttggttctttcatttccgaaaaacagtagaataacattatttctttgcattggtcaaattacatattctttctgtgacagaatttctttctgctaggaacttaagagataatagttacaatatcacgatcatcacacatagtacaaacagtataggtcctaggaggcaaagaccaataactgtgtaatgctgataatgaacttttaaaggtaagggactacacaaacaatagtgattccgaaaatgctcagaatatatactgagcaaaattctctgcaacgaggtatataaacctgaagtgctaaaaaatttcacaaataattattttaaatacacactaaaggataaatttaaggtaaaaacagtagctgacttttagtttatttttccagaactcaaatgtcaggccaaaaaagtcaaagcagaaaacatcataaatgatacctttaaggttattcaaagagtgggaaatatttttaaagcaggtgagatttttccaagcagaaagtgcaccaaatactgaaatcacggaagacagaactcaactccattcctcacctcaaatgcaccgaagacccttagagacaccctagaagcctccattaaatcccatcaggaagttgcatgtgcaggtattatgtgcaatatggtgcacctgcaccccaatgatccaaatgcctcaagctagaaccatcactgacgcttactcaagaatgtcagcgatgggaaacattaaacgcacaaactgtggcgtgttcgtttctgctggtttcataccctttccaacaaatcctccatcctctgccagggaaatctttgtaaatcaacatctgatgagacacctccaggtgatgaaaaatgccagctagtctgaaatacccattctcccttcttccttgagactcccaatttttttttaaaatgtgtgctaaagagaagtgttgtatgaaacttcaccagaacttaaacttaaaaggtatgaggcacgtgctttttttttttttttggctcttctgcctttctttctcaatgcaggggtaatggctggagctccagcagccaccttgaaccgtgcaggaccttaaggatgaaagtcaggtgcagcacaaccaaaagaaagattgacatctgaggaccttctaaagatgcttctctagacttggaatacttccctctagacgtcatttatttttatttttaattttattatttttttagagacaaggtctcactctgttgcccaggctagagagcagtagcacaatcatagctcactgcagcctcaaaatccagggctaaagccatcctctcgcctcagctttccaagtagctaagactacaaacgcatgccaacatgcttggctaaattttttttttatttttggaagttggtctcaaactcctggcctcaagctatccttccaccttggcctcctaaagtgctgggattacaggcatgagccatcacacccagccaagacttctcctatttgagagtataaactgttgtatctttctgccactgtagttgggtctctgtcttgcagctaagtccaagctgtaactaaaacactcactctttttgttctttctttttttttttttttttgagatggaatctcactttactgaccaggctggagtgtaggggcatgatctctgctcactgcaacctccacctccagggttcaagtgattctcctgcctcagcctcctgagtagctgagactacaggcatatgccaccatgcctggctaatttttatattgttagtagagacgggatttcaccatgttggccaggctgatctcgaactcctgacctcaggtggtccatccacctctgcctcccaaagtgctgccattacaggcataagccaccacacctggcctaaaacactcactcttgaacaactctctatcacctaccagaagttctaagccctgctgcctcgccagtttcatctcctgccatgtacgacatacactatttttcttaagaattctattctctatgtctctatgtaggagaggaaaatgtttcttttcttacccatcagttcgtggctgagatccctataacaaaagacagattgacaagagaaaagcatataaatttattttaatgtaggttttaagtgacccaggagccttcagaaatgaagacccaaagaagcagggaaattggtctatttttatgcttaggtctgacgaagaccagagagttatggggaagtgtgattggacaatgggaatatgatctaatggtaataaattggggaaaacttagcaacgcctgtttgttcacattcttcttggtatctctctgcctttgaggataaggatggtctcttctccaggtatagagagtatgcctctggaatgaaggatttataacttgcttcaggagataaggatgagtagaagataagagcgaccttcttgcttctgctgtttgttctaatgccatattttggggtagcatgtccggaaccccatcacttatcatgctccaaattttcatagatgaggggtttcactgcctgaaaccagaccttaatccaccctctactgacctactaaattcctagtcccccttcctaaactcaagggtcgcttcccgtatagtttttgctgggcctctcttctccggccctactgaggctctcctcttcagtctttctcctccttccacagcatcccattcacagtttctacttgttggattcctaaacatctgtatatgtcttctacaaatcaatgggctcttgagttcagggagtatgttgtgtccagttctgtatcttcagcacttggcataatgcgtggctcataatgacattggctagatggccaatattttgatttataaattatgggtcacaggccagccaaacttgaatgtgatttattctgtgaaatcatctccaacccaaccatccctcctgtgtgtttccagacactctgaatgtatttggggttagttatgtacacatctgtcttccctgctaggctgtgagatccagaagggcagggagcacgtatcacacaagctggtacccccacctctaagcactgtgcctggcttacaccacctgctcaatcagtattttctcagtgttgacaaaaatgactacatgaaggatggctttctttaatctcatgttcattccacgttgctacagtggggatacaaaaacgaataaaacacatttcttgctttgagaaggatacagtctaagaatattagaaaacatgaatacagcttttaagacagaacatcatgttgtgtctgcaatctctagcccctaatatgtactaaactttaaatattttgtgatataaagacaaaacaaaagtaatattttactaggacattatcctaatacataatttctcttgctctatgagtattttttttaagccacccagtaaatgtgtagcaacaaagaaccatttggaagttattccctgtcttgcagactgagtcagatcatggctaactgatggtcggtcctctctcatgtttcttgttttgttttgtgtttagggttatttctttttctttgcttttcaccattactatgaattttgaaattccttccattttgcaaaaaaaaaaaaaaaaaaaaagctttcctaattattgttcattataactgtaatcttttaaaaatgaaagagtccaaaattcatctaaatgtctgttaaaatgaacagaagttgacttaagatacagtgtagtttttagtctacatatttaattttcagtgtattcccagagaaatagcagtgttgattatctctctttcatgtcctaaaattaatagcagctcatactgaacccgtctaatggaaggataaagacttaccctccaggccagtaactacaaaatgactgttgcaggaagtaggaagaacatatgctggaaactggttctaaaatgagtaatcagtgatgtcattatagggaaaagagtgcagcgttaatgacagaaaccgggcatatcatctgtgacaagagcatcacaatatagcaaagcgattactacagagttctaatcaaataaaatatcacaagataattaaactttccatgttcagaatgaaacttcagttaatacaacacctacatcctctggagtggtattcaaaaatagttcaattttaaaggaaaaactctcattctccaaaatttcaaatataaatatcccttgcagaatgaacaggaagaaaagactaattaaaaaaaaaaagaatctccaatattctttggagataagtagacacacttataaagaatgcagggccaggaaaggtagctcatgcctgtaatcccagcactttgggaggcagaggcaggagaatctcttgaggccaggagtttgagactagcctgagcaacatggcaagatcccatctctacaaaaaaatttaaaaaattagccagcaatggtgatgcacacttgtagtcccagctactcaggaggcgggggcaggaggatcacctgagcccaggtgtttgaggctgcagtgtgccaagagccaaggtcgcaccactgcactccagcctaagcaacaaagagagtgctgtttctcaaacacagagtcacacacccttatgaaggtgtattcgtatatgacagaactaagaattctgaaaactactacttgctaccatatggcaaattaccaaggctccgaacatctgtcatgtatttcaaaaatgattcactaaatattaatcccattacatgctaatgaaatatccctagttgccaagtaattttcaaaaatgcaccaactaattaaagaccaaatcacatatttgactaaaggacacgtttcatttaactcttagctggacactttcattgaactctggattgcccagtaaccaaatgtaagatgacattgtgtatggtgaccaggccgaactcagctgatgtcctaaccaaggacaccaaacaaacatgcccctgctctccgggactaatttcacatctgcactgaaaaacacaatgaagggcgtagccatgattaacttcaggccaatcaaatggctcccaaaagaggccaattttaaatctatggatcacagaacttcttcataggaagtttctgtcaagggaaaacatactttgagttttttgattttactttgatttccgtgaaacactctctataataccttatagagctaaagagaaaaattaagaggagataacagactgtcctttacaatgtactatcctcttttaccctgttctctcactgaaaattgaataacaattacaaagttcaaaatcacagatatctgacatttggaagtgccagaacacctttcaaaaaatgagctgaatatgttcaaagcaatccaaaattaaagagaacttcaaggtgcaagcaggtgataatctaaacggaagagccatctgatgcaacagcctacatcattctgcattggccctgcatggtggctcacgcctgtcatcccagcactttgggaggccgaggtgggcagatcatgaggccaagagatcgagaccatcctgaccaacaatggtgaaaccccatctctactaaaagtacaaaaattagctgggcatggtggtgggcacctgtagtcccagctactcgggcagctgaggcaggagaatagcttgaacccgggaggcagaggttgcagtgagccaagatcacgccactacaatctccagcctgggagacagagtgagactccatctcaaaacacacacacacacacacacacacacacacacacacacacacacacacaaatcattctgcactgactttcctaatggtggcagtccttgggttccatctttttatttttgtccctaataaaattgaagctattaaaattgtattacatgcttgtattgttttacataaggcagtatgctaagtccaaaatgcctaattaaaacattacaaagggatgcatactgtccatttttcttgtgttttttttcccctgagaaatgcacaattttacataggaaccgttaacgaaatggcaaccctagcacccaaagatgggactagtcctgcatctgctgccatcagcctttcttcctatcaacgcctcttacaagtcatgtctgtcatccttgtcactatatctatatctacgaatataccacattttctttattttaaaatctctccatttaagatcctttccacaaaagatgttgtcttcgtatttacctcactgccaatgcttaaaccatattttgtgtataacaaagtcaataagtgttgaattaatgatgaattatcctatcactattattgcaaaagcaactgttttaataagtgataaacactctctttaaaaagtacctttagcctgtgttctagtctcagtattgtcactaattggctgtggatttaaggcaagtcacttaacctctctagtttgtttcccagtctgtaaaatgtggagttggccaaagtgactatttaaaaagttccaaatgaatgaatgaatgaataaaaaaagaaagaaagaaagaaagaaaagttacttccagcaataaagactacagctgtacgagttttttttaaggttttatcaaccaaatcactaagtctttgaaggtaattaaattgcataaaatccaaagatgctgtccacaaagaaggcgaggtttgaatagagccaacttcctaacatgtacccatcacctattaggtgcaaaacactgagctagtcaatgtaagtgcaaaaaaatgcctaagactgtccctcagttttccaacctaatgagatagatgaatgagtaaaagagtgactacaataaaaggcagatgacataaggccggagagggacacaagcagcataatttaagacagaaaataaccaggtgtgatggcttcagctagaatatatcttggttgagaatgtatctgatgatcatacacagaggcctggacaggcctcaccccaggccacccatgacactgtaatagagtgatcttttctacttaaaacaaaatctgggcggatcatgaggtcaggagattgagaccacggtgaaaccccatctctactaaaaatacaaaaaaaaattagccgggcgtggtggcgggcgcctgtagtcccagctactgggaaggctgaggcaggagaatggtgtgaacccgagaggcggagcttgcagtgagccgagatcgcgccactgcactccagcctgggcgacagagcgagactccgtctcaaaaaaaaaaaaaaaaacacacacacacacacacatctggaatttcccttatggagttatgatgtctcaatgattacggaactttactacattggtaaagatgttgatggcagcatatttaacactgtgaatagtcttccttagtacttcatatattgaagttgaatctgcatcccatacccttcacaaacccctgcataatgaatactatttaagtcatcagaatataactttcatcatgttaattttatctgaagaatatgcactggctctttattgcctgttatgccacattcaaattcctcagacaaaatcccactgtacctatgtggtaaatggggtaaccatactatgtatgacaagtttctatgacaaagaaacttgagatttctagaaaccaggtctttcagatacctcttcactttgatatagataaactaaagaggaataaacaaataaaatttaaaatttttagctatttaatattttaaaagtaatctactgagtatagaacagtttttaaagttcagctgaggaccacgatttatgagctcgaaggaaagacatacttcgatggagtggtaacatataataaaagaccctttggtaaagctaagaggaataaaagaaagaatggcaatggcaaaaacaagagggatgtgatgacgatcagaagtggtgagagggatcctgaataacagacaaatatgggcaatatggctatgaaccttagataacgacagagaggaaaacagccaatcaagcaatcagtccatcaatgaaacatcaccaccaagaaaacataatttgtaattcgagtagtagtaaaaaggagtggcaactacctatccactgtatccattttatacacaacaaactttgaggaatctataagatgtattggaaggaagagactagagggttagaaaccatcggaacagcatttcagtatccccagaagctatcagccagccatctggaaagtgcttcaagcagaataattccagagcactaagaagcattacttacacacagcgcagtgccgtgccaagctaaatcatggagcaacacagcactgcagcttggacaggatccccatctgggcatgagcactgcaaaggagctttagatcagtggttctcactgggggtactagggaccattttcagtattttcaattgtcacaatggcatgtggtagactgtagccaggcctgctagacaggacagccttagataacaaataattacccagtatcctccaagtctttcagatgttccaccagacttgccggtaggtgagaaaatcctgttacttctttgaatatagagcctaactgtattttacttacagacacaagtgtttcttgcactgtttagtagtcactgaattatcaaggaatgcaacatccttaaatgtaaattgaagaggaattatactttgttttgtttgcaattgtaccaagagttgttcatcattgtgaaaaatcatgtcgacaattcatggcatttcaatcaccaacacaataaccaggcatcaatctacatacacagatgttacatttataggattctatgtatgtttatgtgtatacttatttactccttatttcaaagcttcaaatagaaagaaaagcttttgccaatactcagttgaatgttgttttactcctctttaatccaaatatattcattgcaagtaggtccaaacatctgatgacatcattttatctccaggaatagtcaacaagtaagcatttacataataaaatgcactgaaagctatctttctcttttctttatattaaaattgtaacactattttaatacttaaatttatgtgtagaggcagttatattattaatacatttcatttcagaaatgaaggggatattccaaaacacattacaaagatgcagcactgaatctaatagggttagtaaccactgctttggatgcacagagaaaccgtagagagcggattccaatgtatctacacaggaaggtaaagtgcaaaagtaccaaaaggtgatgctagctctgtaaaggaaaatatcatttgctcatgattagaagagagaaatacagattaatgccatatagaactctgaaagggcagcttttcctgttctttgaggatgcttggttattgtaagcggtcacaaggcaccagttcccatgccaacctgagtcaactgcagcaccaaaccatagactgcataaacacctcaatatttctcattcacagaaaaggtgagaacttttttgtcaataacttcaacaaagatgagcccaagtattttcagaaatactagcattttagtgtgatgatactgcattggaaagttggataaagtagacaaaagatagttgagaaatcctgtagaagaattctgtattttgttttagtattttgtttttaaggagctaatttctagtttgttttcttctatttctgttgtctgtaagcaaaaagaactaatttccttactggtctaatccctaaactcactgcagtggaaatgagtgaaatatgaaaaggaggctgggtgcggtgaatcacgcctgtaatctcagcactttgcggggctgaggcgggtggatcacctgaggtcaggagttcaagagcagcctagccaacataacgaaaccccatctctactaaaaatacaaaaattagccaggcatgatagcgcgtgcctgtaatcccagctactcaggaagctgaggcaggagaatcacttgaacctgggaggcggaggttgcagtgagccacgatcacgcccctgtgctctagcctgggagacagagcaagactctgtctcaaaaagaaaagaaaagaaaagaaaagaaaaatacgaaaaggagaggagattatatagctaaaatgagtgtaaacatagattataatttccagtattactattttaattattagtattaagtatgcatttattattatcatcaacttttacaaaatgcagtaagggtagaaatgtaggcgtaaagcaaagccctgtttggtagaacaaaatcctacttggtagtaacaataacaatcaaatacctccaagtcactgttgaaatgttgtcttctccacgaggcctaatgtgactttctatgtaaaactgcaagttgccccaattcctgcactcctcctccccatctctattacgatgttcagttttatttcatagctcttaccagtttctagcatacaaagtaatttgctcatttattatggttatagttgcctcctacctctagaatatatttctatgaggggaggaactgttcactatacagtccagcatgctgaaaagtgtctggaacagggtaagttaaccagtatgtatttgtggaaagaatgaacaatagcacataccatttactgagtgctttctatgggccaggcacattgataagtgctttacatagaaatcttatttaatttttattataaaagcctgcaaggtaaatattatgaatcctcagttcatagatgaacaaactgggatttagagagagtacaacagctgttctacatggtacagccagtgagcagtggggctggccctcaagcccaggcagtctgacttcaaagttccatactcgccacaacagaaactcagtagagctcagatactctttttctccctttagggggtgaaaggagtatctggattagtcagctccattgtgcgtgtgtgtgtgttgtgtgcttttttggttttgttttgttttgctttgagatggggtctcactctgttgcccaggctggagtgcagtggtgcgatcacagctcactgcagcctcaactttccccagctcaggtgatcctcccacctcagcctcccaagtagctggaactacaagcacacaccaccacaccctgctaatttttttgtatttttcggggttttgccatgttactcaagctagtctcgaactccagggctccagcgatctgcgcacctcggcctccaaacgtgctaggattacaggtgtgtggccctccccactgttgatcccattcttgttcattgcgatccttcaaaaaatatgcaagatggaagacaaggtgcaggcaggggacagatggggaatctttgtgtcttcaaaatctctcaattttgctatgaaactaaaactgctctaaaaaaaattaagcctttaaaaataatgtcttaatgcacttgtatttctgaatagttcaattttggggtcatgaaagctttaataggtaattgttgacttaacacctttacaacaatgaaagatttacacctaaacattacatgaggtaaaaggaaatttattcatcaaatacagtaaaaaaaaaaaaagtagaaattaagaatagagtaaagcatggttgacctcagcttttttgtgagagtttctattttctcatttggtgaaactatctttgagggactgacctttcgacattcagcgccatttcctttgactcctggcatcttctgctgcatgttcactattcaaagtagcccaaagggaaccaagacagtccacagctattgttttgccatttaatcaaacctgaataaagagcttgtacacataaggaaagtaaaaactcactagaggttacatgaaagaggctgccatggagaggactcgtctgttcacgtaacatgaataatttccccatcgagttgagaaagttctgaacacatttctttctctttttttttaaagactgaaaaatggatataagcccatagcacttgttagctagtcaagcaaagagtgtactcactaaatttgtgcatagaaacaatcatgatcccacagcaaaaaatacttccttaccatgcccttcatagcaggcattttgaaaactgaaaattctgccaagtcaaatatataactgtagctatgtctacttctgtttaaaggcagagagaagaggaaactaacaatactaattccataatttcagaatgagttgcaagtacaatattggaaagaatatcctcagaaaacaggttccccagaggcaggtgaccacagcaagtcatcaggagaaaaacttatatgttcaatttttctatcatcatagaattcatcccatcataaatggagggaactcttcaccttgagaggctacaatttaggatgaaagttttaacgtttaatatgtagacaaaattatcactaagatcatttagggttgtccaacttttcatgaagttcccaggcctccatattttcagtgttataaacacttgagctcccatttataagccctgaatccattttatgtctcccaaaaaccaaaatatttaaattaaaatacaggtagctcagattgactgtctctcacaggaagaccatttatgctaaaacatgctgattcttatagagtgactacccttttaaaattaaaaactgcatcagtgaaagaaaattacaacctatatttatcattcaaaaagaagctagaaaccttaagtaaaaacagggcatttttgttttcaaaaatccaatttttattctcgttatataacaaagaattttaatgtctccctaatcacaaaaagaaaatgctgtttggattaaaagcagtagttacatgccactcattgcactccagacagttctgacctttttgtaagagaccaattttgtatttcctttctcctgcctgaactattgcactggcttgagagttgggctccttccttccagtcttgactctctaatctatatttcatgccatgaacaagaattatcgttctaaatcgtcataatcatttcattctcctacttggaaactttaaacagctctttacttaatagagaataacgtccaaacttcatactagagcactgaagcaaccccacaatcaaacctcgtcttaacactcctagtcctgtacactacacacactctatgctccaaggactagaagcagataaagtcctttccatgggctcaggaaccttccttgtgtggcttcctcattccctccacttggctgctgctgaaatttaaaatcagcacatgttctacttttcccatgaagacatttccagttctcacagtcataattacttatgtcttcctttgcattcccaacacacatacattttatcttatcatgattagtattatagggggttgcctccattgccctatttccctctattgtgtgagatcaaaggtcttgtcgtgtttaattccagattattataacaaaacactgtgtacatggtggtggctcaggaaatgtttgctaaatgaaagaatgaatgaatcatgtaaacatccaatcagtcaatcagtaagaaggaataagggtgaaatgttgagtcaaagacaggactttgagtgcctgcactttcacttagaagaaccttaggttcttattcataaggctgaccatgcctgctctaccatgataataacaaggaaagaatatacatttccgttacttcatagtcaacccaaaatgatctgagatgtattatacattcccaacactgtgcggggcacattgagagacagaacataaatttcggctataactcttactgattgtcttttgtctattgaaatattcccctcctgactacacaaattgtttctttaaaaaggtgagtttgaaccacaattttatgatttatgcaatgataaagtctgacataaatttccggagaagtctagaactggttattaaacaatgatgaacacatatgaagacaatgaccaattaaagacagaacattttcattaaaatactttatatgaaactaaatattttcccttttttatatggttataaggctgaaggtcagaaaaagactataatgtttaaatgagaaattcttgatgtccttctgagcacaatgaagaagcacaggggaatgatatcagttatgtttgcaacacacccaaacagtatagactgaaaaatgaatgttgaaattcaatttttagcactatctctaatgggctgttattaagtcctggaattgggacaattctactaaacatgcccatcggcgacttggctgagatcataaaaggcatgcttaccaaatttagagatgacaaaaaattgggagaagtagtgtatatattaaatttatatatttaaaaaagctttacaagaaactcatcagattggaagacgggcctaaacaaacaagattacattcatccagattaaattccaggttctgaatttatgtttttaaaaaattaattgggttatgaaaaaaacaatccatgtacatggattagaaaactatatggtcaaataatctttaacaagagtgctaagaccattcaatggaggaaaggacagtctttttgacaaatgctcttgttaaaactgtttatctacatgcaaaagaatgaagttggatgcttacgttacaccatatacaaaaattaaagcacctaaacaaaagacctaaaactataaaactctcaggagaaacataaaggaagtcttcatggcattggcttgagcaatgattactcaggtatgatacaaaacacaggcaacaaaagtaaaagtagaaaaagtgggctacatcaaaattaaaactgctatgtatcaaagaacacaatcaacattgtgaaaaagcaatccatagaatgggagaaaatacttgcaaatcatttatctggtcagggtataatatccagaatatatggataactccaaaactcaacaacaaaaaaggaaaaacccaatttttaaaatggggaaaggactcaaacagatatttctccaaagaagaattacaaattgccaacaatcacatgaaatgatgttcaccatcattagtcattagggaaatgcatattgaagccataatgaggttgccacttcacattcactaggatggctactatcaaataaacagaaaagaagaaatggcggcaaggatgcagagaaactgaaacccttgggtactgctggtggaaatatgaaaggtgctataataaaaactacaaaaaacagtatggcatttcttaaaaaaacataaaaataattaccatattatccagcaatcccatttatgggtatgcatccaaaagaactgaatagtatctagtatagtatctagaatatataaagaactctcaaaactcaagtttgaacaactgaacatttgattgaataactttcccaaagcttgtcatttaaatgaacccacggcatgactgagggaaaagcagaacatcataagattccactcccaggctcgtgaagttactgaaaacatctattggtccaattcccaccaagttgggaaaggatgagaatgtttcccataacaaatctccacactttactcaatgaaaaacctgaaaaagtaaataaataaatacttctaaagacctgagtgttgttaaacttattatctaatgatagtatctcattgttccttcagtttttaatatagttttccttagttaagaatgtacaggaaaagaagggccaaaggggcctgttgcactgcttacctcaccagcaactatcttcttgatatatgtcatcacgattggctgatactaacggaagcaggggtgtggctttattaaagtgcatcaggagaaacatcttcttaaggaaatgccagcttttatattattttataagaagaaggagaaagagggagaacacatgtgcaagcgagctgaatgcacacacgctcaatgaactcaactactgtcaaaaaaaagcttgaaaacatttcactattttataatagccacagctgagccagcaaatgacactgttgtagctactatttatataattaaaattataccctaacatttcattttagaactccatattaaaccacttccatctttaagctaaaagcacttcaaaagaaatgtattcttgttatggtcaactaattaaaagtgcattgtatctggaccagaagaacctatttccatgcacaggctaaagacagcccggggaaatgactagtgaaccttcagataagatgacattttaattttcctttatatatcacatcgcctacacctagcttcataagcatgtcagctcactttgtcacctgctgtattacattaagaaaatgtttttattttcccaccttttcttctagaagtggcctatgactgacatttcaggaggaatagccttacttggaaatattctcttttataaatagtactcccaaagtctattccaacctaagctccacttcaacataatttaaaatgcagctttctatataaggcattttatatatgtttattaaatgccttataataaacacttatgtattcaattcagctagatcatgtatatgattcataagtaatctagataatttataaattttatacactaaatttaaattatatacccatgattttcatcacataaattaacacatactatttatatgcccctagcagaatatgcttcagaatccatgaatccattgaaataatatgcaaattttatatctgtacatacatgtgcttagctttccacagtttctcaaaagaatctgtgaatcaaaagaagttaagaaccactagtctattcccaaatgtccatcatattatttaaatataagcagcatctctgaacaggagacataagaccctctgacttttagagggttaaataaccatgcagctttccatttgcatctacacctatatgcaactgaaattgattgaccacattttcttcccccccctgccgcttttaatgactcatttttaatttccacttcaatgctaaataatatctatttttaaagtgtgcttgtttgcatatcacaccaaactaaaattacatccccaagaaaatgttcccagtcaagctaaaaaaaaaaaaaaaacttagcatatatgctgaagaggctgctgtttggtaccttggttagtgctgaagtaggcaggaagagctggaaatgcaaaacagcttctctgacttagaattacatcaatattacagttcaggaaaatcacattatttaaaactataacatgctcataaaaattcaaaaactggctctttttctgttacaatatgctgaagagctacagtgattcagtcatctacctgaaagcttttgtttcaaatcctttctaataggtctcactactcctctgtgaatggtttagagtaggacctttggtcccattcatccttctatgtggagcatcagacacagtacctgcgaacacaaagcaattcaaaaagttttttattaattaatattgtatgacctaattaaatcctaaaatttaagcttctggaagctatcccagtgtgcacagcttaagtatgttctaaaatgacagaggggcaaaagtaagccatcttagggacatgcgtcaaattattccaaacaactatcacttccagtaacattcctgagtcatctcaagataagtccatgctggcaaatatagaagtcattaggcaaagaacataaatttgcttaagatgcagaggcaaaagtgatcccaatatcaatcaccttaaagcttcataattaaaatgagtctggcaattgtctcagacacacacacacacacatacgtgtatgtatacaatgtatacatattatatatgcataatgtatacatattatatatgaacagagtagaaatatacagctaaaattgttttaatatacaaaccaaaatgacattttaaataaaagagaagcatatgacatcatccaagtagaaggaactgctaagagtcatctagttcaaactctaatctggtccattacctttcaagcattcaagtaagttttctgtcctgttttttaaaggcctctaggattgtataatgtatatcaagtgtaaggctttccaaaatcatcctttattcacttatgcaaaataagaaagaaaacaatgtgagaaaagatgaatattctcaaatctggcagtgcctgctgataacttctcactgttagatcagagagttattggtactgtttgtcattcatgtcctgaaatcttcaagtacaccaggaactgcacatgttcccaaaccaccatttcaaattagcaccaacagattggagttaatggcacatataacacattctgcagaatttaaagctttcaggccagctctaataggtagctgtgccttgatttgtggttattatcctacaataacataaaaattagctatccaggtaaagagtggctctccattttttagttggctacccacccccaattccaaaagcataggtccatcatgttcagattttaaagttgaaagaaaggtagacaccttagacacctcatggaggagcccggagacagttgtgaataatgctgccccatctgagatagaaccttcttttgttatgtactgggcacttaaagaaaaaaagtacaactctgtaatggcaaaagaaaggtgcaaaaaaatgcaggatagaagcagggccttgagaatatatctgggagttggaggaagaaggtgggaaaaaggctgagacaatgtacagcatgggctctgcagactgggcagggagaacataacaaccagtaggcaagataaggaatacagttaaatgaatcaatgagtgagtaaatgaatgaatgaaccaacataggaaccaatgaacatacaaataaaatgaatgaataagtgaatgagtgggcatataaatgaatgaagttgctgaatggtaggctggaactaagatgcagacagtcctaaatgtcatgtaatgagtctgaattcatccaaaaaagcagaatgagaaagacatttcttagacttctgcagagcacagtctgcccaactgtatgcacagacctaactaaaagcaatgagagttcacggaaagtttttaactctattaaatcagtcactgtggaagatcattcagggaacagtaggcagaggataagaaacagaagtcttacaacaggtccaaggactacgagctaagcaattgggttgttgtttttctgatcatgcatatactagaattttggatttgggtttttttaattgttatataagtcacgtgctgtaatattcatgcttctaaagtatacaattcagttgtttctcatatatttgcaaaactgtacactcatcaccactatgtaattccagaatatttcatcactccataaggaaactctggacctattagtggttactcgccatttctcctcacctgagtccatgggattcacatgttttaatcttaatattaatttctcctttatgtatctccccaaagtgcatacaaggacaatataagggtatctgcacaaagcagactctcagtaaaagatacatgattatctgccaaagaaatattgtcagaatgcaggaagtatcaagacaattttctttgctacccacctgatgcgacatttttactctcacacggtgagtagcaattttcaaggttcattaagttttttaaagtatcacttggtttcccaattgcaaaagtttaagttgtttttctccccactggataccataacaacctaaatatagtggccagatcaaaagacggtaaaagtagatggtgcacaactaataacccaattcagcaaccacagccttagatcatgatcgatttttccctccaccctacagagtgaaacaagttctgagaacgcacaggtgtttctctgcaagtccctgggcggaagtagcgggttataggataagccgatttctttttccattttaaagtcatctaagaaggtatttccattacattttgtatataattctactactgagttttggaatggctctttggtatttgggagcacacatttaaaaaaaaaggaaatctccaaattcctctcagagattattaccctgaattttagaacaaatttcatttaggctttgtatgtcatcccccattacacacacaaacacataattttttttcttatttctgttaaaaatgtaaaatacctttaatgataaaaagatattccttaagataattaaatccagctgaataaaaatatagtatgtatgtcttactcattttcctcattctgtgcatagggccaagggactaaatttacacatagcaccgaggctgtgcacagtcctcctctgtcccatcctcactccgccccgagtgctgcactgtgagaacaagacaccctcttcgtatatattcgctcactacttatgaaagatatttgcattaaaacagttgttttcataatactaagcttctaggatttaaaacaaaataaagcccgaactgaaaacaaaaaacaaaaaacctgactgcattttggtcagttcatctcttcctataaactattttaaaaatttatttatttatttattttttttctgagacggagtctcgctctgtcgcccaggctggagtgcagtggcgcgatctcagctcactgcaagctccgcctcccaggttcacaccattctcctgcctcagcctcccgagtagctgggactgcaggctcccgccaccacgcccggctaattttttgtatttttagtagagacggggtttcaccgtgttagccaggatggtctcgatctcctgacctcgtgatccgcccgcctcggcctcccaaagtgctgggattacaggcatgagtcaccgcgcccagccaaaaatttatttttaaaaaaagtttaaatactttgcacagtacctaaatttctttgtaccgctctctataaacaaatcatgtggaaaatattttctaaatgctcaggtctgtcaagtttgctagacataatctaatcccttttgtatcttctctcagtaactcaagactttgtaaagctgcaggacagttaagacaacagggacccaggggacagagccttcacaatcagtcacagcagccaccaaacccctggcctgagctatacagaggaaggggtttttatcttcttccttcacaatgcctgaatactctcaaggaatcctccataaataattcattagcagcaaaaagaatacagtctaatcaataaggagtaatggcgaaactcacagcaggttcaggggactgattgagtgttacattaatgtctgattaagcttcctgggaaattttaattgttcatagaccaaagacctaaaattaaccttttaaccttctgttataaagggtctttctcaatggaccaaaaaatgtttataaaatatatctaatgaaaatgggaggctaacatgagtatttcaatacatagattttctcaagaccacacagaaaaacagaacttggttgacttcattctacctaaaacattcctaatccaatcatattgtctaatatttaatgattattttccagtgggtgttataagagctttataacacactttcatttctcaactatcaattccctattttccaggaaaggaatttagcaaactctgcactctttttctctttttctagtaattccctttgtcaattcacagcaaaacaaactgcatgccataagcattcaagaagctgagtttgaaacacatttctttaacaaaaatgaaaaattctgattttatagttacacatgtagaattttaaattaaaaattgttgatatgtgctaatattacacagaaaatccaagatggttaacaatggtgggttatagaaggccttaatgacaggctatttctccaattttgttttgttcaagctaatgttaaaagaattgaatatttcatcacactctgagaagacagcaaagaatcctgctggaaaggaaagagcagctgatctaagcttttaaatatgccatggatagtccgcacaaagatatgaatcacctgtgtttcactctacaatgacacagctctccctttcattaagatatgaatcacccatatttcactctgcaatgacacagttctccctttcatcaagatattcttttcatcatgtattggttgatcgaagacaaaacataagaatggacaaatcattctttagttacataagaatattatctaaaccaagatctctttcaaaaggatcatgaagaatgcacatatatacaaatgagaagacttgccagtaatggtcaatgaggtacaagtgccaggtttctgctgaaatgcttggtaaaacaggtaaaaggatgatgggttctggggatcaggacctttcgcttcaaattccagctccaccgctttggatgtgcattattttggcccagacacttttctctaagcctatttcctcctctggaaaattattagtggtattcatcttgtacacgtattctttgggactaagaaaaaatgaaagacttacactttctagcaacaatataaggtcaacaaatgttagctttagtattagtactagcaccagtagtattagtaccgctagcagttactgcagctgtgcaacagagaacggaagtgtccaccatcttcattgaaggaactgctccgtggtggattattttcctattaaagtttatactttaaagcatcaaacctttttatcccgcccatttggaaggaaatgctatttatttatttattattttttagagataggggtctcaatctgtcacccaggctggggtacagtggcacaatcacagcttactgcagcctcaaactcttgtgttaaagtgatcctcctgcctcagcctcccaagtagtagggactataagcacatgccatcatgccccgttagagatggagtctcactatgttgcccaggctgctcttgaactcctggccttaagccatcctcccctctccgcctcctgagttgctgggatcacagaactgagccaccaagcccagctggaaggaaatgcgtttcaaatgcacatcacggtcactggcttagcagagtggagtctatcttccttggcaattcaggaccatctttaggatcaatacttactatcttatataacttatgacagtagaggtattgtcaggggctacccaagtgggcaggcttcattcaggtgacctatccgttcaactgctatgtttttcttgaagctggtgactctgtcaggaaaactcagaacaattctcagaaaggttcataggacactaaatgtcttagggtcacatggagctaatacataagggagcagtcacttgaacccaaaagtatctggcttggaaatcaactctctctaacaacccatactgaactcagctgtcactgtatacacacaacagaactggaaactctgcaaaagatctagcaggatttgaattccacacgatatgagcaaatgttgaacagggcgacaggatacagctaccaaaaagcctaatggtaaaacaaagacaaacaattatttctcaaattttatcatttgtacggatattcaaaggaattttaatgtcttaagcacaccttgacagatggtgcattcctatgattacttactttcattttactgtcctcaattctctccttcacagttatggtagccaacaaaagcaacagcagcataatgtctattaaacatgtacagtgtgctagaaactgtggtaagtcctttacagaaccacagcccccctgaatgtactcaaaattctgcagtaaatgactaacatgccaacgtaaacacatttaaaaaaaatcttcatttaaatttattaaacagtccagaattcataaagcaatgtaaaaacattcaagattccatttagtaaacacatctcctggaatacagcactagttgctgtttaaaccctggtgattgagttctatgttcagtggaagcagagtcgagctggaagcaatgaaagacttattttgaaacaaagttaagtttcctataaagaagtcaaattatgtttgggttcattctctttttcaaagttttcctcttccttactctcacatttaagaaattacctttaagcaaaaagaacttgctcagaagatagcagtcactaagaatcaggcatcaccggccttgaacctcagtataccacattcttttttctttctttagcaccagaaggatacctctcttctcgattcagtagtcccccttacccttaggggatacatttcaagaccctcagtgggtgcctgaaaccacagatagtactgtaccctctatactctatgctttttcttatacatacatacctatgataaagcttaatttataaattaggcacagagattaacaaaaataattactaataaaacaattataataatatactattcacagtctcatggatagattctttcttcctgtagatcttagcaacctcagcgtattttttttttctttccttattaagtcgggaactttcaccttttcactgaaggaagcactttacagcttctttttggcatatccaaattgacagcgctagtcttgcactttgggagcattattaagtcaaataagggttacttgaacacaagcactgtgagactgcaatactccatctgataactgagggtgactgctaggtgactaatgggtaggtcgtgtatacgcatggatacgcttgatgaaagaatgattcatgtcccgggggatacgggattccatcatgcttctcagaacagtgcacgactgtaaacctatgaactgtttatttctggaattttccatgtaatatttttagactgtagttgaccaaaggtaactaaaagcacagaaaatgaaacctcagataaggggggcactgctgtactttcagtagagagttctcgtaagtatattgctcttttctggacacctacaaacacaaattggccagaacatcatgaagcatgtttagtgtgaagacaagtaagaagggcttggtgatcttagttccaacctttggcagcttcttcatggagataaacacgagggtagaaagttctgtgcaagtctggctgtgcaaccagcctctcttaattgtgtaagacccacatggaatggtaagaaataattgccaccacaatggacaacaaaatctcactaatgtgaattaacaggcaaaaaagctaacctggattacattatcttttttaatggaaatacagttgtatatttaatacacacacacacacacacacacacacacacacacacacaaacatgcatcctccaattagactaacagtgtagagggtcttgggacctgcttaaaggatagggactcttagtgaatcatgcattactgcaagaaatacgtcttcccaaaggcttcaaaacaggtgcctttctttgtaagtttaaacagtgtccttgcagtcttgggtatacaataggattctaagtcagttctctccataacacattttgaaagaaaaaaagtcaaagcaggacaggcatggtgctcacacctgtaatcccagcactgtgggaggccaaggcaggtggatagcttgttcaagaccaaccggggcaatgtggcaaaatcccatctccactaaaaatacaaaaaatcagccggctatagaggcatgtggctacggtcccagctacttgggaggctgaggtgggaggatcacttgagcccacgaggtcaaggctgcagtgatccatgattgtgtcactgcatttcagcctgggcaacagagcgagaccctatctcaaatcaatcaatcaatcaatcaaagcagcactatatgaatcatcataaatgtcaaattagtaaggtctaaattctagattctgcttattcatgctttgggatcccagcctctatgcttctggatcctcccatctgttaggtcaacaccatttacctatatgtctagaagaatgctccactacatcacctcacagaagggcacaggatcaagatattgaacatttgatttaatgcagaaaaagtaactttcccaaagccttgtgctttccagccaggcactcgtttcctcacacaacagcagcatggctaaccaacagcttccagaagtacctgtaaagattgataactttagctggaggaaaagctggagattttcttctccattccctgactgtacttataagctacttactgcagcccggcaaggctctcctcacctggacggacagcctccctgtcgagctgacaagagctgacggatacacccgccagaggactactaaagatcgggatgctgctaccgccatgtccctggcactcttcagggcaagcctgggtaccaatgtcttctcttactcatggcaaacactgacgtggaaccagcctaaaaattctaacacagccccttctcaattaaatttattgaatgtgtttttggtattcgaagctcatttttatgtttgcaataatgtcagtacaactgatccattattattaaactacagtttttaataaaactccatttcaccataacatctaaaatactgcagctgaacttgattaattataccctagaagaaagtaataacagatttccctatttcaaatacaaaatgggaagctcctgttttattcttctaattatatgagaatgggcaaagtaatataccctccctgtcaacaaatttcagaaacttgcttttatctttttatttttcctccagtcagagtccttgttaatgacaggagcatatcataatttaattagctgacaccaactggcaatctacccacttctttttaattggaatcatttcatagaactatccataaaggcccattttgcataactaataaccttcataaacaagacctttggaaaactgctgactttaatggaaagagataaaacacttggacacaggcaccatgttcccacttcacagaagactagggacacagaatttactctgcaatgtatataacagagctaattcaggaagcacgaatcgggtttcccggatctggatagcaaaaaacttccagaaagtcaacttccccaccgcctcacgaaagcatcctaatagttttgtatagtggaaagaacacaggcttgaaaatctgaatttgtctttcttctttctttagacaaggtctcactgtgttgctcaggctggagtacagtggctattcacacactcaatcatagtaaactatagccttgacctcctgggctcatgggatccttctgctttagcctcctgagttactgagactacacatgcctggctcagatgcaaattttaatctgagctacaatgtgaccttgatcaagttcagaaacttctctgagcttctggttcttatttgcaaaatgaaagcggtataacatctaactcaaaaggctgtcaggaatattagttataatgtatgtagtgtcagcagcgaatagctcaataaatagcttttattctcccaattattacatattaaatttgactaataatactgaattgttgggatcatattagataattttgtgcaagtgcttagacaattaaaaggcaatataggcatctgagcttcactggattaaagacaagttttaaagtgctgttcttacattttacttgttttgattattgattaactgctatatactcaccaaatgttgctgccttcaatgaacctgagatcttaagagcacaggcttggcaatcaggtgaccgagtgtgaactcagcccactttctagctgtgtaacattcagtaagtagcgtaagcctcttaaattgactttccgacctgagaaaagcagctaattaaaaaaacagcattcatctcacagacatcacgaaggttaaatgaaaccatccatgtagactgctaagcataatgcctggcacaaactaagtggtcaatatatgttagtagctattattgaattagtgacaatccaagatcgaatctgatacaaatgaggaagtgagacttagaaaggtcaaagagtcttaccgatattaaggagtagaggaaggaattttattccaggtctgtctgacttcaaaactcatattcaaccctaatgcttttaaagcactcttaaagcaggctcagtcattattttctaatatacagttattgagtattcacaggctgatcgaagtgccaattgttgaggatataatcgcaagaaggtagagggtatccctgccctcagggagcttacctatctgggagaaatagataaagggcaagacaagaaagcatgccatgttctccgataaggaaaatacaccagcctaaaggtgcaccatgcaggaagaacagggaagtgaataaacatgaactttttagaagaatccaggtactaaaacagcttatgaccttttcttaaaactaaaatttctagggatttccagcaacccaggacatttgtatatcaaagaatcaaactacagaactgtaaatggaccaaaaagaagaaaatgcttatggcctgacctcagtagaacacgtacctgcacatgtgagttaacgacaagggtttgggaaagagacctctgtccaaacaaacctccttctccgccaagtgccaacacccatccttccttcagcagttaaagaggagacagtaaacacaattggctttctcagaatggagggtatgcagacccggtgcagggtaaggcataaaagactaacagaagaccgtcctgggggtgagttttgaggaagacagaataaactagaagtgaagcggagtgtggagaaccagtctgggaagcagagactagaaaggaggcaaactgcccaggaatctaataatggggcctacacacccatgctagccagagccacatactccaattcacctagaattggcacaacagcaccaattctgagaggaggaaggggaaggatggcagaagagaagaaagaaagcagcagctgaaaatttcaagaactctccaaactgttcctcccttggtgaaggttgatggtgtcgtccaatcactgcagcaaactgacacaggggcctgcagacggttgtgtgtggcttttggagttagagacaggccgttttcttgttaatcggcaggcaggcgtgacagtgttcggcagaggacaatctgttcgagaataattagattccccctcgcttcttgcgttggtggcggaagcacccggagtatttacaatacaccattttgcttccatccgagtccatatgttcgctggtcaggttaaaactgaggctgcatggcacatttttcactgtaaacaacgctgccccggcaaaccctaggggaagggaggcgatcttgccctcttaatttcccagtccaaggaaaggctcgccttcaggaacggcagcagcttcgatatttattgctggagaaaggccacacctccggggagtcatgtcaggagccataggtccagccaggggagcagccctcatttgatgtgagacaaagaagctagaaaacagcccccatgaagagtatgcctttataacatgttgaaagtcacgtgaatcaggacgtgctcggtggttgtaattccatctattgatggcagctgctgctgcaacagggaggccggctagggctgcacactccatggaggcggtgggagcctcacccattctgggttggggcaggggctccgtgggtgccactgcagccacccaaatcgtggctgcagaccaggcttcctgctctatggagcaggcaggcgccccgccttcctgggtggggctacagctgcccaaactgatgctggagatcggagcttccctgtgctcttggtgggggccgggagcagacaggatctgccctccagggtagagctgcagcctccctgctgcggctgcagacctgggcttcgcgctcaatcgagcaggcaggagccagggacaagagggagccccacctttactgagttggtggagcgtgaactccgcaggtgcagacctggcatctctgcagcctgcaccctggagggcccgggaagacccgccccccacttcatccctgcaggctcgggggtgtctgctcccgcttcccagcccctctcctctccagatgcctgctctgatctccgaccggggttggggccgagcccggggcagcaggaggcagagagattcctgggtggaaggcggcagtccccgtaaggcccctccttcagaccagggagggcctgaaggctgggggccaggatgccagtccgggaccggagtggggacttgtggtgcctcgtctgggtgcacatggaggaccatgggccaatcggcaggaacttcctcccctctgaggtccataaaagcctcaggctcagccagagcagggcacgtggagacaatgggcgaaccagctacagagaggagctgccctctgctgagagcttcagagacctgcagagatgtctgaacggcctgcttgtgaagaggagccaccatctccagggcctcctctctgctgagagctcaacactccactagatgacctgcctacagagaggaactacccacagtgggcttcctctgagctgttctgacactcaataaagctcctcttcatcttcttcaccttccacttctctgagtacctcattcttcctggacacaggacaaaaacgggcaaaggtgccaccagccacagaggtttccggccagaaaagcgacaccccgaagatcacataacactatgatttggaggcaaagaatggaggaaaatggagggaggaagaaaagatggagaaaaatctcttaggcatacatgcctgctgttcaacaaacactgtgctaggcaaggtatacaggccatctccaagaaaagatgactaagtgacttctggaacgaaaagcacaactgccatcctaaccccctccccaacattttccagggatcagccctttacttgttaataagcaagaagacaatgcatctgttgcaactgtgccatcagaggacaccagggcagagttactgcagcacttaattagcttagtgcacttgaaggctcagcctggagttctcaggtgagtggcaggaaaaccctacaactcagggtgggtcccaggacaaatgcagctgatgtcagaaaactatgtttggcaatgcagttagagacaaggagtagacgcctcatttgagaatcatttctcgaaagaaaattctagaaatgtgacagtagctggaggaggatgtggggtcagtagagatgaaaaatatgcaaggcctgatttttaaaatacctctttttgcatttcaattaaatgattaaaaattagcactaaaaagaaccatggagatctatatcaaaacccttcttttctctacgaagaaactgagatgcagaaatgttgagtgactgcttgtctgagacacctagctaatgaagagcagggctcgacttagaatttaggattcctgtccccatcactgggcctctactccatctaccacaatgccatgccatgtttctcactctgctgtgactgatcctcaattttagttttagttttgtctttattaatatgtttcaaaataccctaaagagaaaggtatcagattaactagcagaagtgataattttttttcctttcaaaaggaaaattttaactaccttcaccaacaaagggattaagtctgctctatgatggaactgcattaaaaataatgaggcagataaaaaaaagcttttattattttaatgaattcaaaagccggaagcattattgagatgagcagtgtgttactgccctaatccaatgttaccatgttttaaaaattattctgggtaggaacttttctgctacatcagacaaaaccccaaaatatgccaagtagacagaatattaaattaacatcaaatcctcatccctttcaaaatagagatcacgattctaaggagcatccttgaaagcaccacctataagacacaaaacttgctcatatgcaaagatcacccctctgtctacaatgtaacccaaagattcctctgtctgccatttaacccatgtcctaagaaatttatgattctacacattctttatctgaaacaaccattaacttctatatgtacaagcaagttaatttaatctctctgttcttttgcatccgcagctatagagaaagaaattctgtttttttaacttaccttacagggattgattctatagaagaaaacatcacagtaacatttggcataaacacaaatttgccactttaatgtgatactctcttaagtctcagaagaaaataacagaatcttctttcccaatttcaatgttcacagaaatgttactcaaagaaagtatactataaactataatattccattcttgtgtactatagactataatattccattctctttcaaaacagatcacatttcttggccattaagttgacaccattctgccacattcttgacacatcaagtttagaaattagtactcgggtaactgtgggaacaaaaatgactctggtaaagtgaagttaattacatttaacttattctgaagggttgtattttctaccacagctcacttatacagaccactcccattctgtaatcaggcctagtattacaaaggtatgctgaagcattttttacatctgttggttaaaatgacttattactatactgctaattctgtacatactgtactaatgtttctgtctgcataaagcacaagaatagcctatatggaaaaactgggacccaaaccaaggatttctcctctgcagctatggaggggatgaagcgagtctatttgtctaagaagggaaatgtctggcccagccgtggaagtccaggggttggggggacatggaaaaaggccacagggaaggagacaaaaccagaaaaccctgtccacattaccacagtgacatcccaatggcttactcacttcccctccagagccctgccaaagagccaagaagtcttaaacatcatgccccagcttaccatcctaaaagagatggaggaaggcttgttcagatggctggctccaggttgaaatgatactctagagaagttattactcataaaatattccttggctgggcgcagtggctcacgcctgtaatcccagcactttgggaggtcgaggcgggtggatcacgaggtcaggagttcaagaccagcctggccaagatggtgaaaccctgtctctactaaaaatccaaaaattagccaggcgcggtggcgggcacctgtaatcccagctactcagaaggctgagtcaggagaattgcttgaattcaggggacagaggttgcagtgagccaagaccgtgccactgcactccagcctgggtaacagagtaagactctgtctcaaaaaaaaaaaaaaaaattccttgaggggaaaaaatagccccacagccccctactttcaatatcattttgtccttctacaagcaggatagatggacttcctgttagataatgaatctaactccctttttttttgatatggtacaaaaagtatggggttcatggccaaggtgtttaaaatcctggctctgctacttagtgcaatgaaccaagtaactttaatttctttgaccttcagttttcccatctgtgaaatgaggataacaaacctatgttgaaagactactggaacaaagaaaaaataaaaaactctttgaaaaggacctagcctatagtgtcacattcagcatctactcaataaatatttgtcgatccttcctccacagtcctcactccaccagcagacagattcaaacatcacttgattagatgagcaaataattttctttaactacccaagtatctttaaggcccgtttcaaccccagaagtagattcaataccatacagaggtattttcagagcctagctgtgcattcccaaggattcaggcgtatgtaggcctgtctggcattctactaggcctgctttccagtgaccttcctgtggcaggagccgagatcttctggagaaagtaatgggaagaagcaaatgcttacagacttggtcaaaagaaaatggagaaatagaagaaggaaatttcaagtggacaactccaacccctgagtcagaggtcagcactgtgggatgtgggggccaaaacaacaataaatgaaaaactacttcactgagaacgctgtttctgggagctcaaggaggaactacttcctctggagtctgtgaaacaaaacaagctccctggaagtgaagggttcagcccagtggctgctggagcagaaaacaaacatgaaagtgcctgggtgacaaaataagagaggctcccggcaggcagcccacatccagaggagagaaaaggcagcctgggacacctggcgtctggagagcagggatgacgatgtagagaagtggagggaagagagtgtttgttaacacatcctggggacaagggtgtagtccacagatcagccacaaggacactcagaactgacttggaggagcttgtcattggctatgtgaagaccgagcatggaagtaccatgttgttgctattttcatcctgagcaattataagttggtaaagcaagagttatgtgccttgaaactaatgccacctcagtctagctgctcactcagagcaagtgcagaggaaggcaagggaaccaatattctccatacacttgctatgttttacgcactgagtgaagatttttctcatttaattgcatgtaatttcattctaaagagcagacaaacaatttcattcgattagatatacttcctcaataaaggcttttgaatgaaagcaaatttcattttgctgatcaggctacactacgtgagtgtgtccttatagaaataaattaacctggaattaacattacgtatttttgttgttgttttcaaagacagagtctcatcctgtcacccagatttaacctttctcagccacatctgcaaaatggggatggtaaaaataggtaatgataggagctatttcacactgttttgaggactgtgttactacacagtaaggtgcctggcacaaagtaagcactcaataaatgttagcaatttttatgttttataacactaggctgctaagctttgatggaggaaatcatgcaacaaattctggggagtgtttcctcaacatatctgatgtccaattttctcttgtagctgcatggggcccagaaccgtatcacatggtgcagaagttctctcaaatttccaactgtctactcaagcaccaagcctctgcgtgtgtgcgtctccctcagatgatcttgcttccaaattcacaaagaaaacagaagccacagccctgctaccaacttcctacccaacccccataaacagcattatccttctcctttaaactctccccacttttgagaggaacagtcctcctacacagaccatccattctcctgtgttccacatcctctctgtctcctacagtcataacctggacttccttatcttcagtctcatttacttcccactcatcacttcccctcagcctaaaaccctgctggagatagggaaggagggagggagggagggagagggggagggagggagggaaatatattttatttatattttgattggccgattgcttttcagggtttcactctgtcacccaggctggagtgcagtggtatgatcatagctcactacagccttgaactcctgggttcaacaaatcctcttgccttagcctccccagaagctgcgccaccatgcctggctaattacttttttgttttgttttgtttgttttttaatacagacagggtatcaatatgtttcccaagctggtctcaaactcctagcctcaagcaatcctcctgccttggcctcccaaagcctgggattacaagtgtgagccaccactcctggcctaagtcttctattttaaacaatcccacctttaacctcattcacctctagctacaacactttatttatcccttaatagccaggttgctagaaaaaaaaccctttatacttgctatcatctccatttccccaaatttccaacctctcataatatgtactgtgacatcattaggcactaaatctacccttgctttgggtgggttctaatgacctcttaaatgcaaagtgcagaagactttaatcctttctgcttactgccccatacatgagtcactccctcttctacattactgtggcctcattacactgcaagtttactaaaggcaatccatcaatcaatctggcatagctttggctatatccactcatgtggtattgcacgcagcctacattcactgaacgaatcaatggaaataataagggccttaaaggctccgatggcttcattgtgccatccgctctgcttctatcgctactaactatggaaaaagttaacatttctcttactaagtgaatgatacctttggcaaagtaagatataaaaggtgtaatgttctagctgatcctgctccatacagctccaggtaagtaatctgccccagtgagagatctgtttataccggcaaagtgcttcagggcttaagtcttcagaatttgacccccgctcacggcacagaaggatgcccaggacacactataaagctattagaaattgaaaccaatagccctcctagtttcttttaatagactttcagatgcagtgttttctgctttcctttaaaaacagtagaatagtaattaacatttagtaattttcaaagcagttgtgcaggaagatttcctgaactatgaaagcccacaaatttggcaacaagaagtatcacaacagagaaacagctcttggtttattgttcattgttccccacacttagttaatgtgttacaatgacaatgtatgaaatacatgaagttaccatcaaaacaaacaatgttttttttttgttttgttttttgttttttgttttttttttgagatggagtctcactctgtcgcccaggctggagtgcactggtgcaattttggctcactctaagctccgcctcccgggttcatgtgattctcctgcctcagcttcataagaagctgggactacaggcgcctaccaccacgcctggctaattttttgtatttttagtagagacagggtttcaccgtgttagccaggatggtctcgagctcctgaccttgtgatctgcccgcctcggcctcccaaagtgctgggattacaggcatgagccaccgtgcctggcccaaaacaaacagtatattaaacaagaaaaatgaatttatgaattagctttcttccctcccaaactcccttactctacacaagtcattcctgatggagagattgaaataaaatgagaaatttaataatgaataatagtaatactattactaataattccagcaattatactggtattactttaaaaagaaaaaaatattgcttaatctttagcttttgctccacagcaaattccaattctttcaggacacagccaagagaaagcagataatgttcgtcccttatttccatacgtttcttgtttcaaaatggcaacccaaaaggaatactccactgattgtttgtagatatgctgattaaagaaaaatataaaatttcaagcccatcaaccagtgctgctctataataatcaaaaactacctttacaataaaaggttatcaaaccaaacagtctgatcatcacataatttctcatgaaagctgaaaaggaaatacaatcattcacttattggttcatctttcaccaaacacttattgtactaaatgctggcaatacagaagtgaagatctgcttcatgccctaaagatgctcatagttagcaccaagaactacacatctcgccaggtacaggggctcgtgcctgtaatcccggcactttgggaggccgaggcaggtggatcacttgaggtcaggagttcgagaccagcctggccaatatgggaaaatcccatctctactaaaaataaaaaataaaaaaaaatagcctagtgtggtggcacgcacctgtagtcctggctactcagaggctgaggcaggagaatcgcttgaatctcagaggctgaggttgcaatgagccaagattgtgccactgtactccagcctgggtgacagagcgagactatgtcttcaaaaaaaaaaaaatatatcgacctctaagaatcacatttatcttgagctacagagttcgaaggacagaatttttttttttcaattaatgttaaggtctggaagtttgactttggctcttaacctttggctcacatacctaatttggttactatgtgtttactacatgcaaaaagacttccttgggcctatgaatcatttctagtaaatggagctaataataactttccatcagaaagctctttgtcccatttttgtatcagaaatgggcaagaaaaaagtgaaacaaaataaaacaacaacgtgaagatttttttaaatcctgcccctgggatgttgatgagggcagagacaagcaatttacctgcacacaaaattaagttttttaaataatttagattctaaagaaaggaacttttagaatgacatctgctaatactctaaagcttataactctgagttattgggaaggtaagaacatattttccccataaaaataagttctatatcatggttatgatccaaggtgaactcacagaaacctactttctttggttccttcaataaacattaaaagcctgttatttgtgaggcactatgccaaccattagggatataaaaccaaataggactcagtctctgcccacaggagcttaagagtctagtggaggaaactaaattaacatttgcaagaaatgctgtgtttcctaaaatatctacaaggtgttttggggagcaaagaaaacgggcaccttaatcagactacgaaagggagagtcacagaatgctttcccttaagaggtcatatttgagctgaatttgaaggctgatgaggaattacctacactaaaaaggaaatcacaggtaaaaaggtcgaacaaaccgtatttagtgatttgctgaatcatggaggtgggtgacacaaaggaccctagaatgactcaggtgtctggtttggataaacaatccaacgtaggcaccattcacaaagaaagggatgctaggaggtacgagggcaaagatgaaaaggtcatacgcagaccgcaaagcttaaaccttcgcctcacatctgtttggaacagcagtagctttttacttagcgcttacatcaccaaagccaatgagtagcgaagtctgggacgaggacaagagctgcccttggcatcactgcctgtcacctgtcccttcggggcgccccctgcctccactgcttggcctctgtttgtagcttgtgttttggccttgccagcaagtgtccttcagggaggtctggctactcacagtttatagatgagaacactgaggcagagcgataattaactcgacaagagaaaacaaccagcaaatggccctcttgtcccagagcccacgttcttcaccagaacactgcctagtttaagaaacagcagcaattctgtttcttataaactcatgagcttcccaaagacaggctctcatccggtcaggcatcatgggtggatcatcaagcaaacagatgccaacagacattccctcccaagttattccttttaatcctgtcctttgtcagatgcaaaaggcctaattcaatactggaattcctctatatccattatcaggtcacctggatagcctgtcctaaaagaatgaagtccctccttgccacaacaataagctttgtcttttttcccccccataggtcagcttccttcttttatattctgctacaatctgttgttgtggttaattacacaagagactagcatgggtgtgtcaatccctagtggaactgcgttgagaatctgcaaaccagaccatatattatggggcttccaaattttcaagtgccacagaatcgcaagcttctgatcactgcattaaggatctagacctgtggttcagatgagagatgagcttcataaagaagtatgttgccagtgagaccccactaggttgaagattgcaggaagctgagatgcttaaattattctaattaatgggcttattccccactggttatgcacagcagattgaatggacagttgcaggtgcaaactgagaggtaaacagacctttaaataagtaaagagccagggagcactagctggggaagcacaggtttcagaatgaattattaaagcctgcactgatccacagtcgagggtatgactgatttctaagtgaagacatcttatcctgaatgctgctactttaaggtaaaaatagactcattcttcccctgactctctttctccatcattggtgcaaaatgaaacagctccgttggtttgtaattgatgtatctgacactaaaatttcattctatgtacttccatcctctgaaatgcacagtaagggaagaagatcatcttgacaggtaaaatagtaggttttgacacaaagtcattgagatatatgtgatggagaattttctactgagacaaaatgcagttctatttgaaagtttactacacatttcaactttcactttgaagaaacactttcagataaataaataaatacgcaatgattaaaagaggaaattggctttgtttttttgagaactaccccgtagagtaaagcatacctttttatatttactcttttttataaaactattgattgaaaaatatgaaaaggtagaaggtgcttagaattcctagcacataatacgtgctcaatttattgatgtgaattatatttacacataaatatacagacaaaccagaatatataaatataaagggatataatcactccaacaccatgaattccaccttaattttcctctccttgacaaactactgattaaatgtaaaaagttgctctttaatctagataacacgttttgtatgcatttaagaaacatttactgagcacctgctttacatcagcatagttctcagtacagatagagcaatgaacaagatacaccaggtccttattccaatggagcttaattctacccagcgtgagatatgcagtaccgagaagtaaataaatgagaagatattttcagataatgttcatgatgtggcgacaataaaacagaatacaccacgagcgtgtggaagaagagctactttagagggaatgaccaaggaaggcatctttgaggcagtcacattcaatggagtcctgaagaatgagagcgccaaccattaaaaaaggtttttctaaagtgctggggggaaagcacgtgtaatagccggagttaaattcactgctttcaacagaataccaaataaaatgatttacccacagaaagggtcccttttctcactggattcccacaatgccattagggagccaagctccttatacctttttctttgcccctcctggtgtgtagctcaccgggggctgctctactactgagcagtaactcagccttccagtgatgaagaatggggaaggctgaagggcagggtgtgtctagccagcctagtcagtcccttcctatccgcaaatagtaccttccccagaagccctgcccataagtgttcacttacatctgctctaaactgtcccacagatacagtaaagctaaggaagtttcttgcttttaactggcatgaatgggccttttgtagccccgaaaaaaaaaaaaattgaaactctgttagcaggaagaaagcaagaatgggcactggcctgtgataagccatgtctgctgaagcatcctaggcagggccatggcaagtgcgaagtcccttgtgggataataggtccagcttgtaaaacagaagaccagggtgtaggagtgcagggaacacgacggaagcacagcccaggaagactgtgagtgaaatgggagccaccggtactgagggctcgccaggtcctggagtggggggagtacttttttttttctccacaccacctcccagatgtggtcttgctatgctgcccaggctggtcttcaactactaggcccaagagatcttcctgcctcagcctcctgaggagctgggattacaggagtgcaccactttacctggtgatattacctttattttacaaataatgaagtaaactcagtaggttaagttgactcagctaaattcacagattaggaatgagaggagacacaattataacccagcttgatctgactcctaaattcatgcctgtaacccctgtactctgctgctgtcttcatatccctgctttaacaatatgcctctgagtatgagctgacagaatccattcttccaaatccattccggttattacctactgtcctattcactcacatttataggaagtgtttatttgttctaatattttcatttatttcaaagttctagatagagagaactctatgtctttctttgcctacctaatatgcatagaagaaaaaaatattaaaactgaaaatgactatcttcatctgatgctgaggtttggggtgaaaattcatattagtgggaaagcagatctctatactgctccttctcactctgagatacctggggagggagaaaagacaacactgaaatgtcaaagctcctgccagttcctcggtgctgaaacattaatgagcttctgaatgtgcaaaggtgggcccagagccgaaggatgtttgagagttaaattgctctgcataatcaaggaaaggtaattgagtttcccgaggaatcagagaatcaagaggtctaggagaagtgagaaaggcagggagctatgaaggtggctgctgtctaaccccacatgacgtctctcatgatttccacattaccagcaacactgttcccaaattcctgacacagagctatagcaagctctcacatgggggacagcagtgagtgaggattctgtgggtgactcctgtgggtaagcattggggaaatactttcagatcacatccaggataaaccattattttcaaatctgggaagattaaatagagatggtgaatgtaaaagaacctgtgggacctggcagagcaactctgatattctccagagcagcagcagacagaagctggggctgtttgcttactcctctcgccctgaacattaccaacatgcaggctgggactgtgagacaacgccatcagacaagcgagacgatgccatcagacaagacaggtgttccagcgattgctctaggtaagcctcattctctttgttcactggcagcaccaccccgctccaccctgcgcctcatttgcagagtcctctacaaatgaacatgcagcctgcctggcacacctggcacagctcacctgcatgccgccaagcatgacagactgtctttgctgtggttgtaaaggcctattttcccaagaggcttcttctccggggccctacagctttcagcgtgcacttcaaactcactgaggactgagtgacttacagttttctctgtgtgctaagctgttagattgtttccatctttacacaggctgttccctccatttcaggcatcctctcttccaggctgaacccgttttcatcagattatcttttaccagttcttcagaaagcaattcaggcctcgtttctccaggaagccttctctggcctccacctttgatttcgatggtctccttcatgttccccagcccccgtctatgcctccaccttggtatatcatgctctattgtaattattaatttacttttctttctccgcgaatagatgtacccacagagcctagcagtaaacctgcaacaaagtggtggtttgatcattcttatcaaatgtatggcttaaaagtattgttcttctaaaatgtaaaaagagaatcaaatacaggtctggccaatgacagtatatttcaaatgacaggcaggaacatgtcttcccaagtcctgatttttctttgaatgcacagctctgacttatctggcctctctccagaccttcatatgactcttctctagttaagccaatagcaggcttcaagccaaaaactcctagaagtaggagtttgccaggcaatagtgcatgtgtgttggttgcaagagggtaaaaaaaatattacaaagataacagcctgggtgcaagcttggagagtttcaggaacagaagaggacagcgtggcagagctgtgggttcagtaagtgaggtcaaagcgtgtggacgtgtacctggccggctaagcaacagtagtttcttggtgaatctatcagagaaggactactatacaacataagtcggtgggagcaatgtatctaaagtgagaatgagtgaagtaatgctatcccgcaatgaccactaattgaaatgccaacaactccaagttggctaagtgaaaagagagtcttacctcaattaccctaaaagaacattctagaactaggttaagctaacaggaataagcatatgtggagggtgtttctgggaaaagaagtctgtcagaggcaggcagaagtatcaattggaatgtgtctcagagacaacctaagttgacaccatataaataaatatttctgaagattgcagccaactgatctgaactctactgccacgtaaggcatattaattatttttaaactaatagaattggtgtgcatgttcttgaatcatttaaaattcttatctcctcaagaatctggaatttttgtttgtgttacccctaaatccaaatttcacaatgctgaggagtccatggttttcaggcatcattacaaaataaccagcacttcctaacagctggtggcagcaaaaatctgaaacttatatttctcagttacaatgcctacttaagaatcacctcaaacctttaagtacaatacaatgtgagggttactcagaggtacagagactagtggtatggtcaggatttcaaccgtaccatataacctgcataatgaacaactcagacttacctcacttgttactaaatatttgctttatgtaagggaaaattatcttcagccaaaatggtagagcacaaccaacttaatatatatcctaagtggcttagaggctaagtacataatcccttcagcagtagcctcaactacatttctcttattgtagctagctcttgcacatttaaccaccttcatctgtattgttaacttgaaattttaaatgtgcatattcccagaacgcatcaactaatttttatcattctttcatttgaaaatatccttggaacattaatggttgaagagataaaggataccatgttcctaagagaatttattgtgactcttacactcagtgactggttgtaactgggaaactcaaaaccacaactatatatgactataaaatgacaatgaaaatagtttattctatacttgtaggctgtttgacattttccagcttgccttgattttataaaaagaaatgaccttgaaaataattaagcatatcaaagggtaaggctgtagctcactgaaacacagcaatatgttcacgtctttataacactgctaagcattcatgaaatagcaagagattgtattgctctttaaccaagttctactttaattttataggcttatacatattcactacgaggccattctaatcttcacctacctgcattcttctgaacttgcaaataaaggcaatcaggactctacctgctagacttggaacagatcagattttgcaagaggcatcagggtctggttgattctttttttttccagcctgtgtttaatgagagtgctctcaataaaaacacaaattcagattaggtttctgtactcaatgtttattaatttagatactctttaaaagagcatgtaagcatcttgagaaataaatttagctactgtcactttataaaaggaacaagtgcaattaaaaaagaaacaggaaatcggcaatgatatggaaggaaagtgcttctgagacctggatgctatcagccccactgcatacaactgagtgtgctccctgcagtgttgcaaagggctcagagaaatcacaactggccaaatgttagaaccttccgcagagaaataatgacagaggaaagtcagaatctccaagaatggaagacctaatgctcggagatctgcagacatcttaataaaaggaatattcaggagggaaggtgccattttgacttagttcaagttctctgctgggtttcctcctctacccccaccctagcaagagtcaactcagaccacaaaatttaaattaaaacacaaaatgtttagctggtttctcccaacttgaaaaggggttgacctgggatcccaggtgagagaaaacgagctatataaaaataaggcttcttgggaggccaaggcaggcagattgcctgaggtcaggagttccagaccagactggccaatatggtgaaaccctgtctctactaaaaatacaaaaaaattagctgggcgtggtggcgggtgcctgtcccagctactcaggaggctgaggcaggagaatcacttgaacccgggaggcggaggttgcagtgagctgcgatcatgccactgcactccagcctgggcgacagagcgagactccgtctcaagaaataaataaataaatagataaataaataaataaataagacttctctcatgaggtgatggaatgccttagagatctgctatttccaaaccaccaggaccagccccagtgagccaaatccttaatgcttacatctttcctcttcctacaacacatggacgggggcatgtgagtaaccaaggaagccaggcccaaagagaaacttcctggtgccaggatcattttgggtgagccacttgttttttgctcatactggatacgtgtgccacgtgccaggcacacagtcctgaacaagactgataacgtctctgctctcatggagtttatgttcttgtgatgggtgacaaatggtaataatgaaagattttgggaagagtatcaatcatggaaaacatctatttatcagtccgttcatttacttaacataggctactgttgtgcaacaggtcccatgttggctgctggaagtatacaaaggtaactaaaacacaagctaactttgggagtcagccacacagagacggtgaatgaagctacaggaatcagtaaggtaacccacagacagtgtgcagagaacaaacaaggtggcgaaagaaccccaccgactgggaagacagtagtgcaggaagaaaactaggagagtatggtgtcaccgaagcccagggaaaagcgttcccgaaagggagcggtccacaggacacatgaagttagagtatccggaggattgagcaacatggagattgctgctcatcgcaactacagcagtttcaattgagttaaggacctgaacgccagactacagcggaggtgacaagaagtaagaaagtgaagactaaaaatgtaaataatttcagttgtaattgtgaaaggagagatgattcaaagataagtagaggaagaggtggagcaaaggcattacttctttttttcccctccctcgctttcttccttcctaagaggaagacaggcacatttaaaggctaaaaaaggtgaaaataattgagactagataactagtagagtgaggtccatcaaataataaaagagtgagctctagaaaacaggaaaagacatccttgcctttggggatttcgggacagaaagagggaggtttgctgatgctttcaggggtgaggagaggtgaagggttaaaagtcgtcgaaacaatcttccaccttatagcctcaggccaggaaaactcccaggcaagattgtgtgcagctgaagaggccaccatgtaccagtcacaggtttttaaggtgagcttagatgcaaatggtaaaagtgaataaaggtcggggagtggagaaggtggcttgtctgattattaaagttacttacagatatatatatctgttatatagatatatgaaatttttacaatgagacaataaagtaatatttgggtaagaaaaattcacacatttttaagtaaaaatgtccacttcccactctacattagggtgagaggaggccctggcaatgcagacaatgctgaatcaataatttcagtaacctaagagggctgtctagaagtaaatggatctacatgtgcacatctgaatgggagagatcaggaatgtaggtcaacaagggtcatcctcggtgacccacacccccattacctacaccagacaaactgctttgctgcactgtggactaggttcccctcccttttttaaaaaaaaaagaagaagaaaagcactatctgttttcttgcaactcctcaaggatttagtgcagtgtatgtgtcatgcttctgggcaacttggaaaataacctgagaacatcaaaggtctatactgaacgtgaaaaaccctctgggcacaggctgcaccaggccacacactgccacgttcccttcacagtcctaaagaaaaaaaggtacatgtttgtatagggttctttcagattctctcaccggaatcatttgctccagcatgcatgactgaaacctaccctgattaggaggaggataagatcatgctgcctgagcacacatgtaagtctggtaacaccctactcactgtgtgaaaaagcattttagctgttggcgtcaccaaaatgtaagccctttatttgctgagtgtctgctaaatcaacatacagccttcatattttgtctgttcccctgttaattcttaaaggctgttggttcctggagtctcggctggagtctgggaaccacgtcagtcattgtgcttgtccacacatgtaaagtgctcaagataatgtttgcctatcacagtgtttgtttaacttgctattggcccaataacatgcaaatatgtgctccataaaagctgcaactgactgtaatacctgagagctaggggccgcgggataacttagtcattattgttttttcttgaggtgaaacataaaattaactattttaagaacaattcagtaacattgagtgcattcacaatgataaacgaccaccaacctatccagctccaaaacatttgtatcactacagaggaaaactcgatacccactgaaggcagctgctctcgggtgccccttcccacaagccctagcgaccatcaatctgcactccgtctctatggattcatctactttgaacatttcatacaaacggaatcacagagcatgtggcgtcttgtgtctggctcccttcattaagcataatgtattccgggttcacccgtgctggagcatgtatgggtacttcattcatttgatggctgaatgatactcgattgtatggatagatcacaattggtgtattcattcaactaacaacgagcattttggctgttgctaccttttcactattgtaaatactaatactatttataatatatgtatgtgaaattaagtatcagttttccattcttttgtgtgtgtatatggcagtggaattcctgggtcatacatcaactttttaaggaagtggattccacagtggctaccacactgtacattcctatcagcaatgtacagggttccagtttcttcacatccttactattttccattttactgatcacggccatcctactacatttcattctattacatttaatagtaaatgtgaagtggcacctcattacggtttttttttctttttttttttttttgaagacggagtctcgctctgtggcccaggctggagtgcagtggcatgatctcagctcacggcaacctctgcctcccgggttcaagcgattctcctgcctcgacctcccgagtagctgggattataggcacaccccaccaggcctggctaatttttgtatttttaggagagacagggtttctccacgttggccaggctggtctcaaactcctgacctcaggtgatcttcccaccttggcctcccaaagtgctgggattacaggcgtgagccaccacgcccagcctcattgtggttttgatttgcatttccttaataactgatgatgaggagcatcttttcacgtgcttgtcggccatttgtatatcttctttggagaaaggtctattcaactcctttgctcttttatatttagggttatctgtcctttggtcatttttaagcaaggtactccaatattcttctctatgcatactcctttaaacagacaaaacgcaaaacagtgcggtggttaggaagctgtgctatgaaaccagactgcttgggtctgtcctgcaacttagtcactatgagaccttgacaaaattatctctctgagccaaaatatcttaagagtaaacctcgtggatatgtagtaaatattaaataatcaatgtaatatacatatcatggcatgtgacacatagaaaagctataaaatgtttcaaaagccaataaaagtatgcacaggtagcacgttcatgtaattacttgtgtacttccataaggatgggaaaaatgcacgaacctctcccagattcagccatgtaagggtagaaggaacttcagggaggaagtcacaggttttttgcctccatgttaagacaaaaatggccccataatgaaaagcactgtgcaaaatattaatttttaaatatctttttaacaacataggaaaggcattcttctacttttgcaaaggaggcagaaccaaaatctgtgaagaacctttggctatacagacactccacagggaccaaatctcctgccccatcacacattcctgggaattaaaaagaatggagaacgtttacaagctgctgtactttataattgttatttctttgaaatgattctttttctttgtgagaggaaaataaaccacagtatattgctgagaagtattaagactcattcctttctgcccacacacaaaaattcgttgcacccggaggaatcatgtcaagcagtccacctgcttgggtctaaaagtcatgtatattgttctgacaagtctaccttgctgccaatatgcttttgccgtctttagaaaggagtgtttagtaaaacaaatgatgcctatacagtgtccatgtacaaaggcccctgtgttccagttctatcccatacttgaaaaacaaaggctctttcagggtagggggttcaatatcacctgctatgtactctggtccaattaaatttcccatttgtaatacacaattttatacctataattctttctgtcattttacattgctttaatatgaaaagaagtctctgcttcacttgaattccttagagagcctggcttttctaaaagcttgtgtgtccgtccctacatccctcccacctacaccaaatttaaaccttgacagactaatacattggatagcaatccaggcagtctgcaaaagacagatgccaaggcccaggagtcacgggtaagctcacgtttatcttccacactgcaacgaatagataggatggaagaggtagtcagaaattagtaagccaagatgaaaaacgccaaagttaatttaacaaatatagagaaggaaaattggtcaaagtcagttacagggcaaaagactttctttcaaaaaaaaaaaaaaaaaaaaaaacctctaacaatatatgtgaaaagggcaaagcttaaaaagctggactatctaagaaacaaaataatgttcctggagtagcaaacagaagtcctgtttgctcttcttgggacaaatgctcttgcttgtcccagatcacaggtgaaaaaagatacttccaggcagaataacaatggatagcactgggagtctcaagtttgagttccagctctaaagatacagcaaggccgggtgcggtggctcgggcctgtaatcccagcattcggccaaggcaggcggatcaccttaggtcaggagtttgagaccagcctggccaacacggtgaaaccccatgtctactaaaactacaaaaattagcagggcattgtggcacaagcctataaccccagctacccgagaagctgaggcaggagaatcgcttgaacccaggaggtgaaggttgcagagagccaagattgtgccactgcactccagcctaggcaacagagcaagactctgccaaaaaaaaaaaaaagatacagcaagaaatcttcagtctaaaatgtacctataaactcatttttcacagattatggaaatatttttgattttcaagttttgataacaaaactagaatgtgttacagtttaattctgagtctgcatcgttcttggtttttgatcattatagaaaatacagaaaacacagaataaggaaaaaagagaatgtgacatagtacaacttaagaaaaaataatttgggtgttatttcctcactatcaaaaacaataattaaataatatatttttcattaacctaaaatgaagaatttaacacaatgattttctccccctcctagaaatatgctcaattaaaaatatcagaatagtgtgatatatattatgtatgaaatataatccaactaatactgcagcatggttagtttccatattactaaatatgcctcatggttgcatgtagcttccctttacatttatttataattcatttaaccactcccacactcattacttttttttttttttgctattaaaaaaaagtataattactgctttcaccaaacaaggattgctatgaataattttttcttaattttaatttttctttttttattggcctacttaggaattctactatgagtaatttttgactcgataaatatttctaaatttgcttgtctcaaaatataaatcaatttacacaaaaacggtagtaatacaagactgcctgtcttaaactctccctaagatttgggcattaacatttcttgttcatttttgtcaaatggcatttcactatttacctttcattcttccaaatgaacactaaaaaattacctggaaaactgctttcaagaaacgtagtcgagaaagactgacacgttataatgctcagtcttatcatctacaaacatactatgtctttccaagtaatcttctacatttcttaaagctcgtagacttcttattttcctgcactgtttgtgaccgctaaatactgtattttgcaaaacctttcagtttttttatatgcaaaattcatgttatttttcaaacaaccctctaattttttttaaaccagaagattattttctatggtttcatagtctacaaattactactttcagattatcaatttctgagtatactttgtttctttcagtacatgttatggttctctattctagttttctaagtggttttgatttctactttggtctaatagagtttctgtgctcccacgcattgggtgaggtagaaccaatgctgtctgtgtacaatcaagaattgattttggtaaacgtttcaaagataactgaaaaaaaggtatatttcttttataaaagatatcaagtttatcctatcaattgttttttatcttaaattatttttatatgacattaatataatccctcctttctttgaatttctctgattcacctttgcatatccttttgctttaaatcataacattttagatcattctttttccagagggatgggggtagggagtgccggtgtcatcactggaaaagagcttacacctgagagtactggagtcatgtcttcttaacagagacacctgccaagaaattcattgttaggtgattttgtccttgtgtcaacatcatagacacactaacgcaaacctagatgagacagtctactacacacctgggctacatgatattgcctattgctcctaggctacaaacctgtacagtatgttcttgtactgaatactataggcagttgtaatacaatggtaggtatttatgtatctacacttatctaaacatagaagaggtacaataaaaatacagtataaggttgggcatggtggctcatgcctatgattccaatgctttgggaggccaaggtgggggaattgcttgaggccgggagtttgagaccagactgggcaacatagcaagacctcaactctagaaaaacttaaaaaattaacccagcatgttggcaaacatctgtaatcatagctactcagcaggctgaggcaagagaattgcttgagcccaggagttcgaggctacagtgagccaagatcacatcactgcattccatcctgggtgacagactatgactttatctcatgaaggaaaagaaagttatgaaagataaaaatggtatacctatgtagagcactgaccatgaatggagcttgcaggactacaagttgctctccgtgaatgagcgagtggcaggtgaatgtgaaggcctagaacactcactgtactctactgtagactatccacactgcacgcttaggctacacaggcctagaacactcactgttctctactgtagactttatcaacaccacacacttaggctacacaggcctagaacactcactgttctctactgcagactatccacactgtacgcttaggctacacaggcctagaacactcactgtactctactgtagactttatcaacactgcacacttaggctacacaggcctagaacactcactgtactgtagactttatcaacactacacacttaggctacacaggcctagaacactcactgttctctactgcagactatccacactgtatgcttaggctacacaggcctagaacactcactgttctctactgtagactttatcaacactgcacacttaggctacacaggcctagaacactcactgtactctactgtagactttatcaacactacacacttaggctacacaggcctagaacactcactgtactctactgtagactttatcaacactacacacttaggctacacaggcctagaacactcactgttctctactgcagactatccacactgtacgcttaggctacacaggcctagaacactcactgtactctactgtagactttatcaacactgtacacttaggctacacaggcctagaacactcactgtactctactgtagactttatcaacactacacacttaggctacacaggcctagaacactcactgtactgtactgtagactttatcaacactacacacttatgctacacaggcctagaacactcactgtactctactgtagactttatcaacactgtacgcttaggctacacaggcctagaacactcactgtactctactgtagactttatcaacaccgcacacttaggctacacaggcctagaacactcactgtactctactgtagactttatcaacactacacacttaggctacacaggcctagaacactcactgttctctactgcagactatccacactgtacgcttaggctacacaggcctagaacactcactgtactctactgtagacttcatcaacactacacacttaggctacaccggcctagaacactcactgtactctactgtagactttatcaacactacacacttaggctacacaggcctagaacactcactgtattctactctagactttatcaacgctgtacacttaggctacactacatttattaaaaatctttttctttcttcagtaataaattaagcttagcttactgtaactttttactttataaactttttttaaccttttgactcttgtaataatacttaccttaaaacactaacacattgttcagctgtatgaaaacatttccttttttataaccttattctataagctttgaactatttttaaattttttttactttttaaactttttgttaaaaacgacgacacaaacacacacattagtctatgcctacacagggtcggggtcatgaatagcactgtcttccacctccatatcagatctcactggaaagtattcagggtcaataaaggcatggagctgtcagctcttatgataacaatgccttctctggaatacctcctaaaggaactacctgaggctgtttacagttaattttttaatgctttttttttctgagacagggtcttgctttcctgccctggctgaagtgcagtagcgggatcatagctcacataaacctcaaactcctgggctcaagctatcctcccacctcggcctcctgagtacccaggactacaggtgcgtgtcaccacacctgactattttttatttttatttttgcagacacagggtctcattatgctactcagattggtctcaaactccttatgtcaagcaatccttctacctcaggctcccaaagggctgggactacaggcatgagccactgcatctggccaactttattttttttaataagtagaaggagtgtgctctaaggataaaagtataatatagtaaatatataaacgagcaacacagtcatttcttatcactatcaagtattatatatggcacagaattacatgtgctacactttgatagaactggcagtaccgtagggtttttaataccaggttcaccacaaacacgagtaatgtgttgtctgtggagttatgacaggtggtagaaagttccccgctctattataatattatgggaccagcattgtatacacagtccatccttaaccaaaacatcattatgctgccatgacaacatttgtttggttttcttgtttgttgtttgtttttaagaccaggtctggccctgtcgcccaggttggagtgcagtggcacaattaaagcccactgcagcctctgcctcccaggctcaagaaattctcctacctcagcctcttgagtagctgggactacaggcacatgccaccacgcctgactaatttttgtatttttagtagagatggggtttcactatgttggccaggctggtctcaaactcctgagttcaggtgaccctcccgccttggcctcccaaaatgctggaattacaggtacacaccgctgcatgactacatttgtttcttaacagtggatctattccaggagagtggagtctcaacaattactaattattagttataatatatctgcctttcttcttcacactttcatctggtaagcacctgataaactgaaataacgtttgctctgatcaccagtcgatgaatctctgctgcttttagaaatatctaaaatattacaatactttctaaggtcatgaaaatcttttaggtattaatgagagtgtgggttacatgaatatgcatttatctatactcaaatatcatcaaattatatccttaaatatacacattttatcatttatacaatacacctcaaagttcagaaattattgggggaaaaactaagtatagctcaaggagtaactgcgcctgtgccctatgtagaaaacgcactggtgatacagacaaacattcatttatttacaaaatcgtatttgagtagaaaatattgtgtcatcgtattttgtaacatggtaaatatccctttatattgcaccaaaaattagagtcaggcttcaagatgatttttacataccttattataataaacttagtattatccaactgataggagataaaacaaaaagcaccactgggagaggtttacaattcaggtaaaataaatgctttgttctttgagatctggagtaataactgtctgcttattaaacaaaaaggttattttttcctatgcataacctttacagtacagaagtactccagacttgaaaatccctctaccacctgaggattaaaacactttaaatattcaaatctaacttcttaagtttgaactatactttccatcacagatctggaagtagtctgtgaactatcgaggaagacagggccattcacagggtggtcattcactcaatttggggaaacagagtatcttctaatctgttaggattttgctgaatgacatttgctaggggaaagttttaaacatttattgccgacactccaggaaaatagagggtaatttactggcatgtgtgattgtcaagtgggagaatatgtcaatcacctaattatcattattcattaaggagggctttcaaatacattgtaaatgaaacatgtgtaaagtagccatgaattccaagtatattatactgtgcagacacagaataaaaacttttttcaaaatacataatttacttgaaggagtttcctttcttaaatacattctctatgaaaagcaatttgtactgactcaagttaccacatcttccatggtccttttagaagagatatttattcaaaagcagaaagataatggaaaccaagtgttttactctaagctaatgttacacaaaatcactaagataattttttatttcgttccagtactctcctttccattgagtcctccaggcctcaacccaaaccccctcaccagtaaccacaaaataataattcttttttatctgctacttagtctcagaaacaaactgtggagtcccaaaatcaggtcagctgacaaaattagccttcctcaactacacccataagtaccagtggatccaggccattcctacatccattcaccactgtccggctcttaagaaggactatatttagctcttcagagcccttggcagaaagagataaacattaaaaaacaaaacattattttgaactgaattgataccgtaacaaaaaagtaacatttgactctttaaaacattggaaaacacttacatggtctgaccctcagcaacacgaaaacatattcgaagcaatgagattaatgcttatataggcttttgtttgttttgagacaaggtcttgctgtggcccagactggaatgcagtggcgcaagatcacagctcactgcagccttgacctcccgggctcaggcaactctcctaccacagcctcctgagtagctgggcccacaggtgcgtgccaacatgcctggcaaattactgtattttttgcagagacagggttttgccatgttgtccaggctggtctgaaactcctgagctcaagcaacctgctcacctcggcctcccaaagtgttgggattacagatgtgagccaccacaccagcctatactggccgtttgttaatggcactggtaatattggctcttccccttagacggctcatgaggctagccactcttgaactaaaagaatgcacgtataacatacaaacataatgtctgaatccccaaactatagactttaacccaaattggtgaaacacaaaggaaaaggaaaagaaactttaaattgtttttaggcctgctgtttggatattacaggaaccactgtgatttatatttggcctgagggtataaagatctatgattttatttatggcttggttaaatcttttcaaaacacaagagccacctattcataatattaagaaatcaggtgatttaaaccttactacactctgctaatatactgttctcttcagtagaaacatgtaggagtatgttagggacaatctctcaattatgagcaaatttacaacttcaatgctgtcttcttaaattacatgccatcacttacaatccaaacatcatttaagagtttataagtttaaaaggaggacaaaacaaaaacctttaacaactcattattatttaagccagagttgcaccaagttaccccttcaattgtctaaataaattctagacatggcagcctactgaataaataaaagcaattgataatcccactctatagaaaagcaaaaaagcacaaacataaaatcaagagaccacaccgaagtagcatcatggagaagaataaacattttcaggacagaaaatgtttaagaagaacagcaaaaaagaacaaaggtaggtatattaaatgagcaaggaaggagtggaactgttgaaaggtggggtctaaaaaggctgtgacctgctttctaagtaaagcctagtccaaaaatgtcttgtgaccagatcaatttccattccttctcgaaagatggaagacataagcaaaacacatagagctatgaggacagagtggataatgattagtacatagaaaagttgctacttcgaaggattcagatattaagtagagcaattaaagaatttctccaatgacatcaatctcaaccagacggatgttctcaacatttcgcctagcaactcccccaggccatccttacagcaggcttagggaggtgctactctcttggttcctgctttcaaaaagggtgctgcctccatttagtgatgtttataaaaatggcagtggtttcctatttgaatgttaattattgttatgacacacaaggtaatttaacttgctttggtaatttattcacccttctaattagatgtagttactggaaaatcttccagagtgtagcaacagttccaaaggtgaaatggcaggaggagggagctttcccataggatcgcaactgtaaatctgggatggatgttcaattgccagtcacctgaatgaacaatgccagggatcagagacggtccttctggaatcaagcaggtggcacccatcaccttcaagaatttgatgattcaagaggaaggtaaagccccaaaagatggttggagctactctgaaaagattaaagactgaacttgaatgaaccaaggaacaataccacacaacaccattttaaatctcctagaccgggagtcatttacatacagttgagaaatgccgtagacagagtataagccaaaaacaccactgaagtgggagaggctccactcgagttacttgctttgtggaagtattttcacgcttgccacatcatacctgctcgatcaatatttactgaaacaagcaaatgaatgaatggacaagtgcatgcatggctacagcataaaaacaggcacacccactccatctctctcattacggcctcctcagcaagcagaccttttttcttaatttgaaggtccccaaagtgagcgagtttcaatcaacagaaatttctttgtctttaattaaactgagctgccactgcttcttctgtgaggtctaagtgccagcctgtagccatgttctacgctagccagaagggaaagactgaatcatatttgtgaccaaaaaaaaaaacccattagactccaatcaatgcagagcaggtggctgatgactgcagcgatccctatgaggagcacggattgatactgccaaatgaacacattaactgaaactacccaggccttaggggaatggccagaggcccctgtagggaacagtttaagtcaaacttttcctgcttccattgtaggatggaggattcaagggctcagattatataaacaagttcaaggccatgcaagaatgtatacagaaatactcaaacctctaaccccaacaggaagaggaagaggaggaggaggagaagtagccagcagaacaagtggaagaaacagcttccagtgaggtcactgcacccaaagaagaggagcagtcaagctaacgaaagccacatggcactgggctccagtccttccacttcagagtgatatggaccttcgcaaaaggcctttcaattgccctccaagaaagcgtctttccctctgttgtcctcttcactgtaatgcacaaaataatttattttggtgatgaggggtcctgatctcttgacatacagactgaaaaaatgggggttgtatgtgtgtcctacatataaatctgtcagcaaatattgccaccactgaattctattttctcagattgccctcaattttgccactctgaaataatgtgctgaataatctcagcaaccagaaatcatcatccaggaatgtttcttatgagacagctgatttattcggattcactagatcccttttagtagatttaatccccctttgggaaatgtaatagcaagaaaaacatcttttaaaagtgctggagtgaggccacttctcctagaagaagccagatggtcagatatatatttctcaaaacccatcttaaccttgagtatatgaagggatactacatttcattcctgataaattttggtttccatgttggcattgagctccaggctttctatgtgttgatagcggagatttggaccctccatccacagtctctttctaagtgaaggggaagattggtttttgctgttccttgttattccaaaagctctggtctggggcccatgttcaccctggctctcagtctggtcagatgcaatgttcttcaaaggtggggacctacttgttatcagagtagcagccaaaagaggaaaaggtgtgaattaagtactcagttaaaaggaaacatgagaccaggtgtggtggctcatgccaataaccccagcactttgggaggtcaaggcaggaggatcacttgagccacagagttcaagaccaccctgggcaatatagcaagatcccatatctaatatatctaatatagatatattagaaaatatatatctacatatagtagaaaaatatatatacacatatattagaaaatatatatacatatatgtatattagaaaacataatctctctctatatatatgtgtatatataaactacttatatatatataagtatatatataaactacttatatatataagtatatatataaactacttatatatatataagtatatatataaactacctattctatcttataccttccactcaaggtcatgaagatttgattttggagactgatgcaaatgtttgccacctgattttaaaactcaggagggttaggccgggtgtggtggttcatgcctgtaatcccagcactttaggaggccgaggcaggtggatcatgaagtcaggagatcaagaccatcctggttaacatggtgaaactccatctctactaaaaatacaaaaaaagttagctgggagtggtggtggatgcctgtagtcccagctacttgagaggctaacgcaggagaacagcttgaacctgggaggcagtgcttgcagtgagctgagatcgcaccaccacactccaagcctgggcaacagagcaagactctgtctcaaaaaaaaaaaaaaaaaaaaaaaaaaaaaaaaaaaaaacaactcaggagggcagaagagaatgggtaatcactatacctagtttccagcaagagattcctccctttagaaacactccccagaactgacagaaacagagaaagaggcgtaaggagccataaagagatgtgacgtgctttaaaagcaacaaaatatcagggaggaacatactctactctaatatgtccatcataggggttctatttgtttcctacagataaagtgatcatttaactatgaaaattactatcattcatctctccacatgcattcccatccttgagaagtggtaggaaccatgcgcctctgggatgtggaaacaagtgctcttgtgaacagaggtttcattccactgagagaaatggccatgcaaagcagtgtctcaagagagcaaggcaaatcaatgtctcgcctagagtatattttacaaatttctaatacaaatgattgcactgaaggacaaaggttttcctgtactcttcctccatccaaccttcaaacagatacactagtctcagctctagtggaagtaggaggcatccttgacattatactcagctgtgatgtaaggaatctgtgtacttacaaaactaatgcaaagcatttcaggctgtcagctgacatccctgccactccccacagctgagactattcagtaatggcagtacatctgacatcctgtctgacatctagaggactcaggaaattcaaagaaaatactataaattctatcatttcatgattcacacttcatgcaaccaaagatctcctctacacaaaaacacaggaaatgtcagaataccccataggtatgtgatttttcttaacttgtatggttttatttataagaaataaattcagttactgaattatgaaacagacacataggggtcccctttgggatctagtccttaagatgcgttcaagaggatgaaggatgtccatctctgagatatattagtacttctacaacccgtgtgccaagcaccagtgggctaacatatcctccagatacatagacacaacttaaagcagagaagccaggtagagagatttgaaaaatgaattctaacactagcatactaaattcccaaataaattgtttaattacattgtacctacatttccccaatgatcacgtagagataattacctttgcttatttcacagggggcatttgtaataataaaaagaattatttgaaatcttcaaagaaagagcactattttaacctacttatataaggaacagaaagagaaaattgagttaacagtcttaaattctgccaaattaatctaatttttaaaaagagagaccaagtaaaacctcaccactgttgttctcatcgtaactgaaatccagcacattaaagagagagagaaagagatcaacttttaaaacttgtaaaactccatccctggtggccacaaacactcttatcagttccccactgaaaacccctcctcgccatctcccttccttcccctttctcctattacctcagccttcactccacttaatcttcccatctctcgacttctctatcacctcttcctccctgatagttatgacctcactcccactgtcacacatagaactgatccaaaggggacctaagaattattctaaccaatctcccacacagtaaaaaggacaactggagactgaagtgataacgtcacaggctcagggtcaggtagccactttcatgcaaagctgggtcctcacctagatatatgactcccagtacagtactctttccagtaccccacacaacagtctacctggacctgttcaccagccttatccaagagatccatttctgaaacagttaggtgcactttgttgttcttccaccatataaagcactttgagtcacaattagaaaaataaaactgatgacagcaatcagattagaatcctgtatctggaagacacctttacccataatccatcttatccaggaagtaagactcaggaggccatttccacaatgcctctcctccccagacactcattcctatgttcaacatcacttccattgctcaaacctaaatccttcctaatgatgatactgaagcaaaatcacaataccaggttttccagacccggctgagaagacactaactgagcccctaagtacaaatgagcatacttaacatagagaagacacagttagcacattgctaaatttctccacacccttatttttagcagattaaataattgtaacccctttaactttatcttctaagtctatttttggcttttatctaaggcccctttaaattctccatgttgcttttggaaagctagagtccagaaccaaggacaggtagctaaagtgtttcacataagagaaactccatcaacaaaagtattgcgaagtctgtacaagcccagggcaatcaatgaaatctgcatgtaaacgaggcagttttccagacaatacttttcaattagactaacttacaaacttgaggaataacgagaaactacaaagaaaacatcaactgcgtcttcaaagcattttcaagcacaaaccctaatacagtttactggatgccatttaattgggcagctctaagcatgtagctaaatacaagaaggttggcataagagataaaaaagcaaacaatgtccaagctacatcacttaaatactgtcagaacaaggttaagaagaagcaaggtgagaaatcagggaaaatgcaaataagaattccatttcctacaagataaagaaagataaataaaaatcctgactagctaggggagtatgtccagcaccaaaaaaaaaaagtaattatttcatgtgtggtcctgatataaagtcttgaaaataataaggctgctaaattgcaaatatcagggaagtgaagtagtagctcaaaagattatgaaaattgagatttccaaactgaatttgaaaaggaaacaggtaaaatgaggtcaggacattacagatgagaaagaagcttctactatttggctggctgttttaaattaataacctggaacattagcaggtttaaagtcctataaaaatgacacggagggagaagtaaatgcggtagaaacagcagtgtttacaccttcatcatagaaaggtattactaaaaggatttacaaggtggtaacaggatacatatcaaagtcaaagcgctttaataaatgatgagaaaagacattaggcatggaagtaaagccgaagggcttgaaataactccacctatccacgtcccagattattttaaaccaagtaagccactccaagatccacaaaagatcaggttgtatttttccctaagtggcagtattcccatgagcaccaaagcagtaaaggcagtaggtagaaaaaccaggagttaaaagaatataaaacactagtcctttctgggatattgttacacatgctgaaagaatctaaatatatatatcatgacccaaagaggtctcaggcttaaaatccaaaaagaaagaaaagcaagtatattgcccttttttcctattgggaaaaccttgtaaccactgaaaaattagaacagataaataggaatgggtcagtataattagtatcttctaattatagaagcacccagattggcatcaaactcaccaactcttggctgtcttcaacaatgaccaggcctcctctggggagactacttcttgccatcctcaatctgtacctcagatgtgtgacttcttgcttctaacaatatcacagattatggactaaatgtttgtgtcctcccaaaattcttacgttgcagccctaaccctctgattctatttggagaaggggcttctcagacagtaattaaggttaaatgaggtcatacaggtggggacctgacacaataggattagtgtcctcacaggtagagaccagagagctcattgacctgctcccttcctccctgtgtgcttgcatgaggaagggccatgtgaggacttagcaaggaggcaccatctgcaagccaggaagagagacctcaccagaaacctagtgggccagaaccttgtcttaggcttctagtgttgagaactgtgaggaattataaatttctgttttttaagccacccagtctgtggagttttgttacagtaccctgaggtggctcagacatacctaccacattgatgcttaatagtgactacccaaacagcaggaataaaagtttcaatttgtttcttacatttcctaatgcaatgctctgtaaggctagatgttttagaaatgctttttgaacttaataatggttttaaaaagtcacagacttcaataacagccatcattttctataagcactaatggtgttatatgccaagaatttttaaaggcaaataaatttttcttcttatctaaaaagctgcctggagaatgctcacccttcctttactcactactgaaaactgtcaatagcaattcaagtaatataattccttttttttggaggcagagtcttgctctatcccccaggctggagtgcagtggcgcgatctcggctactgcaacctccgcctcccgggttcaagcgattctcctgcctcattctcctgagtagctgggactgcaggtgcccgccaacacgcccggctaatttttgtacttttagtagagacagggttttgccatgttagtgattctttttttttttttttttttttttgagacggagttttgctctgtcgcccaggctggagtgtggagtgcagtggcgcgatctcggctcactgcaagctccgcctcccgggttcaagccattctcctgcctcagcctcacgagtagctgaaactacaggcgcccgccaccacgcccggctaattttttgtatgtttagtagacatggggtttcaccatgttagccaggatggtctcgatctcctgatttcgtgatcacccgcctcggcctcccaaagtgctgggattacaggcatgagccaccgtgcctggctggtaattccttttcaagaattacaaacaccaaagtatcttgtacaatggtaatttatgtgcacacgtatgctaaaaatgccaaaaagaacttacacaatttttacatacataacatactttagttccttgattctatgccaattcacctaaatattaacaaacttaggacagtggaccttgggcttacagaatattaaattgtagaataacagaatcataaaatcatagaatcacagactagaggtttgtctcggtcaaatctcaccattttttttaaatgaggaaaaccagagctcagtaccttgctcaaagtaacataaatagttcccttaattcccagaattgtggttttttactgtattgttaagaaataattttctgtaaagcaaaataatgattctcaaaattaataaaacacatataaaagatttaactcactagaaaatgagtaagatgctaagtctgatttttaaaagaattcaaagaagacacaaatacataagcatcagaaatgccagcaagatgtaaaatgtgcaaaactagtcaatatgcataggaaaataatctattgcattctccaaacacaactgcattttatggacaagaaccaggcgctttactgtctattttctgcagcacacacaattctagtacagctcaaagacagtgaaaggcagagctgacctgatggttgagtagacaaaacatgctcttttttttttaatcatttcaaagtctttcctcacagtcccttaccatgcacaagtactctgaaaccagagaacagcacggtgggtgaattcaaaaaacagaatttagaattcttgtttaattgctaactttctgaaagccctcagaaaaagacccaagttcatttcatatcagccccaaaactaagagacaatgaaaacttgacctgtgagagtctggcactgtcaatgtccacagcacttctctcaaaatgatccctctgaatacttacaataatcccaccagggcaaaaggttcacaacagcagttcctcagccaagtcgtgggaaaggctgtatcacattccggtcttctgcttcccagtctcacactctccccacatcacaggcacagttacctcgcaggagaatgtctctgaagccccttagagtcattatgcaagaggtctcacggaacaacttttcgctgtgactgaagagatgaaatgtaaaatgaggaaacacgaaagaagaaatggtctgctacacaaacatacaaagtaggtgtgatgtgctagataacgaggtgatgtgctgatggagctcaactctgaccccagttccacagctccagtcaaaagatctgcgtttaagaaaggagaaacaaggtggctcatgcctgtaatcccagcactttggtgcggtggcgcacgcctatattcccagctactcgggaggctgaggcaggagaatggtgtgaacccggaggcagagcctgcattgagcagagatcgtgccactgcactccagcctaggcaacagagtgagactctgtctcaaaaaaaaaaaaaagaaaagaaaagaaaggagaaacaaataggaatgaagagtggaaaagatatcaaataaggacccaaaagcactctgagaaaacaataaggttcttatgtcctgtgttcaggcaaagaaacacaagacatagacatgaagagaacagaaagcaaggaataatgtttaaaactaatttggcacaattttttttcttttaaaatgctcaagaggatcattgcagaaaacacagtggtaaagcaagctgctgagggatttttcaatagctccactgtgaaaaaacaagcacatcttaaaactacaagctttgaaacttttaaatttcttaattaaaatatttctagattccgttcatttctaagcaagactgcagccctaaagagaccagtaaatttttattcatcttttttgaaacaaacatgattaacaagtcattgtttgaatagaaaactatgaattaaacaaacaagcaaacaaccccacaataatggaacccattccttggagataatgacaatgcaaagtacaagaaacccattttgaagcattagtttcatgtgagcacttgttgacggaaatattacaagaagtccccctaagaacagttctcttcattgtcgtatcaatggtcttggtggctcacattcctcacgtgcactgagggccgtcttgataaaaagtatctagtagacctcttggtgtcaagttgtaaagctcgaacttgttttgggatttttaagaatgtataataaatatcgatttattaatttacaataaaaaaactaatgggtgaaaggactggacactcagcctctgaccttcatgttttctccctgcataggaagtcaaactactatcagaatgttgtcgtgtctggcactacagcaagagcaatgagttgcacaaaccatgaagcaaacagactgttcattcatccagcacgtcctggcctagagctagaaatacagcagcgaacaggagcgatcagagtccagattggactctgaaaagaggatctccttgccccaggagctgtgcagtatggccccagttctagctttctctggcctagacaatgcctaatggagccctgcaaagattcacttcactgacttttttaaaaatatttttatataacataaaattttcactttaaccattttaagtgtacacttcaatggcattaaattcaaaatgttgtgtaaccatgaccactatttccaaaagatttttgtcatcccaaacagaaactctgaacaagtttgctttttaaaagtggcacaagttactaacatttgtggttgacatttttttttttaatatctatgttaagaactcgattataggcctacccataatatgcttctttaagaggtctggggccaggcgtggtggctcatgcctgtaatcccaacactttggggggccaaagtgggtggattgcttgaactcaggagtttgagatcagcctgggcaacatggtgagaccctatcgctactaaaaacacaaaaaagagccaggcatggtggtgcacatttgtggtcccagctactcgggaggctagtgaggaggatcactggagcctgcagggcaaaagctgcaatgagccaagatcgcaccactgcactccagcctgcgtgacagagcaagaccctgtctcaaaaaaaaaaaaaaaggtctgtatgtttcattagccattgtgtgtgtttatgttaaaaatatgaagtgtttcacaaatttgcatgtcacccttgtacaggagccatactaatcttctctgtctcattctaattttttagtatatgtgctgctgaagcacgaactagccattgggttttgattttataactgttttccagaaggcaaacttctaacttcttaaagagaaaggtaccttgttgccatgtcctccctcccaccccactacacagaggcgctttcttctacaatgcacactatttcatccaactcttacaaatatctaaagagatgctatcatcagctttttagacataaggaagctgagactcacaggaatgatatttctcaaagctactcaggaagcaagggaacaacgcaagtgtcggtaacagttattccatattggagcatgactgactggatgaatatatgtttgtttttgctatacagctaacattaactggttctaagactgaatactgtattaaatttgttattaaaatacatactcctataacaagaagggacatataagacaaaataggaaagatgaaaaggttttaaagacacaggagaggctaaagaagtgatttttaatggatatactctgggagaaattctcaactatttccctacaaatgggtgacattagtcacttagggtggctgccttttttctgaaagctatcagacatctccatgggcaaaataaagaaagagaccccctacggtttatttatgtacgtatcatggtagcactccgtggttttaagacatattgaaactccatcatatgctgcttttaaagcccaaataactaaaataaaaactcccaggcacagcaacggcaaaatactgtcatttgtatgtgcttaggagacacgtgtctctaaaagcaacatgtacatttctcttttcaagcaaatgtttaaagaactggcaccgtaacaaacaaggggaaatatggagatcagttttaaaggcaggatttgtttttgtggagtctaatttatttcaagaaatccagattattaaattcacctcctatctgaggaaggatctcaaaggaaaggtaatacaggctagtcgtccttaaatgcccaagtccaaaagactagtatttaagacccaagtttatcacttactaagtgtcagaccttggccatgttacataatcgctctcaatctgtttcctcaaaataatactgcttaacaaaggattaagtaaaatggtgcgtataaagcaccacacacagaccgtagcgtatacttaagagttttatttcagcattagaaagcatgggaggccgggcgcggtggctcacgcctgtaatcccaacactctgggaggccaaggagggtggatcacaaggtcaggagttcgagaccagtctggccaatatggtgaaaccccgtctctactaagaatacaaaaattagccaggcgtggtggcaggcacctgtagtcccagctactcgggaggctgaggcaggagaatcgcttgaacccgggaggcagaggttgcagtgggccaagatcgtgccattgcactccaacctaggtgacagagtaagactctgtctcaaaaaaaaaaaaaaaaaaaaaaaaggaagcatgggaagtaggggagtcgctaaagctcactgatttaaattactactcaattagactaaattttttaaaaatcatgattttctttgtccccctccccaactcacacacaaaaagccaacactatactaaataatagaagatagtcgaggtcaagattttcaccttgttctccagctatcattttttccctcccgacttctattttggattaaggtatttcaggggccccaacatcaaagtagaacagaagaaggaaagcaagagaaaatgagaggtaggaactagaaaagccagtatcagaaaagcatacagcacttcctcactatactagcaaagcttaccatgcaatattcaacaggtaaatcctgatggatggctgacaccgggttcaagacactagtccacatgctccacatactgaataccctaaggtagttcagagagaaactgaggggaagacggagaaaacgcacctcacggtgcattctgtatgtcactgccttacacgcaggagtttcaatgttttggtaccaattaaagaccaactatcagttctccatggaagcagcaaaatataaaagtatccttgaaatcagtacagggcccttctgcgagggtctggtgatgtggttttgagattctttgttttggatcattcctcgtttggtggacccacaaataatggtcctgcctagaaccatcaccgcaagctagagtgaaaaaatgccagaagactaggctggtgggtaaaaaaattcaacgtttttcctcatgattaaccttgggtggccttgacaagttatgtaaggttttgtttcttcagaaagacactgcatttttagaacatctctaggcacaaaaattagtcatgtaactgaaagacaagaaaattttaagcatatattataaataaatgtgaatattaggggtgtgtatccaaacacatgaatagctcttaaaagaataagacaaaaagatcaaacatatttgaaatcagagagatgtcttttgggaactgaactcttgccatgagcaggagaaaaccagaaaggtcttcatgggttctggtacctgttcaaccattaattcatgatgtgtcgctggaaaaagatcacaaatgtcttcaagcttcattttccctatctgtatctgcccaagatctcactggattctcgaagaatcaaatatgataacacagtcattcctgaagtatggccacggaccaacagcatcagtaagtcaggaacttgttcaaatgcagttgagtcccacccagtcctaataaatgagaaacttcagcaatcggttattctgatgcaccttgaagtttgagaaccactgcacaaaaacagatacaatctgaaacatctgaaaacactggagtgttgttattacggaaaaaattaagaatcatacattgaagatcttaagaactttcacttaaaagttggatacagaagaggctatgtgtggcttttgttgttgtttttgttgctgttgttgaaacaaggtgtcactctgtcacccaggctggagtgcagtggtattattatagctcactgtagccttgaatacctgagctcaagcgatcctccttcctcagcctcccaagcagctggaaccacaggcatgtgccatcatgctcagctattttttattttatttacttatttacttttttaatttataagaaaagaggtttaattgaagaaattggcaaaaagaaaggggctacagaactcctgcaactttggaacccagcagggcagttgttaaatgttaaagctccaaaataacctggctcatttttaatttttcttttgtagtgatgaagtcttgctgtgttgcccaggctggtgtcgaactcctgggccgaagcgatcctcctacctcagcctcccaaagtgctggaattacaggcgtgagccactgtgcctaacctatgtgtggcttttttaaagccaagattcgcagttaatgtaaatgctacaataaaataaaatccaaaattacggtacctatcaatgttaaaatgcagtattatttccttataactttaaaagggttaagggaaaagaaataaaattagtaatgattgtaatgattacatattctttaaagagtaaatatgagactaaatgtatctcaatccaactattaataaaaaaagagtgaacttgagattagctctctctagggaaaaaggagaacagtaagtcctcctgggatctttacattttcttggcaagagtaatgcattcattgcttttaaaaaggtaaaaggtaaagtcaaaaaaaaaaaagaaatgtagttacaaaagatgcatttcaattgataatgaaggcttttaatgtaatgattataggaaatcttggaggagttctaataagtacagccaaattaagaacaaaatatgctaagaaaacagagaagtcatattgtttttcattctacattctagttaaacccaataaaacatgtgaagacaaaagtattcctcattagaagtatccttaggtcccatttatcgtcatatcttgtttactaccagttaagaaaatatggtactacagcctctgacaaattagggacaacctgagagccacattggtagaaacatacagatctgaaaaaattctgggatgaaagtaaggaagaagagattggaagaataaattaacatttaaaatacaacaagatcacatagaaatagaaatagttcgatgaaaagacttgtccataaaaagcaaaattaccaactatctggagatttaaattagactgtactgatgaatgtattcttcagaatatgtttatttgtatgatcttttacgtacccttcaataaaactctagactaagtccctacgacaaaagaggcagccccagcagtggccttgtggcctgatctacagagacagcaagccgccattcactgacccacccccatcacactggcaccccacgtttctctccaagcttcttccccacagtataaatcagatccaaattagctgctagtcataatcagcagaaaggatggagaggccttacagttaccttagacacagccctagtggtcttctcctacttcctcagggacggcctccgccagcagcacaacagcacacttcctgtagatctacaatcagttcttccgagccgcagacggctgctatcgtcctcgcagctctccgggtactcacgcttctttttctccctctttaattctaggccttcttttctttcttacctttgtgtcccctttcaagctttcccttttattcaaacgtacaccaaaatggcaaaagcagcaaagcattctaaatcatgttcacgcaagccagtgctggggaacaaaatggatacaaattggtcattatgttctctttcatttgggggtggcgcacaattaagagaggtacgctgtttttatgtacttctctataactgcagctctaaaggttcctcataccatcatgaaatttaagaggtacatgagcaatggcactatactgggaaagttaaaacaaaagatttattaacctgtgggttgttgttttaaaaaagtatcaagggggtctacacacttcctaaggggaaaagtaaacatttttttgaacacttcatatactacagttcttgtggggtttttttgtttttttttttttgacatggaggctcgcccagtcacccaggctggagtgcagtagtgcgatctcagctcaccacaacctcccacctcctgggttcaagcggttctcctgcctcagcctcccgagtagctgggactacgggcatgtgccatcatgcccggctaatttttgtatctttagtagagacagggtttcactatatcggccaggctggtctcgaactcccgacctcgtgttccgcctgcttaggcctccgaaagtgctgggattacaggcgtcagccactgcacccggctgcatgccacagtttttcacagacattatctcacgagtagacatgccaaacctagccatctagagctgtgctatccaaaaggtagtcactaaccacatgtagctatttaaatttaaaacatcattaaaattaaatttgaaattcaattcctcagtcacattcaacgcatttcaagtgtttgatacatgaaaacggctactgattgccatattgcacaacaaagagagaacatttccattatcagagaaattctacggcacaacaatgatctaagtctccttcacgaagattttccacaaaaacgtctgaagaattacattgggtccctcgtacaatgaagattaattcgctcacactaaagctgtaactacaatccatatacgtgtgttctcttgtacctgcagccaggttttcaccactgccagtttctacgctatacttggcctactgagagctccagtcttttacaaacacttactacatcctaacctctcttgaatgtctggcaaaggtttggatcaaaaaagacatcacatttttgcacatatgacataatacttgtagttgcctggaaatttattggcccatatgaagtgggatccccggggcagtgacaaaactaagtttatgctactgaggttttgcttgcccaggaaatataaaaaacttgtgactgtgaagtcactaaataaactaatggttttaataatgagggcaaaaaattattttaataggtataatgtcattatcaaaccacagaaaatgctatacctgaaatagagttcaattttggttagatttcctttaaagtctcacaggactcatgtggtacggggcctctgtgacaataggtaacttttcataaatgcttaagcacatctggactctactccagtgacctacaaggtaatacatcattctgtcagtttcagaggtacattcacatcctattctccaaaaccagaaatcgcccagggattcctagaccatatgacatgttgctgaaggaatatacaaatatatacacacaaatgtgcgtgcacgcgcgcacacacacacacacacacgcactgaaagaatattataaccattcacctttcttctaaattttaccttctgtgttaactttccctgtgttgacaaagaatgcctctcactaagtcatgaccctgcaggtcactgtaatacaacatcgcatacctggattattataatgggtgaagggttcttacatatagctcaaccggaggttaggaagccctacgaacactcagatttttgcttcatttttaaccaaaaggggtcagagcctttgtcaataccagctgttgcagtggttggctgcctgtgataataggctgcctttcacctgaaagaatgaaggggtgtttctcagagtaatatcttacgatacagaggatgatactgtctttaaagctagtgaaaatcaattttactgtcacttctttatttaaaaaaaaacctccctttgcagaaatatcactgagatgtcatgtttaaattttttttctacttcacattatttataagccaatattttaaagatttttggcagttctttaggcctgggcaggggtgatatttgcccagaatacatctgatatggtctcctggttgtttctaaatttcctgttttgactgatcaatgcttgtacagtgcttgttattaactactagacaataactcctgggtacagacactgctccttgtcttttttcctttgtgtaattcagatagtaaatgtccagcaaaaagcaagattccaaggggtaaattcaattgctgacgtatttgcatttctaattctaatccaagttaaataaatgaaaaatccactgtaaaagagaagcacaaaaggcaaaatcttcacaatcattacccagggaatcactgctttgtataaaatcattaaaaattatcttgaaaaataataaaagcaagttgactgagacaattatacaattctaagaaatgtttttagaaatgttcttctaagtattgttctttttaaattttatttttggcaattctcaactgtaactacaatacaacattctttccccaatgaaaaacaaattttaaactatttatttaacacttttggccaccaacatttacagaaatagttgcttagtatagcagctcaagcagcttaaaaaatttaaaagttaaaactttcatagggcctagaagcaaagaaaactcattagcaataaacataaatagtgcccaatcttgttttctaaaactattctccaatttctaaattctccaatttctaaaactattctccaataaaagaaaacagggcacattgaagaaatggctgcttctaggatatgagcaggaaacataaaaaataagcctgaagcatcttgtagtgccagaaagtgaggaggtgctaaagaaaaaaaaaaacaactctgcaatgatgaggatatgtcaaacggacacagaaatcaactgaaaaagttccctgcggccaaaagttagaatattttgggcaagaacataaagtagtattggattataactagagatataaaataaattgtgtacgaatacatactgatataaataaaagacaaatctcctgttcagaggaattccaaataatttacatattaaatactcctccttcaaggaggtggaacgtggctcccctctccttaggtctgggtggtgcctagtgacgtccctgtgacgaggacagtgtggaagggaaaaggaggagctctgcagtggcgaaggctgacaaacgcgacctcagctaggtgatcaaggtcaaaatcaacaagtcaagtcaatagagcatattccaggtaggatgtaatgaaaacggcactttatctctgtggtcttcctccccaaaatccgtaactccactctaatcatgaaaaaaaattcagacaggtattaccttctttccacgtaaggtacgttctacaaaatacctgaccaataatattcctccaaactgtcaaggatcatcaaaaacaaagaaagtatgaaaaactgtaccaagagaagcctaaagcaacacaaggaccaaaaataacgtggtatcctgtgtggcatactggtacagacactgggtaaaatccaagggaatctgaataaagtatggactttagttagtaccagtatatcaatattggttcattaattgtaataatgcaccatactaatataaggtgtcaatagggaaaactgggtacagaatatataggggaacactctgtactattcacaattttgctgtatatctacactttctaaaatttaaagtctatttaaaaaatttaaacagtctttccaatactaaatcatactgcatacaattaaaaatatttatttgtttgccattgtaattgtggttaagagtgtgggctaggataaaactgctggatctgaatcccgttcccctgtctaagttgatttttactattaatagttatgtgcttgacctgtacacagtatatagctaacacgggcccattctgacatcagttatgttcagcagtctttgctttcccagtaagagaaaagaagacaaataaggcccaatcagcccaaagcttctcatcacagggtagccatatttagtaaagaaccaggcaacatttgctgagtatcacagggactaaacctggggcaaactggacccccattcacagtcaaggcaggttctctttcccaagaacagatgtaaccagcaatgtgaataatgcctctgggcaaagtgcaggactgattttaagagctgtcagcaatttcacatgatatgaactctgtttatttctaatattcaaatgagctcaactaatgaaatactattttattttcataagcaaaaagagcagtaaaatgaatttgataaaaaatatctgaagacacattcaataagaatgaccggggtacatagtatgttattcatcttttttaaagtctacatgttaaaagatttacaaccaatgaatgcttcttaaatgaatattcatacagcaattgcagtggcttttttactgcctaagagagtcattaaaggcttgtcatcctggcccagcaatgcctctggtgcttctaaatcattagatcttagtctactgctttgaatgttgtaattgcaacataaaaatgagaaataaattaccagtatgaacaatcaaaggtcacgattttcagcaaaagcttagaattttatagtggcacctactttttaatataaacgattaagggtatttttcttgaccagactgagtaaataaacagatgcaattaatgaaacaaatgaaaaggctgagagcaactggctattctttaaacagattataagtaactaatgggcattaaagggttttttaatgtaaatttttgcttataatttcaacttctattttagattcgggggtacatccacaggctcgatacatgggtatgtagtgtggcgctgaggcttggggtagaaatgactccatcacccagggggtgagcctagtacccaatgggtagtttttcagcccttgcccccatcccctcttccccctctagtagtcccagtacctactgttcccatccttatgtccataactgatgtttttagagttagattaactgtcactatacctaatacaaaattcagtctgggattgtgcctcaggctatgctccacgtctgctactactctaagatcacgtgccctctgtgaagtcactgagctgagcacaccccagggacagggaacctgatatttctcttctatgaatgcactcagcacctcacactggatatataaagaataaggaaatcacttaataattcttggattaaacaaatgaatgcatctgcttgtggaattatttccaattcagtgcaccaaacagggaactttggtatacagccaaccaggctattttaagttttgttttgttttgaaaaaagtatttactgtgagggcttagagcagttacagggctctaaacagaaattactggatactccctcccttcaggacaacgtttgacacatttccaatatcttgtcacgtacaaaattcagaagagcacacctgattcgctggcttggtggggtggatgcttaccaggagatcttgattgacaatgacaccaaggctttatccaaggtggaagttaaacaaagtaaacacggagatgctattcctagaagagaacagcatagatgctgagcgagaatgtacacagacagccactgtaacagagaagatggagaacagcgtagatgctgaacaagaatgtacacagacgcccactgtaatagagaagatagagaacagtgtagactctgagcaagaatgtacacagatgtccactgtaatagagaagatagaggagaacagcgtagacgctgaggtagaatgtacacagacgcccactgtaatagagaagatagaagagaacagtgtagactctgagcaagaatgtacacaaacacccactgtgatagagtagaggagaacagcatagacgctgaggtagaatgtacacagacgtccactgtaatagagaagatagagaacagtgtagacgctgagcaagtatgtacacagatgtccactgtgatagagaagacagaggagaacagtgtagacgctgagcaagaatgtacacagatgcccactgtaatagagtagagaacagtgtagacgctgagcgagaatgtacacagacgcccactgtaatagagaagatagaggagaacagcgtagacgctgagcaagaatgtacacaaacgtccactgtgatacagaggatggagaacagcgcagacgctgagcaagaatgtaaacagacgcccactgtgatagagaagatggagaacagcgtagatgctgagcaagaatgtacacagacgcccactgtaatagagaagatagagaatagtgtagacgctgagaaagaatgtacacagacacccactgtaatagagaagatagaggagaacagcgtagacgctgaggtagaatgtacacagacgtcactataatagagaagatagaggagaacagcgtagacactgagcaagaatgtacacagacgcccactgtaatagagaagatgcacgggatgggaacaactaacaattccccaggaactacagtaggcattttgcttttcatatatatgatttgattctccaaacaaccttttgacgtgggtattatcaaccccatctttctagagccgaaaatgaagttcaccaaatttaagttacttagctaaagtcatgatatcaaacctaggtctttctaacctcttctacctcccaaccaaaaaaaaagtttcttatcaaagcatcatgtgaaacattaaatccatgaagtctcagaaatgcaagtcatctttgaaaacaatgtttcttgacaacgaggatttcttgcccccatattaacaaggttttctcacaacatattcagcaaatctttttcattcaatcaaaatatgttatttgcttttatataaacctaagtttccatggctattgacagaaaatggtgataccaacgtgacaagtacaattcttacagacaaattaataatctgctcatccctacaagctcaagattcccctctaagtaagtctatcagtccttatatatggtagcagtaataagagataccagatgagaatatggacacatccacaaaaattgctaatccctaatggcagtcaaccttattaatagggggttaaagcaggagcattttttaaaccagcgcaagcccagcacttttctaccatgcagaaaatgggtgttcatctctctggatcagcttaagcacacgcatgctattttgtttattatttgggtcactatatctgtaacctaagcagatggtaatatgcattttatatgaaatatttaattaggccatcaaaaacatggcagtaccagctgtcacggcctgctgaccttgggaaaggaggaagtatcagcaaaatgaggatgacaatgttcagatgaaacccagaaatgaagtgtttatgaaaatctcagttgctctaacttaccacacttcaaaccaagaaatgtcacggaagcataatgatccggttcacatcaatcacctacaggtccactgggtttattaaaaactattttcaggccaggcgcggtggctcacgccagtaatcccaacactttgggaggccgaggcaagtggatcacttgaagtcaggagtttgagaccagcctgggcaacttggagaaaccctgtctctactaaaagtataaaaattagctgggcgtggtggctcatgcctataatcccagctactcaggaggctgaggcaggagaatcgcttgcacccgggaggtggaggttgcagtgagctgagatcatgccattgcactccagcctgggcaacagagactctgtctcaatttaaaaaaaaaaaacaaaaaaaagccatttttaaatgatttatactgatacatacatagaaaaactggaaatatgtactgcaaaataataattattatttctagatggtgagctaatgggtgatttttatttaatacttttacttaacgatattttctataatgtacttttatgatttgaaatatttttaatttaaaaaaacagtgacatatacatatcagtccttttatttagtactgtagttcctgaaacactgccttaaaaatccatttttctcataaataaatttgaacacatttgatcctttctcatttctacatgaccacctttacatttttcatatctgaccgccctatcattggcctatgaagctttccaatctcttagcccaagttctttttccaaccaagtcagaggactcctgctactgcaaaccccaggctgggccttgactctgcctgcaagaattcagctggaaccgagtcaactccttccccctttcctcagaggcttttccagagacttctccctttcctcagttccccaacccatcaccatctccctcaaatcatcgaaatgtgacgtattaaatccacgcacagtctcagaaatgcaattcctccttgaaaacaacagttcttgacaacaaggacttcctggtatcacgctagctaacaaaatatactccaaatccttttccattcaatacattatgatacctgcttatgcataagcctaaagcctccatggctagtgagagaatatggtgataccacagtaacaaatccaacccaatcactcctccacctcttcgcccagaaaataaagtctggaggctgggtgaggtggctcacgctttaatcccagcactttgggaggccaagatagtggatcacttgaggtcaggagttcgagaccagcctggccaatatgggaaaacccgtctctactaaaaatacaaaatttagctggtcgtggtggtgggcgcctataatcccagctactcaggaggctgagacaggagaatcacttcaacctgggagggtgaggttgcactgagctgagatcgcaccactgcactccagagcaagactccgtctcaaaaaataaaagaaaagaaaaagaaaaagaaaataaaggctggagacttaagaactttctccagtttccttccctggtccacagcaaatccctctgaccccagggctttgtttccctctcactggtccttcagtgaaattaattcaataaatatccacagagctttaatccagatgtgtgcaagatattggggatttgttcagccaccatcagacacaatctctgctccatcaattctctcccgcttctggacgccagcacctccccatggttgttcgctagagctgccataacagaatactacagactggtggctgaaacaacagcaactgattctcacagttctggagtctggaagttcaagatgaaagtatctataggtttggtttcctccgagccctctctggctggaggagccactgtcttgctgcctcctgacacggcagtccctctgcgcacatgtgctgttggtgtctcttcctcttcctacaaggacaccagtcatactggactagggtcaaccctaaaggcctcatgttaaatcacctcttcaaagaccttctctccaaatatggtcacattctgaagtaccggtggttagaacatcaacatatgaatttgcggggacacagttcagcccagaacacactctccttctcctgggtttctcacttgctcctggctcttctacctcagtcaataacatcctcaaatctttttcatatttaatgcaccaacaacccactcctagtccagatcttccccctgtcctatctagctgcttcccatcactgccaagatgtgaaaataccctaaactagaagtctcaaactcaaatatagaggagccaggagaatcctaagtggaccggatggagaacaagagagtaccagtgcctgctaaaggtggagatcactatccattgccagctaacttcagtcaggtgtgaaaacagagcccagggtatctactgtgttttgtaagagaacccagaaatatatttatatgtaatttcccaagttttatatgctgataataaaaacagaaactccccccaaaaactgtaagtgggccaaataaaataggtttataatctatttttcccctattttttccctataatctcttaaatttactttccccatttcctgacctgtcactcatcctcacattaatgaaaacaggcttctttgtaccaattccttttcccagaccccacttaaacagctaatgctgaagcccccatatcttacctgccatgcttcccttctcaagtgtgagctccttgaaagcagatcctgtgtctctatatttccagtgctgagcactgtgtccagcatagaatgtgggctcagtaaatgattactaaataaattggcttaactctttctttagaacaacccaatgaaatggaggaatgataaatcaaagaatcttacctttgtcaaagctcaccacttaatttacctatttgcttcactggtttagcaagattctggaccatcatgtcacatatatactcttacatggcacgacagcttaaaatccccacttttccttcaaatggcacaattgagcttccaaagagacaaatgctgatatcattctgtcatttacccaaaaggtccatttatctgcatgcttaacattttagaacacagtcaatcatcagaaggtaagaaaaaaattctatgaattgtcaaaataggtgattaatgttcattcattaatttcactcataagcaaactcttcaggccttgactcagaatctcctggcttttaatttttaaactattctaacataacttcatttgcaggagaaatacatcaggccagaactatcttttacatctgttagcctgagagccagacttaattcctgagataccagtgtgctgctctgcggagggggttcctttgaacccactccgaactacactgaatttagcctcttctcatctgtcacttcacttatgaactgtcaaaattactccagaagggtggagtctatgaagatgacaataaaagaagttttgtacttaaaaggaggcatggaatttagacgtaagaagacagaaacctagggtggtccttacaaggagatacagttcagctatcacaaattagctcaagaaaatacttaggtgtcatctctttctaacaaagttattttcttgaccaggaagcttccagtgttccaatgaagtgctccaaaccctcttttctttcactataaatgtgggcatggtctccctcctggagtcctttcccatgaaatatccagtacagtcatgcgcagtctagccacaactcgccacaggaaaagcacaatatgagggacagtgttcactctcatacatctctgcttttgttcaatccaggcataacaggaattagacaggactagattaaaagttcccagttccggcccagcgtggtggctcacgcctggaatcccagcactttgggaggccaaggcagacagatcgtgaggtcaggagtttgagaccagtctggccaatatggtgaaaccccgtctctactaaaaatacaaaaattagctgggcatggtggcgagcgcctgtagtcccagctactcgggaagctgaggcaggagaatcgcttgaacccaggaggcgaggttgcattgagctgagatcgtgccactgcactccagcctgggtgacagagagagatgccacctcaaaaaacaacaaagacaacaacaacaagagcaaacttcccagttctgctacactcttaaggcaagttactaaacttttctaaatcttcacttcctcatatgtaaagtggggatcacaatattaaagcctataaaagggtgaacaaatactaaattcactggtgtgatgaattacccatcatgctgtcttcaatttccacgtctcagctgaggctttccctgatgctgcatgtgtggcaaggatcgggctttctatagaaaatattgaataaaataatattcctccactgtttttaggacaacttcaattagatgtggaaatactagggaaaaaagagtagtcttaaaatgtattttataaaaatctagatacaacttaagcctaaaataaatttaaaaaaagaaaaacaaattaatccagatgacatataactaaacatcaaaatggggaaggaaggaaggaagggaaacctacattgaaatctattctaccataaaccaacatgaacacttctgaaaagaatgtaagaggagttctgggctatctcttaagtaaaagcaacaggaatcccatgggtaaagaaacttgtaataaagaggtatttagactcaaagaatctcacagaaatataagaaatagagttagggtcatatggaatgttctagtggtaccaaaagccacacaaaaatgacagagaaaaattatgtacagaacttgtatgcttgaaaaaaaagttacagtattattcttctcttgctaccaatgcaaaacaaaaatcaataaccaattctgttttcagatttttatccactgtgctgcataaaggcaatttggggactgtctgaacagaacttctaactcagcatcttctcagacaagtagatttgtcattctaaccaataaataactagtcatactgtggctaagagagcactttatatttaatgctttaataaagctctgaaaaagttgggaaaactttaaaaccttagccactttagagtaatcatattaaattttaatatagttttataaactgtataacagctcagctgatttaacaactgtaaaaagctaaattcacagaaaaataactcgtattaattattgaattcacttttcagaagcactgattcaccgaaagtgatggcagactcagaagcttctgaaggaacacagttgagttccctaaacatttcattagtgggcattaccagggaacacaattctatgccaaacgtataaggcaggttttaggacttcagattacctaaaatgaacataataatgagtagtcacttctataaagatactggatattggatataaaaattaaatatgtgttatttgacacacctattctctatgaataggctgtaccacacataaaacatcagaaaatctgaattcttgtgtgtaggtcattcatatgtttactcctgtcttttaaattcatctttatcaccatcagatcctcattacttattgtctggatgcaggtttctcttttacttacactgcctctccttccacgttttcatcgttatcagtggcccatgttagtaggttaatcttagtttgtgagcctgaagatctcttagcgctccaagatggaactggtacgtgtcatcttatttccatctaaatacagcataaggagtgaaaaaggtcaatggactgggagttactaaataaaggtgatgtggaaaacaaatcataacataggagtataagctaaaggaaagggccattatggtaatatctatcaaggacacttacaaacagtaaaagacaaaaggacatacaaagaaacgtacaacttaactaaaacagaaaagaaaaaagaaaagctctgaagtctacaaaattataacaacgatgggatatgaatcatgttttttcaattctaagtggaaggaagaaaaataaatcacatgtgcctggtaggggagaatttgcttaagaaagttttctcattttagatttgcttttggggtagatggtactttttcactatattcttcaatctcaagttttcacaggaatcacattaataagagacagggactggacaataacctggggagcagtaaatttgggggttattcttttgcattaattggtctagttaaccaagatgtgcaaactgccagagtagaagtaaatctacattctcaaaatttttttaaaaatgaagagtgacaaggaagaatatgcctcattctagcaaagtcatatctgaagagagagctgggaaaataggtgagatttgaaatttgtgtctatatgatgtaagacaattttagaatgatagttattatctcataggctaaatcaaagcacagctgtctctctgcatgcacattttgattctgcaacagaggtcctgcaagagccatcataatgccagcaaattaaataaggagagtttgaaaggcccagtcattgtgaacaagactgaggctatttcattcacttcacgtggtgaagtgcattacgaggagctgatatgactgtaaaatgtatggagacactattaagctgaaaggaatctagacatgtggatagttccctactcactaacacttcatgataatagagttaaatattctgaatagttcacttctaagggattaatacacttccccagtactcaaaatcatgtctgcctttcaacttatttgaaaggttcagtaataactcctcaaatactcactgcttgtcatattctaaatactgaattcttagatgcaaacacgcagctcctattagggctaacggaagctacatgtttgtaccaagggaaaaacatacgtctagaaaactgttctctgctgctcataggcaatcacgttgcatgtcctctcgtggacggtataaaaatgcgtgactatttacgcagaaccattcaggtgttacaggcacttccatagcatccaagaatgcattagccaaaaccaactaaagtagtttttgggctcatgatcattcaagctgaatcaataatattaaacagcatgtggaatgggggaaaaccaagtgtaaagcaacattaaaacctctttccactcaagcataattcattttgatctttactactggattcagctaaaggtcaaataatatatgatgatttagattcagaaaatatattatttcgctgttgagtatagtctgaaatgagggcaactaatttaaaaatggaatcaattttaaaaatataaatgtaataaaaatgtctccatcacagaatatacaaattaagtcccactattgattactgccaacattttaagcctccctactcatattggtaatgtctttagtgcaacttaattttcttcatattgtgtcatacacattcaatgaacatcattccagtgagggaccaagaacgaggtcagaaatggctgtgatgataaattacagaccttaataacttctgaacaatttgaaatgtaaaagccatctataagtcattcagcttgatagatgaatggttaatgaattatacaaactaataaaaaccattaattatttatctgtactacaaaatggcataaggccaagatcttaaacatggtctgcattaagaccaaaactgggattcagggtatatataacaagagggggaaaaaaagagttatctattagaagactgtataagcaaaaatcacttaagctttataagcatagaagattttattaaaggactggtcagattcataactgacagaccactgaaatattatcagcattggggtaaaaaaaaaaaaaggtaactggttgatttagatgtttccttgttcttttgctttttgttttcagtgaaaggcagtttgaaatttccgtcttagtggtttgtactgcagaacactgagatcaagacttgggtacttttgtatacttgcatttcttgctcttgcatgagtcccaagcagtgatggggggctacccctccccactaaggaataatcacattccagtttctggaaagaactcaaattagtctgactctagtgaatcaagagcaagtccaagatggaaacacaggagaggcaacctgggagggaacagactgaacaggtaaaactacagttagtagcctccccgttcatgaattacaactgacaaatgacatcttatctggtaactctgtcaaatcttcactaattcttcgacttcagtatttctcaagaatggctcttctactaccaatatcagaatcacctagagagcctgtttaaaatgcatattcctaagttactttccagacctcaggtaacaggacatattccagaggtctggaaataggtaacagacctcaccaagtgtggggctgagaaagcttttaatgatctgcccaggatattccaatgtgccctaaagtttgagagtcacagtcctaagaggatgctctccattacaccaccctgcagcaatggtgcctaccatcacacgcatagtgcacatgtcagcaacgtaagagatgccaagctcttaagtgtaacagggtgccttgaatattccctaaatatgtgagaacataggcatgactggatggataaatgcatgaaggagaaaactaacagtacttctgatataaaataggaattctgattcctttagaattggctctacagcactttgggaggccgaggtgggtggttcacctgaggtcaggagttcaagaccagcctcaccaacatggcgaaaccccgtctctactaaaaatgcaaaaattagctgggcgtggttgcgggcacctgtaatctcagctactcaggaggctgaggcaggagaatcacttgaacccgggaagcggaggttgcagtgagccgacattgtgccactgcactccagcctgggcaacaagggcgaaactaaaaaaaaaaaaacaaaaacaaaaaaaacagaattggctctacaaatccattcgcagctctccaaaaatccccaaggtgctccaaatttctcacagtctatatatttgaccgtacgatcttaacttctcaggtattgatcagagaaagtcgagaggaaggaggaaatgcagggcttcaattctgatttcgcagaaacatgagtgctgcactgctttcggccccgcatggtgtgctggcagacaccaccactgtcccaggcgcgtctgctgtgaaagccgttgcttagcaacagcaatcaatgctgtatttcctcttcaccattttcctgaagattgagacactgctccaaggtatcattttcaaataccttctgtttcactgaccaaacatgtttgttaatttttctattataggaaaaaaaaatcatgaaccaaattggtctaagaatccaggaaagaggagtgagggaaggtcagtataacaccagtgctttgggatttgtttgatgaagaaaaattctttgacagctcattgactttatttgctataccgtttcattctgccattttagcattgatttctgctacctcatgggatatgaaagtcgttagcatgaattatcattctaaatgcagatccacaaggtactgccataaaacacaaaaagcaaatgattttcagagactggttgaatacacatctcacatctctgttaaagctcttgtcttggtcatgttcttattaaccaataacaacaaaatgttaaaaaaaaataaacatctctccactgataccacaatatataattctttcagatgggcaatgtttctactaaattaattgtacctgtgatgaaagcatatagacaataccaatatttaccttaggaaaaaggcagagaaagtacacaagagggagacaaataaaagggggaagaggtagtaatttttatcaatatgtcctaccaatgaatagattcttcatataaaaccaaaaatgagacttgggaactttacatgacatcttccaataaagaaacttgatacttgcttgaagtatatacgtgcagatatgttagtaagtggtggaatccaacaaggtggatattgtgtgatatttatttttcatgtttattgaatatctactgtgtaaaaattctatgggtagcataaagatgagtaaaatgtaatccctgtacaagattgtggtaaaaaaaaaaaaagtcacataaataaatacagaagaatacatattacctcagataatcactcaagtatttagtaacaacaaatattccacttaaggtggattatatctacaacagacaaaatgagtaaatcggaatcaaaagcttttatttttttaaaacactcaatactggtaaggatgtagcgacataaaaatgcatcatgtgccagaaaagacacagggctggtaaactaaatcaactttttcaaagatagttagcaatatgcaacaaaacttttaaatatgcaaatttaaaatgctgacacagtaattgtatatctagtcaattatttcaaggaaataaagatgccaacaaaagatatttatttctgctacatttaaaataataaatactaaaatgttcaatattagaagaatgattaaatgcataatggtaataattatatgataaatgagtaccattagggtattcaagaatattttatgaaaggaaataattcctataatgttaacaggaaaaacataaaagcagccaatacataaatgcatagataaaatagtggaacaaatgaaaatgctaatgatttttggtgatttttattttcctctctttattttttctatgcgtttctaggttttttgtattgactgtctactgcatatttggtcaccgaaaaatgtcccaacaaataaaatctatcagtctcatttgacttcctattaaccgatctgttttatttcaacttagaacttcaaccctcactggtatcaagtactgccaagttgaatgatagtactcttaagtttcccaagcatttttagaccagcagtttttcatttccataaagatctaataaatttggttaatattttccacagagaatagctgtaatgaaagcataaaatttaagttaatctaaacaacaaatatgtaccaagcacaaggcatacaaatgtagacaggacgttcttgggttatgagaaatggatttcagtaacttgctctcccttcagtgtccttccagaagatatggggccttcaggtacagcatttctctggtgtcagaatatatagtctgtctacaaaaggagctctagtatcatccagggcaggtgatgacactgtctacaactgctaaccctctaccatcagataaactaaagagtgaaggatgcagagaaatgaataaaattaaaagaattctgtcaagggaaattagtattctttcaaccttcctcaatctcatatgatgtcgacacagatacacaggatatcacatgctctttttgtcagttacctgtgactatggatgctgacaaaagcacttttctaaacccaaacaccaagggccagactttccaatgcttacacagcagcatgtatgttaatacctgcattatcaaaggaggaaactgaagatttggaatggtgaagtacattggctagggtccagctcatccgcaagaagacaaaactccagtgagttttgagtcaggttatctcctaagtccgtgtttccaccattatagcacatatgatctttgagaaaatggataggagaaaggcacccattgcaaaggaataacatgagcaaaacagagcagcagaagtcaacagaacattctcaggccctgcacacccaagtttgctagaacaagggcaggggaacactcagctacctggtttgttcacccaacctgccctgtctactgcacttccacgccaggacagtggccctgttcaaaggtcaaaaccagtcccactctgatgctcccctccctggctccattctcacttcagcatgatgatcttctcatggtccctgagaatatcttagcatctgtaatggccatcggccattgagtaaatcccagttttaaacttgcctataaagaacgaacttagtgtgcttttctgctgctttctctcattgaacacagttctttctcttccttcaagaagaacctttctgaagcaccttgaatttcctagtttataatctctgtgaactcctgctatcaagagctctgcagagctagcttccataacctgtcctctttggtgactctctcgtaacaccaaaagctcccttctaacaccaacaggcaaaagatggtcatggtttaatattttaggtactgttccagaattagccagactgtggttcttaatgtttgcatctgtttgtttacagaaatggtggtattgatctaatggaacactggaacttggtctttacaatggcaagttgtggatgataaggttgaaaaagacaagagaggagtctagaaatccagtcagagattagatttcacatcccaggtcacaaaatggtagggagataatacatttgtgaaagctttatttggtaaaagaatgcaagataaccaaagaggagacaaatgtcatagcaatccagctatgagttgtgtactctgtgctggaatggtaaaccaagcatggcaagatatctcaaaggaaaaatgaacagaactgtcaattaactgtatatgaggtaaaacaaaggaaaaaagacaaagagatgagttttgaaaccaatatgttgaagctcatagtatcagctcatttatttaagtgaaatatatgaaggaattgtttaaaataaaaaccaaggaatttttaaaatagcatgccaaagtaagtaaatacataataagtatgcctccaagaagtaaggctaagagagaaaccaatttagatcagtggcctctttcaggaagagagaaggttctgccctatccagcattttctataaggacaagagaaaatattttttcagtcttccaaagacagctaccggaatatttaggaacagtcctaaaaatcaagaaacagaatcttctgaatatggaggaatgatcattaaaacaaagaggaatggagaatagcaaagccattttgcagctaaacttgctgagccccaaaattatccactcatgtttatgttagcagtactataaaacttatatatatgctctattatcaaatacatttttccactttctagtaggtaaaattcatggaaacacttaattttctttatttatgcagatttttacctctctaaaaaatgctgctgctgagctttctatttttgttcattccagttgaaatgcgatgattcatcggtcatcaccacaatggccacacgcatgtggaagagaagctcatgattctaatctgcacagttgctggcggctagatatgcctaaagaggatgtgaaacagcagcttcacttccaatggagatccggacagtaataaaacagtttcgcaatctcttcactaaatacatctttgtttgcatggtctatgtatattgtcatggggcaggtgcaggaaaatataaaatatacatatttaaaatcctactgagctgctgtgaagtcagtgacaaagaaaaacacacacacgctggggcttcatgcatgtagttaaataaataactttgagatcatcaaaaagagtcagcacacccatatttcttacttggcgctcattactgttcaaagacaccatttttttttaatgctgagccatcttaaaactttgtcaggcaacattaaattcttcaagtcttaagccctaaagaaagttaccagtaatgggcagtaacattaagttagctttgcatttaagaaaaaatatttatccatctgccttctcccacagagtactttggatcactctcagtggccatcgttctctgtcctgtcttcatgcagctgggctgagcagcagcatgccacagaaaggggccagcggaactcaactgtccaaagaaatgtccaaactgcttctgttacgtaaagccaatgtcactttccttttttaaaggaagccctggggtgtaatcctgcctgagatgagtccactgacacgacaaaaatctaaaatgtgtaactatttggaggaaagtcagtgtgtatcttccacttgaaaggtataattccttaaaagggacataaaaatattttttctattgtatactctaacagtcaataactcacaaggaaaccgaatagagagcgaaagatggagcactctggactaatgtgaaaaacaaactcaaggccgggcacggtggctcacacttgtaatcccagcactttgggaggccaacaggggcaggtcatgaggtcagcagttcaagaccagcctggccaacatggtgaaaccccgtctctactaaaaatacaaaattagccaagcgtgatggtgcacacctgcaatcccagctactcaggaggctgaggcaggagaatcgcttgaacccgggaggcagaggttgcagtgagccgagatagcgccatggcactcctgcctgggcagtagagtaagactccatttcaaaaaaaaaaaaaaactcataagcagacttcaggaaaatgccaaacaataaaatacatctccatattggacaatatggtgaccccaacaacccagatagacgcactgacaaatatcttctaaatgcatcagtacattgtttgtaccctcatttggggaaaaatatgcaaaaaagatacctaggaacaagtgggaaaatctgatatggattaggtattacagaaaatattagagaattgttactaattgtctaagacgtgctatggcattgttataaaagagaacgtctttgtttttagaatgctaacaattgatgaatctaggtgctaaatttctggttgtattccttcaccttttctgcattattgaaaatataataaaaaatgaagaaaaataaaggcataaaagaagttgtatttaaaaagagaacattaaaataaaattcatgatttaagtgataagaaagaaatatccttagagtattacagtcaagtaaagataccaggccagtaagtaaactctgaagctagctttctcactagaaacatttagctaacctgaggatcctgaactttccccttgacggagacgtgggcacaaagcactggaggctgtgtgtgggcctcatccagactggaaagtctaaaaccaaactcctgaacagacctaggattttccaaggactatatgctgtgagttagaatcactgtaaattacaaaaaatctattccacacaagggagagcaaagaagttctcaatctagaccctaaatactggacagagggggataatttttttctagactcataagcagaagttggcatctaaccaagcttgtagcctaaatttatattatctttgtgggagaagaaacctcaagcccagaaattaacctgagcaggatccaaggttgttaatgccttagttatccatcaaaacaaaaggcaaattcactcagggtgaatacaccttcaatccaggcctcaaagaatttctaaagagtgtgaacttacagcttaaaaaacaaaatcacaagccagggtaacgtagggagaccctgtctctacgaaaaattaactgggcgtggtgatgtgtgcctatggtcccagctacttggaaggctgggatgggaggatcgctcgagcccgggaggcagaggttgcactgagccgagattgtacaactgcactccagcctgggtaatagaccaagaccctgtctcaaaatataaataaactaaaaattctcacaaagaaaacaaagaaacaaagatcagtgaacaagactcagcagaagtattatattgctgaatcaactcacaaagagtttctaatttggtattatcagaatttaaagtaaatatgtttaagatgtttaaaggaataagagattgaaaatatgaggaaggataaagaaaattttttaatgtctagctaggaaaaaaaataccatctagaaatgataaatataattgtaattaaagtgctaatgtaaaaattggcaacagtttttaaatcccacaatgtcaaatgctggtgaagatggttcagtacgaatgaagtcaactttcagaaacaatttgacattatctagtgaagttgcaataagcatactcatggcccaacaattccattacaagttatatatccaagaaaaactcctgtacatgttcaatggaagataaatacatgaatgttcatggcaatgatatgtgtaacagttaaaaacagaaaataaataaactatggtacattcatagaaaacaatacagcgataaaactgaatgagttgcagttacatgaccatcacgaataaatctcagaatactaggtcaaaaaaagaaagtagacaagaatacgtacactctgacatgagtaaagttaaaaacataccaaattataacacataaaaaactgatttcaatacatacaagaaaacctgttaaaaaaaaagccagtgaaaggaacataagattcaagatagtgattatttcgtggggtggagagggagataagagagagaagcagttgtgcagctttaaaagtagtggcaacaggccgggcgcggtggctcacgcctgtaatcccagcactttgggaggccgaggcaggcggatcacgaggtcaggagatcgagaccatcctggctaacacggtgaaaccccgtctctactaaaaatacaaaaaattagccagggggtggcgggcggctgtagtcccagctactctggaggctgaggcaggagaatggcctgaacccaggagacggagcttgcagtaaaccgagatggcgccactgcactccagcctgggtgacagagcgagactccgtctcaaaaaaaaaaaaaagtagtggcaacactgtatttcttaagactggctgactgctatgcaagttgtttgtttactgttatttgtaccttatatttaaggtattttgtgtgtgttcaataaaaattatttaacaaaacaaaaaagcaataatactcacgggtatcttagccaaaagcctgaagctatactagttctgcacacaacaaacatgctttagaaaaagaggaaaccagtaacattcaggaatatcatagcaagacaatcacatgcttctggaaaatacaggatactgtggtaaggaaatgaccaacgttgtcaattctgtcccctttccagggatgtagatctccatttcacagagcaccaatagctttatctgtatgcctgggagttgtcaagcctctcttttatataggttgggcttaatttaactaaaactcctgattttcccctccaactattgatagggacagggggcagagaaattctaggcagaaaatggtggtccccaacaaaaccccaccttcaagcctcaaaccatggcccaaagtagaacttacatccctgtttccctgcttgaatgctgccttttccaaaaccacctgtggccctatcccaccccaccctgtgcctataaaaaccccagatccagccagcagagagaagagaagcagctggacatcaaagactgcagctggatgtcggagagaagcagcttgacttcagagggacagcctgacggggtaactctggagaagaatctggccagagatgaccgcatttcacaggaagattaccttcctgccccatccccttttcagctcaccttgccactgagagccacttccattggcaataaaactccctgcatttatcatccttcaattcattcgtgtgacttcatttctcccagatgccagacaagattctggagccatgagtgtgaagacaaaaaggttgtcacactgaccctttgccctcgttagcagaaggcagctgcctcatgcgaaaaggcagagggcccattgagctgttaacgcataagccgtctgcagagagcagagctaaaaggtcactgtaacactccctctggggctttcgtggtcacaggcactcccagcccccagatgcagctgcaggcaagcacagagttggctcctgccagcaaccaaaaaacactcacccaggctcctgcactcacacacctgcatgcctcctttcatgaggggtggaacgcagcagatccgactgagtggggttcactgctggtgccgtagtggctggctgactccagcgaccatgtactccacctcccaccttgttgactcatgcactccctcctgtgaggagctgagagctgcaggtgagtaaacagaacacccctgttgcaagtcccacgagggtgtcagggaaatatactgcttcattattgctgttcatttgatttcaaatataatgatatctaaacgcaattttttggcatttacgttcctctaagcccagccttaaatttagatgatgaaaatcttaaattgtcccaaatggacactacctccttccacatctgttgactaggatattgatggtagtggccattccagacgacccactgctaccatcacaccagctgcagtgaggaggaatggccgggcctgcacactccacagagcagggagaagaccccacccgccccacccgccatgctctccccaacccaccatgcagctgcagacccaggcacctgcagcctcccaaaccatggctgcagacctgggactcctgctccacgaagcaggtgggagccccacctgcctgggcacagctgcagctgaccaaaccacagctgtggatccagacatccctgcactttggggggcccaggaaggcccctgactgcactcacagtctcagaaatgcctgcttcagctgcctggcttctctctgctatcgatgcccactccgacctgggagcaaagtcagggctgagtccgggcaccatgaacagcagcaggaggcaggcaggttcctgggcggatggggcctggtcaccagtgaggccccattgtcaagccaggaagggcctgaaggctgggggctgggctgccagttccggggcatggagtggaaacttgtggtgccttttccggcccacccatggccacctatggaccaatcagtgcaaacttcctcccctctgaggcctgtaaatgccccaggctcagtcagagctgagcagactgggacaaccagctgcagagaggagctacccactccagggtctcctctctagactgagagctgcagagatggtactaccagctgcagaggggagcaacccactctggggcctcctctctgctgagagaacagacagatgatgggacgaccagctgcagagaggagctaccctctctgcctagagctgcagatgatgggacgacctgcctgcagagaacagtctcttactctagggcctcctctctgccaagagctggagacaacggaacaactagccaaacagagaagctaccctctctgctgagaactgaacactcgttgggatgacctaccagcagaggggagcaagtctctctgctaaggagctgaacgctcattgggacatcctggctacggagaggacctgcccactgtgggttttctctgagttgttctattgctcagtaaagctcctcttcatcctgctcaccctccacattgcatacctcattcttcctggtcacaggacaagaactcaggacccaccgaatggtgaggctaaaagagctactgtaacacaaacagggctaaaacatgccccttgctcgccacgttgtgggcaaagagaaggagaaaggagctgcaacccttcgggtagcccagacctgggagctccctgagccagggctgtgagcccttctttggggccctgtggttcctggcatctccaagtttccgggatgtcaccacattccccggtgccagacgggaaagccgcttgcagtgaacccggtccagccacagcctcacagagagctggtgctcacgccagcacctggagctgcccacaccatagcagcagctggtgtgtctgaccgcacagtgggcggaccccacgtttgctgacacacacccctcaccactccatgcctgactccagactccctttgaagcacgggatccaggctggtagcatgagctgagcgcagcctgccagggcgagtgggtggaacaagcccagcaggtccaagcaaaactcaggcaagggcaccaccagtcacatgtttccggccagaaaagtgacaccccaaagaccccatgacagtatgacttatatcctgttatattgtctcatcacaattcacatagggttgaatctgctattttgactgtttgtgatgttttggctagcatctgaacagatgggcagtttttcttcagtatgactatttgccaacaattggaagggtgtaaaactcattctcagagcaacccaaacataactacaaggagtctaacagataaaatatccactgttgtattcagaaatcctgtataaagtgccagtgaattaaaagaacactttggtaatgtggttaaatgaatgctactaataatcataatagaactggaaatttgtataggtattgtgttcacattcatctgattatcatagctctaagaaatagatattacaggtattattacggactttattatcgacaaggaacaaagcacagagagatccatattacagaaaatggactgaactcagaaataagaacaggatttgagccgatctgtgcctcattagctgtgtaaacttaaacaagtaacttaatttctcacagcctccattgcctcatttgaacacgcaagcacagtgagacctaactcacaaggtcctcctgagaattatataaaatatataaaagttatcagcaagagctcctgtcatagagtagattcttcatgaatatatccttccttaatttatgaaatcctccttgataagaagaagtcaaaacttttatcattactcttttcacaaaggagtcaaaggtgatttcaatttagggaaaaagaaaagtttagacctaaaacattaatataaactgaaggatgcaaagaactcaatgttctacaatcatacttcagtggcctctcattgtctcctgaagaaatatacagaatataatgagtgggtcaccatgcggtttagaaggggcagagttgtcctacagtaataatcacggtacatttgatgctaaatcgtatgtgctctaatattgtaatttcacatctaatacatgaaaatctttccaatgaagttagtttattccctatagcatgaagatagatgaagttaaatagtttatttcctatagcataaagatagcccttgacattcattgtcacacatttcctgtttctgagatcagtaatttgtagattccttcctgaaggttccagcaaagagcttttacccatctgcccaactcctttgattcaagacagggaggggaacagaggtctcctcaggaaagagagtctcctgtacccagggtgaggagaaaagtggtcataaggaagccgtggggccacagatgtatgaccactcacaactgattcagtgagccaagaagacagcagtgttgccagagatggaaggtgttctcagaatgctaacaggacttgctgatgaaggggatggtggtaggggatgacagaaagaattaatcaagagcgatgccttgattttggtcctgagcacctgactgggagtaactactgaactggaaaagatagaggcagcctgagtctcctgtaaaattcagacaccttccaatctccataattctagtttcttgttcctggacctcttgctttagggaggcatatagcactttacaaagtatttgctcattttgtcatcttatgtatatactgaaaatggagtcagtgtcaccagaaaggacacctaatactccttgcttttcttatggacctacgactatactataggtgctgaaggtacctatacctatactattggtattgaagggacacaaagatttgacctaaccttagagtcactttgtaggactactaccccttctctgttttcctccttcttcattaactcttcccttacctgacaagcacagctgactggaattgtgtacactaaatggtcctttacaatacggaatacttcagtaattacaatatgctggaattgctaaattctataatttcatttggatgaacttaatcacatcatagcattcaatttggcttattttcaaaatcagcttcgtttataaactaaaaagaactgaaggattcttttcattttcaagacttctcatctgtaagaggatttagattcttctatttacaagcattcttctgagaatctttcattctacacacaggtttctttgggggttctgttttatcttttttcatacactgcctaccagagagaacaagactggcaaaaggactctgtcctcataaagctcagagacgatgaacagataaacaagtaagtgaacaaaaatacttcagataatgctaaatcctccaaggagaatatgatacagtagatgtaatgggaagctcctttagactgagtggtcagagaggacctttctggggtggggtgtggcatttgaactgtgccctgaagaccgaagcagtacaagcacaggaattagcaactgcaagggctctgtttgataatgaacttggtaggttaaagggacagaaagaaagccagtgtggctgaggtgtggtcaaggggatgtatccaaagtatagcaatacatcagagaggaaacccaggggcagatatattagtactgaaatagcataagggattcacactgtattctaggtgtaatggaagtcgatggaaggttttaagggaaggtgcagggattacctaattcatattttaaaaggtcattgtgggcgccactgagaaagaatatagaggagcaggaaaggaaggaggaggaggaaggacagaaggaagactactatgattgctcaggcaagatatgatgttacgttagactatactggtggcaaagaaagcaggggaaacagactttagacatattttaaagaaaatgttaataggacttgctaatgaattcagtggtgatgggggtaagtgacagaaaaaaaattaagagtaatgactagatttttgtactgagcacttgactgggggtaattattgaggtgggaaaaacagaagcagaaaaaggaaggtggcagagggagccgaggaatcaagagttctgctctggctatgttgagtttgagatgcttttcaaatatccaagtgaggatgaaaccagtagatggctggacatacgaacgggagctcagtatagcaatcaaggctggagatacaattttttttttagtatattggcatcaaagagggtatttaaagtcatagaaataaattagaatcctttaaggagagggtttatttaacgagaaagaaaggagaagaaagctcaggactcagcctttcataattccagtatttaaaggttaaacagagcatcaacagccgtcaaaagatgttgaaaagaaatggctaaacagagggaaaaacaagaagagtgttgagtactaggagccaagataggggtcagttatgtggaagactgctgaaaagtcaaaaaaaaaaaaaaaaaaaaaaaaaaaaaaaaaaaacagaaaagacaccagatttggcaagactaaaggtctttggtaaccttattagaacaactgtaatgaagtgtcagaaaagaaagtcccattagaatgggctgaaaagagaatggaaggtgaggaacaggggagaaggaagagacaataactacatagcagtcttttcagaagttgtgcacaagtgtgtgagagagctagagcacaggagagcgagcccgcaccagcacacacttaacacaggtgacaacagaagttacggaaagacagtgtctctggagcatctgtaatcatctccttctttgttttcctcttcgagtcattctgctgaagttcctgaataaaccatacggatctacaacatacatacatctcagacctagtatctcttttgttcaatctctccatatttttctgccaaatctaatcagaggttttgcggagggattcgtaacaactatattcttcatttttaaaaatgtgtgcaaaatagtagcattcggtaaatattacaagattgcaaggctagatgtatctcaaagaacacaatacaaaagatgtaagatgctcttctaactggaaatggtggaaacttcattatgaatccaatttccaaattatttccaataatgaaggccaatgtatgatctagtcacctttgacaagatcggtttccataatatgtttacttgctttttttcacactgtctcccaatctgttctttgaagtttcttcttgcctaaaataaacttccacacacctgctctataaacccgaactcaaagtgtagcatttttacctccataaatgttttggacactatgctgacagaagaagaagaggaactaaatgacctgtgaaagcccctgttagttgcttcatactgataccgaatttctaaatgtattataaatgcatttcacagcattccattaacatgtcagaggactttcttttccactaagcacactttgcatgagttaaatatcattcttttaaatttacataaagacaagttaaagatgaggccatgtactacagatttatttaatctacatgagacctaagatatattttcatcaatggctgtgctagaataattataaattacagaaaataaaacattcagttagtggtatagtttgcctagaattgattttttgatgctgattatataacccattaactgactaaaacttcttcactcgagtcactgcagcgtctgccaccatttgtgttagtgtttacacataaagatcacacacatttgatgcgtccactttccttcaaatatgggttagagtggaactgggaaacagaaccatttctagtctttttacagctttgttattttgatttttaaatttacatttggaataaagagaaactctgctataagaatctcatactaacctctgaataaagtggagatatgcaagtactccaagaaggcaacagaattaaatatattttctatgaaagatattaaaaccaaaagtgtttaataatcttcattaatgaactttaaagctcaagaagaccttataaatcatctagttcatcttccttggtttcaaaatctactcttgaatttatttagcattatgagattattagatgaggttatttattctccctaattttaatattgataattaatctttaataaatgcttgtgatttttgacatattaaattctaaacctcaacatttcaaacagtcttagatcatgaagaatattaaccaagtccaacgtcccatatactttgtagtaaaatggtagaccctgaggtgaagtggggcaataatttcatgagaacacatcacagtacatggttagatgtactttccactttttcttctactagaaaactaagtttctgttttgggaagtgctggctttgtgttctgcccgtttatgctttaatttcagctcatgcactggggcgccctcaggaggattaaagaagacaactttggccgggtgcggcggctcacgcctgtaatcccagcactttgggaggccaaggcaggtgaatcaagaggtcaagagatcgagaccatcctggctaacatggtgaaaccctgtctctattaaaaatacaaaaaattaaccgggtgtggtggcgggcgcctgaagtcccaactactcaggaggctgaggcaggagaatcacttgaacgtgggaggcggaggttgcagtgagctgagattgcacaactgcactccagcctgggtgacagagtgagactccatctcaaaaaaaaagaagagaagaaagaagaagaaggaagaaggaagaagaagacaactttgagtggtggatgaaactccgtcctaaagattccaggctggagaactgggtccttttagccatcttattaacagtttgaacttgaagagatcacttaacctctccagccactctacctttatgcataaaatgaaaataatattagtttacacataagtattcaaataatttcctaaggtctcaccgatctctaaaaatctgtgataaatattttcataaaatagatttggcatcatatgctatgttatttatatttacctaacaccacatttccttatttttattccttttttttttttttttttttttggagacaaagtctcactccatcacccaaactccaaactacagagtgcagtggcagatctccactgactgcaacctccgcctcccgggttcaggcaattctcctgcctcagtctcccgagtagttgggattacaggcgcatgctaccatgaccggctaatttttgtatttttagtagagatgggttttcaccatgttggccaggctggtctgaaactcctgaccttgagtgatccacctgcctcagcctcccaaagtactgggattgcagacgtgagccactgcgcccggcctcacatttccttatttcaatgtttacttcagaaggccctaaagcagggcaattcaactggcttccatgtttacttatcattaaaagttatcttacaggactcttgggattgtgtcctttttaagacaacacaaagttcatagagtaatggactgtgtggtactcctacccgaggctccaacattttgaggcataagaaaatcaagtatctggttctgatttccactctactttgttgccatttttagcaacagttgatggcacttgacctgatctctttcctggtccattgcctataggtcaagctgacagcagcataaaaccctaaacagccataactttttagtatctattaatagatacattttatggtggctgaagtgacaatctaggttcctttggttaagaagttcaaaatctttattctactgctattcctttctgtataagtttctcagagaaaacaaggtgtttccagcagcaccatcactttatgaaaaaaattaaacctccatcatctaaatataatgttttttctaaaagaagccttcttttttttagtatgtatattatttttagatacttccattgctttaagaagttcccatgatctttgagacaaaaatcaaaacatctttgggatgacaaaactaaaaatgaataaatagataaagtggaatttttgagccaactttttttacattttcatacaaatttcgaagctacaattaacttcatttagaccatgaatagcaacctaatggggctgtaacaatttccacaaataaagctacactatttgtttcacattcactaaggatgactattactctaaatgttcaattagttcttcatttattttaaaattaaattcattataaaaataatgttagaatattatccaataaattttctttgctcaccttcaaaaattctacattaccgttctcttgagaaattctacatttggtttttgttcctcatcttatcatcctgcaataattctttgaaatccatttatcttactaattttaaaaaaaagggattagtgtctatttaaatcaaataattagtaataacctattgaataagtttgtgatagaaggtgttacattgtttcagtctacctgccattgaacaaaataatgccaataatttacttaatcctattgaaatttaaattttgcaactctctttatagaaggataaagtttacaattgccctttatccatcttatagagatgatgcaaagttaaattatgcactaccatagtctgttttcgcagttataatgaaatacctcagactgggtaatttaggataaacagttcacagttctggaggctgggaaggtgctaatatccagcaaaggacctctgactgcgtcatctcgtgacagaaggcaaggggcgagatacagcaagagggggccgaattcaccttttatattgacaccaatcccacccatgagggtggaactctcatagcctcatcacttcttaaagtttccacctgttaatactgatatagtggcaattaaatttcaacacgcattttggagggacaaacattcaaatcatagcacgtgcctttcaagcgttttgaggtattcagaaaatggcaagatactagaagtattttaatgtgttcctaaaacattaaacctaaaacagacttatatctaccttcagctctaaaaatctgggccttcaagatttttccaagtgttaagcaggtggaccccaaaagtgaggcacaaacttcacattatccaaacacatgacaacgtttaatatcacagtatttaaatgctactctaatgaatgtgtgaagattttctaatctggtaattcaccgaacttttaggaaccatgacttttcctaaagccatgacctggttttcttctgaactacatgctattctgtatataatgctccacatgtttacaattgctccaagtgatcaattcattaattctcaaacaaatgacatcaatctttttttcacatgtaaagaaacaaaggcagaaagagaaagaataggccatttccctttaatctgcaatcgctcaccagaaagatttagtttgcataaacacattcaagaaaataagcgaaaataaattttaaaagaagtacataggaaatgacaacgtaaggaaaatgggaaagggaagagagaaccaggagttaggctagaatgctgtcctatcttgtgcattgccaactctggagagatccaataatcagtccaaggtaccacacaggctagacctgaactcctgggctcaagctatcctcctgcctaagcctccaagtaactaggactacagtcgcacacagtcagaactagcttgttggacttatttttgtcaaagaatagtatcataatctttgtgcctctcttgattgagaagaaattctcccagagcagaactgtcctatagaactttctgcaatgatacaatcttttctatcagcaccatttaatatggtagccactggccacacgtggctgttgagcagttgaaatgtgtttagtgcaagagaaagacttaatttttaatttgattttaattacttaagtagtcaaatgtggctactggttaccatatttcatagtgcagttctgatacatatgtacagcaaatcacagcaaatcaatttctctcacagtagtatctctctcagttactcagtttcctaactttgacagaactatttatcatatgatgtatattttcacctgaatacttccatatgagtctctattttattccagagaatttttccgattacagacttagtgtacttttggccagtgagttgtgtgggttattgctaagcatggcattggacgtgctcggatgcttgtcttcattcattcctgaaagcagtcttattctctaaaactatccatcattcttactcttctctctcatcccagctgacatgccactttcaaataggtatattttctctggtttcctgcttttctgatatagctgtggatacatggagagtgtaataaacgggttgtccagaaaggagcttctgtagtcactgggcagtagatatcagcatcagcaatagatctatttaataaaataagtaaatatatatccccactatatggaagagtataatacataaaagcatgtaatataacaaattttatgcaccaataattttttacagtattcagaaaagtttctacatagtaactataaactacatattaaaaattgttttctggtcattgctataatgtacacacacattccaattgacacacagaaaaaagaagttactttctttaaactgcaagggaaatatcaaaataacatcacgaaacatttcataatatcctagagatagtatctcttacatttcaaaactgctttaactcatatggggctccagttcatcagaaacaggacttgatacaaaaaggcatggcatgaatgataattactgctttgggtacaaatctgcacacattacatgcaagatccaatataagtcaacttctcacagcaatcaatttttcaaaaggaagggtacaaccaatgtttattttatgttaaggagaggaaatcaaacaaaaggggaaaaagtgagatgaaaattcttatgctccagttgagtttttccttgggagcactgaacagattttaggaaatttagcctaattttgctatggcaacagttataacacttgagaccacagtccaggagaagcgcagcatttattctcttattgcagcactttgatcctttccgagtctaacttaaaagccatagtttttaatgcaaatgagaatacatacattgagattcgggaataattagaatatttatatttgtaataaatccaatggaagctcttttgtgacatgaagcttactcagtggttagggggttaatgaatgaaatggatcactggactgaaaataaaaatcactatttaaaacgaaggcgacaccaggagaattaggcactacataatactgtaaccacggagaattctcaacagtaaaataaagccctgtagtcccagcattttcattacttttccagtagtgctggatgcagtgtgaatttcaatgaggtgggaaacagtggctgctccctttaaagaacatataccacacagaggaaagaacatataccatataccacagagaggagaagcactccttcaattcacacagtgatgaacatattccacagagaggagaagcactccttcaatccacactgtgatgaacatataccacacagaggagaagcgctcctcaattcacactgtgatgaacatataccacacagaggagaagcactccttcaattcacacagtgatgaacatattccacacagaggagaagcactccttcaatccacactgtgatgaacatataccacacagaggagaagcactccttcaattcacacagtgatgaacatattccacacagaggagaagcactccttcaatccacactgtgatgaatatataccacacagagaagaagcgctccttcaattcacactgtgatgaacatataccacacaggggagaagcgctcctcaattcacactgtgatgaacatataccacacagaggagaagcactcctcaattcacactgtgatgaacatataccacacagaggagaagcactcctcaattcacactgtgatgaacatataccacgcagaggagaagcgctccttcaattcacactgtgatgaacatataccacacaggggagaagcactccttcaattcacactgtgatgaacatataccacacagaggagaagcactccttcaatccacactgtgatgaacatattccacacagaggagaaacgctccttcaattcacactgtgatgaacatataccacacagaggagaagcactccttcaattcacactgtgatgaacatataccacacagaggagaagcactccttcaatccacactgtgatgaatatataccacacagaggagaagcgctcctcaattcacactgtgatgaacatataccacacagaggagaagcgctccccaattcacactgtgatgaacatataccacacagaggagaagcactccccaattcacactgtgatgaacatataccacacagaggagaagcactccttcaatccacactgtgatgaacatataccacacagaggagaagcactcctcaattcacactgtgatgaacatataccacacagaggagaagcactccttcaatccacacagtgatgaacatataccacacagaggagaagcactcctcaattcacactgtgatgaacatataccacacagaggagaagcactcctcaattcacactgtgatgaacatataccacacagaggagaagcactccttcaattcacactgtgatgaacatataccacacagaggagaagcactcctcaattcacactgtgatgaacatataccacgcagaggagaaacgctccttcaattcacactgtgatgaacatataccacacagaggagaagcactccttcaatccacacagtgatgaacatataccacacagaggagaagcactcctcaattcacactgtgatgaacatataccacgcagaggagaaacgctccttcaattcacactgtgatgaacatataccacacagaggagaagcactccttcaattcacactgtgatgaacatataccacacagaggagaagcactccttcaatccacactgtgatgaacatataccacacagaggagaagcactccttcaattcacactgtgatgaacatataccacacagaggagaagcactccttcaatccacactgtgatgaatatataccacacagaggagaagcactcctcaattcacactgtgatgaacatataccacacagaggagaagcgctccttcaattcacactgtgatgaacatataccacacagaggagaagcactcctcaattcacactgtgatgaacatacaccagaggagaagtgctccttccactcacactgtgatgaacatgtaccacatggaggagaagcactccttcagttcatactgtgatgaacatataccacacagaggagaagcacttcttccattcacactgtgatgaacatataccatgcagagaagtactccttccgttaacaccatgatgactatatactgtacagagaagcactccttcagttcacactgtgatgaatatacaccgtatagaggagaagcactccttcaattcacactgtgatgaatatataccgtataggggagaagcactccttcaattcacactgtgatggctattggcctatccatgccactatgtagtttacattttagtatcttaaaatatttcatataatagaatattgcatttaacttgcaagaaaggctaaacacctagcataacaaaccatggtgcactgtaaatgttaatttaaaaataatatatacaaatcagttacagcttagacaagaaacctctttgactacacaatttggaactagaattatatattatatttaaatgtatctctttaaaccaattcaaaagcaacatagagagactaaaacctgtactgaagaaggaaaatcaggtcattacccatgagattgcttcagttcaaaaagagaaagcaggagtaggtgtgaaaatgcacagattactgaaaagtggaatgtggcgttaaatcaaatcttacaacatggaatcacgttttactttgcattaggttcctatgctcctagtatcaaaactaggaggtcctttgagctactaacttagtaaaaactaaaagtcaaacatttcactaatagacctgcctctaagtataaggttgaggcagaagatatacaatcatagaagaaaagacaggagttaataccgctttccccactgtaactggaaagtgtcataaatcctacattagtttctcacctaacctccctatatttagtcattccagtgccccaaaattgaagaattagtctcaatttctactggaatataaataacacatcagcttctagccagataattacgtccttcctgaatatgttgcaaaagtgttattcattgtggagaatgcagaattataaaatacaacccgactctcaaattacttataatctggttaggaatacctaactataaaaataaacacagttgtgggtctcagctgggcaacagtcaggctctgcaggatgtctagatagacaggtaggtagacagacaaaaagacatgtatggtgagccacctccagctcacaggcagtatcagactcacagtagtaccaactcaaaacagaccttcccctccgcagcattccgcatgccccacattatgctagaacctctatttgaatttttcttctagagcaaattcctagcctctcctctaggaaggggagggctggggaaagagcccttggggtcttttcaaggggttcactgaccctacaagctctaagctctctctacagctgtgctgtccaatatggaaatcatgagccactgagtggctactgggcacttgaaatatggctagtgcaactgagaaactgaattttttatttaatttaatgaacttaaacagccacatatggctaatgactacaatactagaaacaagatataaaacatttccatcatcacagaaagcactactctacagagtaaagacttattataattggatatatacattcctgaaaaatgtggtatataaaatattataacttgagggctcataaggcagaacactcaaactctatacagtattataaccaaatccctaaaaagtaagaatcccaacttttaaaactagcgtgatttttaaaagacatttaattcttaataaagaaatattatgataaataagtatacatttaattatttatttatggataaatgaatgaatgaaatgaatgacagggtctcacaatgttgccgaggctggcatgccgtggcgcaataatagctcactgcagcctcaacctcctgggctcaggcaatcctcccgcctcagcctcccagtagctgggattatagacacatcccaccacacctggctaactttttttatttaattaattaatttatttattttttgagatggagtctcactctgtcgcccaggctggagtgcagtggtgcgatctcggctcactgcaagctctgcctcctgggttcacgccattctcctgcctcagcctcctgagcagctgggactacagaggcctgccaccacgcctggttaattttttgtatttttagtagagacagggtttcactgtgttagccaggatggtctcgatctcctgacctcgtgatccacccacctcggcctcccaaagtttttttatttttctgcagaggcggcatctccctatgttgcccaggcttgtctcaaactctggggctaaagtgatctacccacctcagcctcccaaagtgctgggactacaggtgtgagccaccatgcccagccaaccatacatttaaaggttaaagtagcttgaaagaaggctgtaagaaaggtatctaaattctgaaaatgcacaaagactgggaatactatggccaaaccaagcgagagacaagaggtctcgggctcactgtttctccattcctccaccttgctgggctgtgctggcgtttactgcactttgggtttagctgctaccacttgatgaagaaaaccattaatacatcaagaaaaaccacttaataaaccaaagagacgaccacattaactcaatagcatccccccacttgtcaattctatgtgaattaattcttgtcatagaaacatgagtaggcgcagaaaggacttcatttggcagacaggttctctgtgtgtgttccctcatactccccgatataactggtcgcagctccattcccatctcagtctatcaaaaaaactatgcctgctgctcaaggcttttctcaactgataccttccctttattaagcctttcctgaccatcgcctccaaccaagatatgaggaacacagacttttttctcctaaagatatttttactcacacttcacattaaatttaacacatacttatggttgttgttctattactgttattactagaggtagcttaggagggctgctggaaattcaagggggaaagctaaaacttcccagggctttgtaacatctcttcagactggattttagtcctaattctgccaccagcttcctggttaatctcagtaagtcactccctccccgtttctgggctttaaacaaactcatttttcaaaatatctttattattgtaacttttgaatgacattttaaaagtccctgtaaacctctagtatgcacagaactttaaaaagctgaagtgagaatagccttctagactttttgccacatgaatatatacaaacataaaagcattttacactgaattagaccatgccatccgtatcgtactgtgacttagtttactgtattcacttaaaacttgatttcagtacacaaagaaatctcctgcagttgttttacctgctgcattattagaaaaaaatataatttaacaatcccccattgattaaattaccctttaaatgtttaagcttttcttaaaactaggaaagtaatacatgcatttttttaagtattgaaaattttcctttccctaatacactctatcttgggtgataaaattttctaaagagtatcttctgttttttcatttttctcatagataccactggggtttctttctctttttttaagacaaggtctggctctgttgaccaggatgaagtgcagtggcacgatctcggctcactgcagcctcaacctcccgggctcaagcaatcctcacacctcagcctcctgagtagttgttttttgttgatgttcttgagatgggtatcattgtgttacccaggctgcactcgaactcctgagctcaagcaatctgcccgcctgagcttccgaaagtgctgtgattacaggagtgtgccaccacacctggccaggtttcaacgatgcattcctatatttacttcttgacttttgttacagcattattttacactgtcagtgattatttttaattcattaaattctattccataaatagatcccagtcctctgtgctttctcagttgatttttggagacagatagtcaacaggcagcattcacaatattataattatatatctattactcactgtagaactaagtattgtggaacagctccacaggggaggaaatgcaatcttatgccattcaacttctcctgtttgaaacaaaatatcccaagagtcaagcagatttcattttcgtttttttgcttttctttactttacctgcaattctttcttacatctcagattatcttctttcttggattcttctaccatttcattgcagaaactccttacatatattatttcatataagaagcctagataattagataaaaaatagcttatatccatgcatatttgagtatctttctatcactgccttcttacttaacaaatagttttggctacatgagatttttggttcaaagttattttctttgtttggtttttttttttttttttgagggaaattactttttacttcagtgcaatttactggagagacgaactgtgcaagtagagatgcctgatgagcgtcacacaacgttttcggtggatagtcacgacacttgagcccaccacgaaagcaacgggaggcagctgcaatattccagcaggacagtgtgtactacagtgagttttaagcagttatgattttttaaattatactttaagttctaaggtacatgtgcacaacgtgcaggtttgttacatatgtatacatgtgccatgttggtgtgctgcacccattaactcatcatttacattaggtatatgtcctaatgctatccctcccctctacccccaccccatgacaggccctggtgtgtgatgttccccaccctgtgtccaagtgttctcattgttcaattcccacctatgagtgagaacatgtggtgtttgattttctgtccttgcggtagtttgctaagaatgatggtttccagcttcatccatgtccctacaaaggacatgaactcatcattttttatggctgcatagtattccatggcgtatatgtgccacattttcttaatccagtctatggacacttgggttgattccaagtctttgctattgtgaatactgccgcaataaacatacgtgtgcatgtgtctttatagcagcatgatttatactcctttgggtatatacccagtaatgggatggctgggtcaaatagtatttctagttctagatccttgaggaatagtcacactgtcttccacaatggttgaactagtttacagtcccaccaacagtgtaaaagtgttcgtatttctccacatcttctccagcacctgttgtttcctgactttttaatgatcgccattctaactggtgtgagatggtatctcattgtggttttgatttgcatttctctgatggccagtgatgatgagcactttttatgtgtctgttggctgcataaatgtcttcttttgagaagcgtctgttcatatcctttgccaactttttgatgaggttgtttgatttttttttgtaaatttgtttaagttctttatagtttctggatatcagccctttgtcagatgagtagattgtaaaaattttctcccattctgtaggttgcctgttcactctgatagtaggttcttttgctatgcagaagctctttagtttaattcgaacccatttgtctactttggcttttgtttccattgcttttgctgttttagtcatgaagtccttgcccctccctaggtcctgaatggtattgcctaggttttcttctagggtttttgtggttttaggtctaacatttaagtctttaatccatcttgaattaatttttgtataaggtgtaaggaaaggatccagttttagctttctacatgtggctagtcacttttgccagcaacatttattaaatagggaatctttcccccatttcttgtttttgtcaggtgtgtcaaagatcagatggttgtagatgtgtggtattctttctgagggctctgttctgttccattgatctatatctctgttttggtaccaggaccatgctgttttggttactgtagccttgtagtatagtttgaagtcaggtagcatgatgcctccagctttgttcttttggcttaggattgtcttggcaataagggctcttttttggttccatatgaactttaaagtagttttttccaattctgtgaagaaagtcattggtagcttgatggcaatagcattgaatctacaaattaccttgggctgtatggccattttcatgatattgattcttcctatccatgagcatggaatgttcttccacttgtttgtgtcctcttttatttcattgagcagtggtttgtggttcgccttgaacaggtccttcacattccttgtaagttggattcctaggtattttattctctttgaagcaattttgaatgggagatcactcatgatttggctctctgtttgtctgttattggagtataagaatgcttgtgatttttgcacatcgattttgtatcctgagactttgctgaagttgcttatgagcttaaggagattttggactgagacaatggggttttctaaatatacactcatgtcatctgctaacagggacaatttgacttcctcttttcctaactgaataccctttctttctttctcctgcctgattgccctggccagaatttccaacactatgttgaacaggagtggtgagagagggcatccctgtcttgtgccagttttcaaagggaatgcttccagtttttgcccattcagtatgatactggctgtgggtttgtcataaacagttcttattatttagagatacgtcacatcaatgcctagtttattgagaatttttagcatgaagggctgatgaattttgtcgaaggccttttctgcatctattgagataatcatatggcttttgcctttggttctgtttatatgatggattatgtttattgatttgcgtatgttgaaccagccttgcatcccagggatgaagccaacttgatcgtagtggataagctttttgatgtgctgctggattcggtttgccagtattttattgaggatttctgcatcaatattcatcatggatattggtctaaaattatcttttttttgttgtgtctctgccaggctttggtatcaggatgatgatggcctcataaaatgagttagggaggattccctctttttctattgattggaatagtttcagaaggaatggtaacagctcctctttgtacctctggtagaattcagctgtgaatccatctggtcctgaacttttttggttggtaagctattaattattgcctcaatttcagagcctgttattggtctattcagagattcaacttcttcctggtttagtcttgggagagtgtatctgtcgaggaatttatccattttttctagattttctagtttatttgcatagaggtgtttatagtattctctgatggtagtttgcatttctgtggggtcagtggtgataccccctttatcattttttattgcatctatttgattcttctctctattcttcattagtcttgctagcggtctatcaattttgttgatctttccaaaaaaccggctcctggattcattgatttttgaagggttttttttgtgtctctatttccttcagttcttctctgatcttagttatttcttgccttctgctagcttttgaatgtgtttgctcttgcttctctagttcttttaattgtgatgttagggtgtcaattttagatctttcctgctttctcttgtgggcacttaatgctctaaatttccctctacacactgctttaaatgtgtcccagagattctggcatgttgtgtcttcgttctcatcagtttcaaagaacatctttatttctgccttcatttcgttatgtacccagtagtcattcaggaacaggttgttcagtttccatgtagttgagcggttttgagtgagtttcttaatcctgagttctaatttgattgcactatggtctgagagacagtttgttataatttatgttcttttatatttgctgaggagtgctttactgagaccatcgatgctaggaagaaactgcatcaactaatgagcaaaataaccagctaacatcataatgacaggatcaaattcacacataacaatattaaccttaaatgtaaatgggctaaatgctccaattaaaagacacagactggcaaattggataaagagtcaagacccatcagtgtgctgtatttaggagacctatctcatgtacagagagacatacataggctcaaaataaagatatggaggaagatctaccaagcaaatggaaaacaaaaaaaaagcaggggttgcaatcctagtctctgataaaacagactttaaagcaacaaagatcaaaagagacaaagaaggccattacataatggtaaagggatcagttcaacaagaagagctaactatcctaaatatatatatgcacccaatacagaagcacccagattaataaagtaagtccttagagacctacaaagagacttagactcccacacaataataatgggagacattaacgccccactgtcaacattagacagatcaatgagacagaaagttaacaaacatatccaggacttgaactcagctctgcaccaagtggacctaatagacatctacagaactctgcaccccaaatcaacagaatatacattcttctcagcaccacatcgcacttattcaaagttatttatctttcagaactttgaaagtactgttccgtgatcttctagaattaaatgctgcatatgagaaatgtgattttagtccagttcctgcatgttttgtcacttattttttccctctaggggaatatgttggtatatatatattttctatggagttctaaaattttactaggaataattgagtttttgacttttttaaatcatgtgattcaacacatagtgagccctttctatctgaagaattataaggcttttttcagctttgtgaataatgtttttatcatttcattgactatttccacccctctatcttaactatcacctgcctctggaaatcctattagaaagacgttggtcttcacagatcttaacccccaagtttctaatttcccaaattatccattaatcagttatactgtacattatatatatgaatattctgggaggtttcctgaactttcctttcaaaaatcagtctttggctaaatctattctatttgttggcccatatatcaaatgttttgttatgaaatcattctaattcttggaaagagttttaactatttcaagattattttgaatcttactttgaaagtttggtgtagaaagaattcttacttgatggactaagaacacaagagattgagagttaagattagaaagaaataacattctacacgttttgtaaaaggtggggattttttccttatttttaaaaaatgaataaaagccaaccaatctttgttgggcatggtggcaaatgtctatagtcccagctacttgggagacatatatgtgtatatacatatatatacacgtatatatgtacatatatgtgtatatatatattttaacatgggactcatatatatatatgagttaaaaaaacattttatttcattaatatctcttgtacatgggaaactgtcacaaagcagtttcttctctttttactatactctaaacatagactatatataaaagaggttagctatagttcctgagtcagctactcatcactcatttcccacacctaaaagaggccaaggacacttaaatgtaaattcattgtacttttcacctttttgagtgaccccattttataggtatcttggggctagctatttgcacatcagacttttccattctgaaatgctgactcaattcactagagagaaggattctacttgtgagtgtggaaaaaaaaaatcctgactttctagatcattttccctattcactttggataataccactttataaataggatttgatgcatgcaaagcagcaatctgaaaggaccggcagtatatactataagcacttattatagtatttgtaaatgccttattaatggcaaaatagctttgaaaccatccatgatatgtaccacagctaactcaatttgacagtgaaagatgctatgtcagtctgttatggcagatataaaacatgtaccatatgagtagatccttggcatatgttataaaaattacttttgctttatattttctagttgtgtaaaaagggacaagaagcactcctaacactgttttcattggactcttccacactgccttctgttgcctactataaacagttaaatatatcttcttttactatctggctacagcagttttctgtatataaaaatttttccactctactatgaattgggtttatatggactccatctaaacattattcatgaactattctgaatacataccaaatgataccccagtgatcttcaaaacgctgaagtttcaattttctttaattctgctatcaggccaggcaaagcattcatctcagtgaggcagcctgcctcttaggcatcattaatgttttagattttcataaattccactacggctaaatagaccaagaacctgaactccatagagttcctaaaagaattcagcagctactgcctttttttttttttttttttttagttttatttccaagatgaagtttaaaaataagaataaaaactggcaacaggccagacatggtggctgaggcgagcggatcacttgagcccaggagttgcagaccagcctggacaacatggcaagaccctgtctctagtaaaaacacaaacattagctaagtgtggtggcacatgcctgtaatcccagctattcaggaggctgaggcacgagaatctcttgaacctgggaagcagaggctgcagtcagccaagatcgtgccactgtactctagcctgggtgacagaacgagactctgtctccaaaaacaaacaaacaaaaaacagaaatactgggaataaaagtatttttgaaacatgtagatcctcttttattaagaaagaggcagacatctcacacttaggaaaatctcaacccttaaagagagaaatgaaatagaaattttacaaatcaaaacaaaagtaaaaaaaaatcaaaaataacagatttttatctaagaaattaaaatttcagatttaacgtggaaaatatctgaaaaatgttgtgattatgaataagccttatgacatttctgcatcacttcctgacttatagacctatttctctaaattgatattcattctacaccaatgaaccactaaaggccttgttcatcaagattccagaggtgatttctattcatattttgctatgaatacaccaaactgtatgaaaagttagtttttttccatttctgtaaatataagtttaataaaatacaaccacagataacacaccaggccaatgtctcagtcaattaccaacttagccatgttttcctatccaaaaaattcatttgtttttggtgacagtggtgatgaaatcatttatttacttatttttcatttggttttcatgaaatacttgttccagtttgttccatgtaggttttgagaaagattacagtattttgttgttctaataaactgagacattcagttctatcagacaacgatcttacttttattctagctgccagaaaagtcacagctaaagttgacattcaattatggtggctttctttagttaaaaaaattaataaaacgttcttctcttcccctttactacctaacttttgcctttgttcttacggtatgatccttgatcttactgtatctgtagttttattttaagtaagaagtgaggactctggacattgctctagttgttcaaatgagattctatgtggattgtaaaaatatatttttctactggaaagtaagtctatttgagtagctagggctcctgttgtaatagaaagggtaccaatcccaagtaatatgatttctaaaatgaagtcattatcataagtggagtatattatttcaagtgagtaaaacttttgaagagtgaattgttcatattctgggttatgtatgcatttgttacggtcaaggaagcttgaagcttcaaattcataaataaattacatcaaatgcaataagaataccacctactggacactttataatatgcattaatagtatatttatgactttatttaatttctaaaatggccctatgaagttatttttagaattttcattttacctatgtggaaactgagccacatagaagatgcccaaataacagtatttctgcagaaatcaaaacccaatttgcctgactctaacatttacactatatatattttatacatatatactatatatatatgtaacacatatattacactgtttaatataattacagtctcacatagggatgaattcgattattcagataattaaaatgttttttaaaagaaaataatattcagcatatttcttcgttagttatatgttaaaatacgaagatacacatcaaactactaaatcaactaagactaaatgctcttttgtatataactcccttattagacctgaatgttacagaattgtaaacttaatttggcagctgatctgaatccaggtcgctactctgtagtcagctgtgttgtatgactctgcactgagacccagaggaaccacaatgaaaaattagctgctcagtataacgaattgccagatgctggactcaagtaggtaatgacatttgaaagcatgtgtgcaagtacagaagaaaattctgaggtcccagatctcaaattttatgtgttataagcaaaatgctaaaatctcaagttccatttttaaaaattaattaaataattatttataacgtgtgtctaggcaaccacacattcaacagactaccaggacagattttgcctctagcactgtggtttaagaaagagaaggataactctctctctctctctctctctatatatatatatatatatattttttaacatgggactcatatatatatatatacacacgagttaaaaacattttatttcattaatatctcttgtgcgtgggaaactgtcacaaagcagtttcttctcttttttccgcactctgaacatagactatatataagagaggctagctgcggctcctgagtcagctactcatcactcatttcccacacctaaaagaggcctttttgtttggcaaaatgcttcccaaagtaaatagaaacgacagttaacactttttattttctagctaagagtcacctattgccttcaaaaaaataaattcttctagtagattacagaatttgctttgaaaaattttggtagacttttatccttaaaaaatccaggtagcaagagaacctggataagtactgcctggattagcgagcggttatgagcaaacgctatctgagaagtaagttttcatgagtgatgagaacataccctttcctgcttcgctgtccctcaccatcaaaatccctctcaccaccttgctgaaaccaaccgttgcagagattcattctattgatgtaaggttgggtctcaactgaaatagttaacaggcagagagcatatctcttttgaaactgtatttggagtaaaaggttcggatactgagccactgataaggtgtttggaggaaattgtttcataaaactgaaaagcaaccgtaagaaaataaggttggagccaatatgacaagaactgatgatgtaacgattctgcccagaatgttctgaccatgtcatcaaatcatgccctctaagcaatacaagacacacaagagaagtcttcacaaaacacacgctgggctctcacacactcattttcggattttgaagggatttcacaagatttcaaatctgcccagatcatctcaaaattgttcatttctaaacttgaaatgtctcccaacagagactttttggaaagtaatttgggcaggtcgtttgttcccattatcaattaccggtcagtatgtaagtagctctcttcccatgtcaaagctgcccctggccttcctcttgctcatgctctaattgtgttattagtcaggctccaaagtctgagtgtagctccatctaccacaccctctgggccagttatgcaaaagctctctgactttcctttttttttttttttttttttttgagatggagtctcgctctgtcgcccaggctggagtgcagtggtgcaatcttggctcactgcaagctctgtctcccgggttcacgccattgtcctgcctcagcctcccgagtagctgggaccacaggcgcccgccaccatgcccggctaatttttttttttttttttttttgtatttttactagagatggggtttcatcgtgttagccaggatggtctcaatctcctgacctcgtgacccgcgcgcctcagcctcccaaagtgctgggattacaggcatgagccaccgtgcccagccgctctctgacttcttttacctaattcacagtatttctctgagggtcaaataagatcaagaacaagatgcgaaaactacaaagtgcattttaaaataggtgattactgggatttttttttagtatttgatttttttatagtatgatcattgctttttgtttcttcatttgtttttgagacacagtctcactctgtcacccaggctggagcaaagtggtgcgatctctggctcattgcctcccaggtttaagtgattctcccgcctcagccttccaagtagctgggagtacaggcgcctgccaccacacctggctaatttttgtatttttagtagagacagggtttcaccatgttggccaggctggtcttgaactcctgaccttaagtgatccgcccacctcagcctcccaaagtgctgggattacaggcatgagccaccgtacctggcctgattattgatactccacacaaaacacagaaaatacaacacaaatatggaaactattaaacaattatttcaggttttaattcacaaaaatgcacccagtatggatcctagttttttgttttttttgtatttttttttgtaatttcctaaatgtactgggataaaatatttctgaaaaaataagctctataaaaattttcaattaaggttatatttgatcatcatagtagtacagcccaacaaaacagttttacctaaagtaacatgaaaaatataatttctgtttcacccttaaaaaatgtgtgtttgtatttatgtacttccaaaactttttcttatcaactaataagatcaggtcacgttaagtctattgatctcacctttcactgtaatatctgctttggcaactgttccttagatacaatgttctccaaactcaaaagttatttccccactggataggtgattttgtactgtttatattaaactttatctcttttcttctaagagcagctcccccaggtagtcaagtctgttccatgttagcttactttcaaattaagtcaccttctggcatgacacaattatagagcacattaataactgcaggcacctgcagaataaattcaaacgcattcctttccctccccctctcttgatatatacctgcaaaactgtctaaaaattctataaaatctaaaactcaaaaatggtcttctctatattcctgtgttcctccttactgatactaggttctaatactctgtcttctaaaacctggcaacactatctaatctattctcaccctgtgatgactgtgactgctgaaacctcattttcatagtccaacattcaaatcttcaattgttgcttgacaaactcagttatcatggaatagctacctgaagaaaacagctgaattcagtacactattttcagtgactgcaaaactataatacacaatacagatatttttcacataaactaggtgtaaaaatacaatgttcacacttcatatgagaatattttatttctagaaataaatcttcaccagtccaaacacgtaagtttacagaaagtcagtaagaaatcattatatttatatagcaccttgaccactacaaaagctgctcactgataatatcagaaataatcaataggcttataacactgccaaaatggtagcagagtatcgtgtgtctattgagtctgaaattaaattgcaatttaaggtccatctcttaaagctatattcatgtatttagaactctatcaaacaaaacaagaaaaaaattactttgacgtacatcttttaaagatgaatatgaaactttggacaataaatactactctcccgaatcaacttttaaagtgcaaccatcttttaatgatagttaactgctttaagaaagcaataaactaaaatgtaaacctgaaagcccactatcttaagctcttttaaaaattaaatacaccagcaacattttgagactcaaaattaatttacttcactcaatcctatgcataagtttggcaatttgtttcagatgctattttttctgtaatttttgtgggtacatagtaggtgtatatatttatgggctatataagatgttttgatacaggcatgtaatgtgaaacaagcacatcaacaagaatggggtatccatcccctaaaacatttgtcctttgggctacatgtcatttcctaatgtaaagaaaatggacagacagaaccaacattgatttgactgggtgaaaaagtccatttgagttgggagcaggggttgtgttcctggatttgggttgttaggacagtataaaaaggcttcacaggggaacattcttttctgataaaggaaagcagctgggttggcttcaaatagcagtgactttacttggaatattcacaggtaagctgcaaatataaaacaccttccacagagtgttattttgtaatcggggcttatctcaagtgcaagaacctccagcctacagctttagtaggtgcctcagacactgtgcccggctttagtaggtgcctcggacactgtgcccggctttagtaggtgcctcggacactgtgcccggctttagtaggtgccgcggacactgcgcccggctttagtaggtgccgcggacactgtgcccggctttagtaggtgccgcggacactgtgcccggctttagtaggtgccgcggacactgtgcccggctttagtaggtgccgcggacactgtgcccggctttagtaggtgcctcggacactgtgcccggctttagtaggtgccgcggacactgtgcccggctttagtaggtgcctcggacactgtgcccggctttagtaggtgccgcggacactgtgcccggctttagtaggtgccgcggacactgtgcccggctttagtaggtgccgcggacactgtgcccggctttagtaggtgcctcggacactgtgcccggctttagtacgtgcctcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgccgcggacactgcgcccggctttagtaggtgcctcggacactgtgcccggctttagtaggtgcctcaaacactgtgcccacgtactctgaatggcgtatacacaatgataataaaagataacacagtgtttgctaagtgccaggtacaactacaggtaccgtaccagatagaaactgttattataaccatttgacagataaaaacactaaagcacacggagatgagtgaatttgcccaaggtcacatagacagtaagcagtatgaagaaacatatgtataactgcactgactctaaaatattataaatttattctgttaaaggtttctgtttaaaaaaaaatccatgtatttattaaaagtagcttttttctcagattcacttatagcaagactttattacatattaacttatcactgggtacaaaccacctggttctaaagacgtctgtcctgattactgtagggactgttatatatgaggcagaggcatcttttcattattattatttcccaaaacctatagaatttgtgtatagcagttatagactatgtctgaaatagttatattcacataacacttaataatcacatttaagtattcactaacagaacaaagcctgttactatggtaaataaatacacacagttctatcacagagcacagaagtcatcaaacagataatattttcttcattacacactgaaacttgtgacccgctaacagcataaaataatgtttaatatttaataccatgtgatggcaatactcaaccaaacatgtatttcaaatgatatgttatttgacatttcaatttcagctcaaaagtacttctaaaaaggatgaaaatatgtgcctgaaactgatagtttgaatttaataaatttttctgggattgttgtgttttgaactttaattttagaaccaagggggtacatgcgcaggtttgttaccagggtatattacatgatgctgaggtttggggtacaaatgagcccatcacccaggtagtgaacacagtttccaccagttaggttttcaacccttgctccctccctccaacctcgagcagtcctcagtttctgctgttgccatctttatgtccatgagtacccaatgtttagctcccacttctaagtgagaacatgcggtattggttttttgttcccgtattaattcacttagaataatgacctccagctgcatccaggttgctgcaaaggacatgattttgttctttcttaaggccacattgtattctgtggtgtatatgtaccacattttcttcatccagtctactgttgctaggcacctaggatgataccacatctctgctattgtgaatagtgcagcaatgattcttccaatccatgagcatggaatgtctttctacttgtttgcgtcatttctgatttctttcagcagtgttttctagttcttgtaaaaatgttttacttccttggttggatgtattcctaggtgttgtaggtgtgtatatctactgcaaatgagactggattcattatttggctctcagcttgaacgttattggtgcatagaaacgctattgatttctgcacacagcgatgaacatgcaactatatgtctttttggtagaattatttgttctcttttggatatgtatccattaatgggactgctggatcgaatggtagttctgctttaagctccttgagaaacctccaatggcgttccacagtggctgaactaggtttatattcccatccacataagtactcccttttctctttttctctgctgcctcaccaaaatctgttgttttttacttcttaataataggcattctattaaaaaaactttgtcagatgtgtagtttgccaacattttctctcattctgtagactgtacactctgttgatagtttcttttgatgtgcagaagttctttggtttaattaggtcccaccagtcaatttttacttttgttgcaactgcttttaaggacttagccataaattatttgccaaagtctatgtccagaatggtgtttcctagcttcttatagtttcagatcttaaacttaaatcttttccccatcttgagttaatttttatataagatgaaaggtaagggtccagttccattcttctgcctatggctggcaagttgccccagcaccatttattgacagggagtcctttcctcattgcttatttttgtctactttatcaaagatcagatggctgtaggtgtatggctttattttggggttctccactctgttccactggtctatgtgtctgtttttgtaccaggaccatgctgttttggttattgtacccttatagtatagtttgaagtcaggtaatgtgatgcctctggctttgggctttttgcttaggattgctttggctacttggactcttttttggttctatgttaattttagcatacttccaattctgtgaaaaatgacactggtagtttcataggaatagtgttgaatctgtagactgctatgggcagaatggccattttagtgatattgattcttccaatccatgagcatggaatgtctttccacttgtttgtgtcatttctgatttctttcagcagtgttttctaatccttgtaaaaatgttttacttccttggttagatgtattcctaggtgttgtgcatgtgtatctctactgcaaatgagactggattcattatttggctctcagtttgaacgttattggtgtataaaaacgttactgatttctgcacacttattttgcatctgaaactttactgaagtcattgatcagtttcaggagccttttggtggagtctttgggactttacaggtatataatcatatcacttgcaaagagaaatagtttcacttcttcttttcctaattggatgccttttctttttttcacttgactgactgctccagctagcacttccaggactatgttgaataggagtggtaagagtgggcttccttgtcttgttccagttctcagggagaatgctcccagtttttgtccattcaggataatgttggctatgggtttgtcatagatggatcttattattttgatggatcttattatttgatggatcttattataataataattattattattattattttccttcaatgcctggtttcttgagggtttttatcatgaggggatttggggttttgtgaaaagctttctctgcatccattggggatgatcatatggtctttatttttaatactgtttatgtggtgaatcacacgttttgatttgcatatattgaatcaactttcatcccaggaatcaagcctacttgatcatggtaataaagtttttgatgtgctgttttatttggtttactagcatgttgttgtagatttttgggtttatactcatgagggatattggcttgtcattttcttttttgttattgtgtcttcaccaggttttggtatggaggtaacactggcttggtatagtttcaaaattggtagcagctcctatttgtacaatacatctggcagaatctggcagcgaatccatttgtctggggcattttttttttttttttctagttggtaggttttaaattactgattcaatgtcagaactcaatactgttctcttcagggtttcaatttcttcctgactcaatcttaagagattgtgtgtgtattagtcagggttctcttagagggacataactaataagatagatagatagatagatagatagatagatagatagatagatagatagatagatagatacacacacacatacatacatacatagatacatagatagatacatagatataaacgggagtttgttaagtattaacttacatgattacaaggtcccacaataggctgcaagctgaggagcaaggagagccagttcaagttccaaaattgaagaatttggagtctgatggtcgagggcaggaagcatccagcatgggagaaagatgtgggctgggaggctaggcctgtctccctttttcatgattttctgcctgttttatattccctgagagctgattagatggtgcccaccagataagggtggatctgccttccccagcccactgactcaaatgttaatctcttttggcaacaccctcacagacacacccaggattaatgctttgtatccttcaatccaatcaagttcacacttagtattaaccatcacagtgtgtttccaggaattcatccatttcctctagattttctagtttgtgtgcatagaggtgttcataatagtctctgaggatcttttgtgtttctgtgggatcggttgtaatgtcacttttgtcacttctaattgtgcttatttgaacttcttttttgttaatctagctaatggtctatcaatcttgtgtatcctttcaaataaccaatttttagttttgttgattatattaatttctgggtctcaatttcattcagctctgctcttattttagttatttctctttttctgctagctttgaaatgtttgttcttgtttttctagttcctttaggtgtagtattaaatcattaaattgggatctttctaacttcctgcggtaggtatttagcactataaaatttcctcttaacactacttttgctgcatcccagaggttttggtacctgtgcctctgttttcatttatttaaattttttttatttctgccttaatttcattgtttacacaaaagtcattcaggagcaagttgtataatttccatgtaactgtggttttgagtcctttaaggtactgatttctatttttattccactgtggtcttagaatatggttgctatgatttagattttttcaaatttattgaaacttgctttatggctgaacatgtggtcaatcctggagtatgttccaggtgcagatgagaagaatgtatgttctgtggttgatgagtgaagtgttctgtagatgcctattaagtccaattggtcaagtgtttactttaagtccagaatttctttgttcgttttctgcctcagtgatctaatagtgacagtggggtgttgaatttccccactattattgtgtggttgtctaagtcttttcctaggtcttgttttatcaatgtggctactccaatattgggtacatatatatttaggacaattaaatcctcttgttgaattgaatcctctatcattatgtaatgcctttctttgtccttttttactgttgttggtttaaagtttgttttatctgatgtaagaatagcaagccctgctcttttttgttattcattactttgagcctgtaggtgttgttacctgtgagatgggtcacttgaagacagcagatgactgggtcttgttgttttatcaaacttgctactctgtgccctttaagtagactgtttagaccatttacaatcaaggttaatattcacatttgaggttttgaccctatcatgaaattgttagctggtggctttgtagtttctattatgcggttgctttatagggtctgtgggctatgtgcttaaggtgcttttgtggcagcagctgtttccatatttagaacttgatatggtttggatctgtgtccccaaaaactctcatgttaaattgtaatctccagtgttggaagtgggactgggtgggagggaggtgtcacaccacccttccctctcctgcttctgccttgtaagacggctgcccctcctttacctactggcatgagtaaaagttccttgaggcctctccaaaagtagatgctgccatgcttcctgtatagcttgcagaaccataagtcaattgaacttttcttataaattacccagtctcaggtatttcttttcttttttcgagacagagtctcactttgtcacccaggctagagtgcagtggtgcgatcttggctcactgcaacctctgcctcctgggttcaagcaattctcctgcctcagcctcccgagtagctgggattacaggtgtgcaccaccacgcctggctaatttttgtatttttagtagagatggggttttaccatgttggtcaggctggtctcaaactcctgacctcgtgatccgcccacctcggcctcccaaagtgctgggattacaggagtgagccaccatgcctggcctcacgtatttctttacagcaatgcaagagcacactaatacagaacacctttaaggaactcttgtgaggctggtctagtggtaacaaattcccttagtgcttgcttgtctggaaaaaaattttatttcttcttcatttatgaagcttcatttgacaggacatgaaactcttggttgcaatttcttttctttaaaaatgctgaaaatagcccccccaactcactttgcttgtaaagtttctgctgataagtctgctgttggcctgatagggctcctgttgtacaaaatctgacctttttctctagctgcctttaagatatttttctttagcaccgaccttgaacagtttggtgactatatgacttagtgatgttcattttgtatagtatctcacaggtgttctcaggatttcttgtaactggatgtctacctctctagcaagcttagggaaattttctttaattcctcaaatttgttttccaggttgcttatttttttccttctctctcagtaatgccaataatttgtagttttggtcactttacataatcccatatttctcaaagactgtttattttattaaattattttttcttcctttttgtctgactgggttaattcaaaagactgatcttcaagttctgaaattctttcttctacttggtccaaaccattaataaaactttgaattgtatttttaaatttcttaagtgagtttttcaattccagaactggttgatttctttttaagatatttatctcttccttcattccctggatagctttagaagcttctttgtgctgattttcagtcttgtcttggatctcattgagcttccttgcaattcatgctttgaattacttatctgtcatatctgagtttccattttggttaggaaccatttctggaaagcttgtgcaatcctttggtggtgttactacattcagatttttaatggtgccagtaatcttgtgctgattctttctcagctgaagatgctagcacttctaatttttgtaattattttcatgtaggtaggatgtttctttctcttttcttcctctataatgttactgggttttttttccttctctttccctttcccctgcttcctatgggtatgactacagattattttgggtaagatctatttgttttgcttctatctttgctctgcctttggttttgtttctaccagttcttctggtaggttttgtatcaggctgtgcagttcaatctacatgccagtagatgatgcttataggtaagagccagttgcagccaatgtagctggatacttgatccttgtttactggcagaagttctctgttgcctcagacaatgggctgatacatagaatgcatagtggtctgagctccctgctcagccccaagggcatggggccagactggtcaggtccacctaaaggtcccctgatacaggcacaagcaccagcactgacagagaatccaatgggtggctaccaagcacccagaggtatgcctaggcatggagctcctcagtatcaagttctctgcacaggaatgggaaacctcttcagcatcaacttctctacacaggaatgggggatgccctaaactccaaatccagaagagctctgcctaggtgtgtagtatagtgggctccccctgaaccaagatctctgcataaaaggggtagggtgactcgaactgctgaaccaggcaagcaggtgttctgaatacctggagatctgtctgggcatggagcagagagagtccccctatatgaggatctctgcacgggaaggatggagcagctcgggctactgacccaagtaagcttgtgctccaaatgcctgcagacctgcctgggcttagagcagagagggtcccactgtcccacaggaagagttgcgtggctcaggctgctgaaccagataagcaggtgctccaaatgcctggagatctgcctaggtgtaaagcagaaagggcctccctacaccaggatcttttttatccaccagacactgtcgcagaggttgtttgccagtgttctgctcaccaggatctgggtgtccctcacgattccagtggattcccattttccttttgttgttgttgttgttgttgttttttgtttgtttgtttcttttttgagacagagtcttgttctatcaccaggctggagtgcaatggcccgaccttggctcactgcaacctctgcctcccaagttcaagcgattctcctgcctcagcctcctgagtagctgggcctacagagctaatttttctatttttagtagagatggggtttcaccatgttggccaggatggtctcgatctcttgacctcgtgatccacccgcctcagcctcccaaagtgctagattaccaggcgtgagccactgcgcccagccccattttccttcttgaaaaaaagctcatacagtttatcttcatgcactatctagccatttccaagtggctgaggcatgctacaagcctcttatctgccatcttagagaaacaatctgcactttataaatggacaggtaaatctttgttgagagagaaaaaataaaggaaacagcttgtagagtgacccaagtacagtcctgaagctgctctcaaggaaagtaagaaaaatagcagcccaaaccctccccttagaaggaaggcttttcccacagagtctcgccttctggctggaagtcatctctttctgggttttgttgttgttgttgttgttgttgttgtttatttgagacggcgtctcactctgtcacccaggctggagtgcagtggcaccatctcagctcactgcaagctccgcctcctgggttcacaccattctccggcctcagcctcccaagtagctgggactacaggcgcccgccaccacgcctggctaattttttgtatttttagtagagctgggtttcaccgtgttagccaggatggtctcgatctcctgacctcaggatccaccctcctcagcctcccaaagtgctgggattacaagcatgagccaccgcacccagctctctttgttttttttttttaatgttaccttatagtcacagcattttatgctttaatgataattcacatttaattttagaaaacttttattttcttaaagatataatcgtttattatatttacatattgaatgttttcaatgacaataaatataggaaggtcatcaacaagacccatagaatttaaacaatcacacataaaataattggtgtagaagtcaaaattttttaaatggttagctcagaaaatacagaaagctcaagacacattactaaaacatgaactgaccttaacaaagaaaaacactgctttgtttctattatacttcaaaaaaaaacagtaataagaatttaaaaaaaaaatcagttctctgttgcatagaaggagaaatataccattttctctttctgtgaggaaaaagaggaaaatcatatttaaaacgaatgacattctgtacagatgggcataaacagcgccctctgtctcatgtacacacatccttttcttgtcactcagctttatttctggcaattcttaaatcggagaaaaaagttacaataaatctgtaagatccatattgtgtatagaagtaagtgaaaaataagctgttcaaattccaatacctactgatctccttctgtggccaaagtttctctgacatcattctgctgcttgtttattcttccatgctctcctattgttacagagggcaactaattttaaaaagtatttgacagtattaagcaataactttgtgccgattttctttttcacagaacagaattaaatttgagtgcagatgtgagtagatatagaagagtgtatgatatttttgtgtgtgtgttttctttgtagagtccaaaagccctgtggattgttagtgaagctcaggcagaataaagcaaatagaagaacaaggcaactgaagtctaacgatatggtggataagaatccgattttaaatcttgacattgcttgagaatgggaataatgtgttacttatttttcgcactatgactaacaattattaaacatctaatatgtaccaaacacagttctggacatattcccatatcttaactcgtttaatcttgacaacaatccttctgaggtaggttttattacccttcatttcagatgaggaaataaactcacagacattactaatttgggtgactcagacagacacagtttccattttgttcttcctttcagttaacatatatttcttatggactttctgcttgttccaggcactatgcttggcacagcgtctaccatttctctttctactaaaccatatagccggtctctgacacctagcacagtacctaggtcatattaggttctcaatgaagattcactgaattatttggttaatttacttgtctctataaaataaacatttacatagaaatttgggtccaggtttatattatcttaaaacatcttgtaattcaacactgttaaaacatgtattttaaaaatagtttttcaaaagagaaaatatttcattgattatagacatctaggaaacccaagtcaggtggcaaatacctgcactgaaaactaacagaatcatggaaaggaagcctgacacagcatgatgcacattctctcaactttgtatgtaaataaatcctacattctttaattgtctcaagaatgcgtgatttgaatacctaattctattacaaatatcacatgggaatggtcttccaatgttggtacatgtactcaaggcacaatgcatagtgttgaccaaaaagcaaaagcttaccatgaaaaaaggtaagtaatggatggattactttgtagtcagacatggataaggttgaatgttagctctgccatttactagctaccttattttgagggaagttatttcacttttctgaggctgtttctgtactataaaatacagataattctaacagcatctactgtgcactcagagattatggtgaggactaaatgacaggatgtatgtgacctgggcacatacccaggtcagagttagggctcattaacagttagctgtatattgaagtagaaaagttagggaggctgggaaataaattttctggtaggcatgaggtggagcagactacataatgatcaccttctttttactgtctaacctttaaagctccttagtatgcaggaaaatgcctgctcctgaatgagctgatcttcataccagcgtatttatctttcctaattcaaaaacagcctccttaaaacacaaacatactttttcatactgtcattcaaaatagctgcttatgatataacttaatagtaaaaatgggaaaattactgatttctttttgtacaattctatgtaccttcaacaaattatgccttttcattttcaaaggataataccaattccttccaaaggcatgatcaaacctaaatagtggttaatttgaacatttcttttaagtcccagaagaagaaattacgttaaccacttcttcatatcttaagtgaaaaatgtgtaagacagtaactgtcttaaataattacatttctgcttattaggtgtaattaatattttatccccaaattaagccaaaataattccttagatataagatgcctacacaaccaacaaatcaagcttttaatttctgagttctagccaaaaggccatattgcctaagaagagcagaaataaatgtttttttttttgttgcctttttaaaaactttgtaacctacatataaatagaaggaaactcagatttcgaatacagacttctgagggaaatcaaatgaatacaaaatttattgtatactaagcagtaactcttgtttattctatcacttgggactgtatattctttttaaattagtatatcaattgttctgaatataataattcaatacagtcatcttcctaagggtccattttaagcatcattcaaagcaagtagtagtaaaaaggaacaaagcataagccacagcagtgctaaaaatatggtaattgattaaaacaaaaacaattagctgggtgcaatggctcatacctataatcccagcattttgggaagccaaggtaggaggatggcttcagcccagaagttcacgaccagcctgggcaagatggtgagaccctgcatcttagaactgatgaaagacggtaacttttctatattttttcaatatgattttattctcacacatcaacaacattctaagatgtcttacaaagaatagcttttgtaatcccatggcctctaatgcaatacagtgctttatacacattctatgggaattgcaggtaccatctccatagcctaagagtatgcaatctgaaccaaatccttttctgtccacatcttgaagtgcttcttaaattcctaagatctaactagttacttctctattacctgttagtggctctgctatagaagaaaaggtgaaagtaaatatctacaaagaaagacagtggggatagtgacaacaataataaccactatttactaagtgctatgttctaaacactttacatggactttgttacttaatgtttgcaattctatgatgcatacagaatcagtcttattacgagatgaacaaatttagtttccaactgataattgtgaagaaataaaaaactacaggagagtgatttttaaatcaaaggtgcatatgaagagaagcatgctaatgaaataatcctgctagcttttcttttttgattttgtaaaatattaattgctcttgcactgttctttattgacaatggatcagactgaagcttctggtcagtgtatctttattatttttcgagacagggtctttctctgttgaccaggctggagtaccagggtgtgagcatagctcactgtaacctcaaacacctgggctcaagtgatcccacctcagcctcccaagtagctaggatgtgggagtatgccaacatacccagctaatttttgtattttttttttttgtaatagacagggtctcactttcttgtccatgcttgtcttgaactcctgacctcaagcaaacctccctccttggcctctcaaagtgctaggattataggcatgagccactatatccagttctgcttcgttttttttgttgttgttgtttgtttgtcttaagaaaaaattctcattttgtgaagtgtgagccaggagaaagagacaagaggctgactccagaaaaactgcagtcttcattcttaaaaagcacatctttcagggatgatagctattgggatattcacatgtcagcagctctcagtataaacaaaacaacaataaaaagtcagaaaatcagcaagaggaataaacatgtcagaaatattgtgggatccagtgaccatcacatgtcttaataatgagctcatcatccagcctgtatgagccttctcctgtgagagcatctttttgaaccaacggatcaacagaaaatactcccgcagtgcttgctttttaaagtaggattatatgaaagtaactgagaattactcccatctccttatattgacaatcttccagttaatgagaagatggattttctcctcaagctattgggtttgagaatcttctgttctgtgttagctaatctctcatgaatgtttttaacactgaaggtccttgtatttgctattacaaaaaagcaggtgcaactgagttccttccttagaattttgagctcgcaatcatttgttcaagatcccactaatctttttagttcttgtttgctgaacacctgattttaaaagggaaccccacaaatcccctttaaccactcttccatttgagtccatccttcatagtcatctactaaacattttgtttacaatgtatcaaaggttatgattcctaggaagtttggctttctttttttgtaaaaaacagggaaagaactctattgggaatgtcatgccctgtccatccatcccatctttttttaatcgggcaactttatattcatcctaccaggaccaactctaatgtccaaactgcgtgacagaattaacagttccttcctctgtattcctaaagtattttgttcacattattattattagagtattaatatattgagtatagaatgttttggtatgccgatagtgaagtcttattcatctttatatgttccaacggtacctggtacagagtagttactcagtaaaagtatgttgaataattttattaacgtgattccaaatccctaagtgataatcttatttaaggaaaatactataacactgaatactctctgaatagtctctgaaacagtaatgagaaatacaaaaatcagctgggcatggtggtgcacacctgtaatcccagctgctagggaggctgaggcaggagaattgcttaactgggacccgggaggtggaggttgcagtgagccgagattgcaccagtgcactccagccgaaagaaagacagaaagaaagagagaaagagagagagagaagagaaagatagagagagaaagaaagtaatgacagagaaaatactttttcgagtaaaacctcagaaaagaatatgatcccaagtaaaaaaaaaagtaaactgcgaaaataatatttttttccttttcttattcattttccacagcttcttaattctcttccattaaatcttattgaggcaattttatttatggatagttatatctagttttataagcctggcaaatatcttgccccaaagttacagaatatgtatctagtactggataatgcaaaattcactttgaaactttttattagaatatttgcttgcctaattaaagatggaatagagcaatattataataaatgtgcatagcctgaatacaaaggagctaagagataacggaatacatacatacttggccaaagaagacagaccacaattataaatatagcctagatatatacaaagcaaatggtcatgcattaacatattaattgaaggtgatgaactgaagttttatcaattaagaaaacactgcaagctatattctgggcccaattttaaaagtagaaaaaaaatggtattattttatggtttatgttatttatgtttattttatgttatttgattattcccagtccataggcacatccttaaaatttcatatgaacactttggggaaacattttaaagttttcatttgaacttactcctcgtcctcaaatgccagcaaactgttcctggtatatagaaaacagatcttatctaagaattcaccgtttacatgtgaaagcctttgcttagaattcctcctcctctcctgtctgcctgttgaaatcctgtcattctttaagggtcagacattgtgcttatatattgtcagaccacatcttctgagtctctcttgcagccccttcctggattacaactctaaggcagagactgcaccttaggtacgggagcatactgttgcatgctcaacaatatttgatgaattgaaagtaggcttttatcaattcataaacaaaatcaattattttaccaattccagctcatttcaacagatttctattcccaaagtctagggtcctttgtctttgttctgtcaatccctaaagaagcaagatcatttctgtcttttcctatgagcctgagagaggacaggcctcacacattcaccattcccaggtgtgcagtagtgtaaaaataattcacactgattccaaggtatcacttatcaattgggaattgtattgtcagaggcgtgtgaaccagaacaactccatcttgaacaggagctgggtaaaatgaagctgaggcctactgggctgcattcccagacaattaacgcattctaagtcacagcatgagatgggaggtcggcacaagataaaggtcataaagaccttgctgataaaacaggttgtaaagaagccggacaaatcagaccaaaagcaagatgtccatgagagtgacctctggtcgtcctcactgctacactcccaccagccccatgacagtttacaaatgccatggcaacatcaggaagttaccctatatgatctaaaaaggggaggcatgaataatccaccccttgtttagcatatcattaggaaataaccggccaggcgcagtggctcacgcctgtaaacccagcactttgggaggccaaggcaggcagatcacaaggtcaggagatccagaccatcctgaccaatatggtgaccccgtctctactaaaatacacaaaaaaaagacattagccgggcatggtggcacacacctgtagtcccagctacccgggaggctgaggcaggggaatagcttgaacctgggaggcggaggttgcagtcagccaagatctcgccactgcacaccagcctgagtgacagaacgagacaccatcaaaaaaagaaagaaaagagaagaggaaagaaaagaaaagaaaagaaagaaatgggcaaccagcagcccctagggctgctctgtctatggagtagccgttcttttattcctttactttcttaataaacttgctttcactgtgcaccatggactcgccctgaattctttctcgcgccagatccaagagccctcccttggggtcctgcaacactatcactgttaataaaatgatccaaacttcatcaccgttaacccaattaaccctaaagtagctgaagagtaaaaagttacaggttcccattactaaattagaatcagtaaagaataataagcacgtaactgaatctaattaataaataaaatctctcccttttccatcccactaaatgccagtaatcccactgtaatcccaccataccatctaaaatgtatgcttcaaggcccagggttaaggcccaactacatgaagcctcccagtttcctttgttttctctgaaactggctgataccaccctttccagatctcacactttagttagtagatcgactaacaacacagcaagagcctgtgttagtaactcaataaatactgaattgaacggcttctaagttatcactttataagaatgaatataatcttcttaacattatgacactgatattatgttctcatttttgacgttaggaaatggagggtcagaagattagctggtggtgatagaaccacgattagaatccttatctgtccaattcatactttcatactcttcccccatattccagtatgaccctggaatttattctgtcaaatattattgttttctttctgtttctttttttttcttttttttttttgtttttgttgttttgttttgttttgttttttgaggcaggctcttgttctgttgcccaggctacagtgcagtggtgcaatcacagctcaccgcaacctcaacctcccgagcccaagcaatcctcccacctcagccgtaagcagccgggactacaggcacatgccatcttgcctggctcattttaaaaaaaatcttttttgtagagaagctgtcttcctacgttgcccaggctggtctcaaactcttggactcaagtgatattcctgcctcagcctcccaaagtgctgggattccgggcgtgtaccaccacacccagcggtcaagtattattcctgagtgactttgtacatgaggtttaccttcccaagaaccatgttggttcctgaagaatgacctccaacaccagagacagagttttcaaattgaaatggtactcaagttggttaatttgaacagattgtctcttttgctaggtcattctcaattaagtcttggttgaataaattaataacattacgacaaacaaggattaacttcagaccctaccctcttaatccctgaaagaactggacattatagccctacccataggaagacagtgatagaattttctttaaaactatatataacatattatatgaattaacataattatttattcttgctaccatgcatttacatcaaaccattcatttctcaaggcatagatgcatccaaaatcctcctagattgaaactgttttcattttttattgcaataaaatatgcataaaaaatttactatcttaaccatagttaagtatacactttagtgttactaaatccattcataatgttgtgcaccatcaccaccatccatctctgtaactcttttcatcttgcagaactgaaactctaaattcattaaacagtaactccagttccctccttctttctagcctctggcaatcaccattctactttctggctctaagattttgactcctctaagtatctcataaaagtggagtcatatagtatttgtctttaatgtggctggcttatttcacttagcataatgtcctcaaggttcaaccatgttgtagcatgtgtcttcatttccctcctttttaatgctgaatgacattttatgatatgtatgtatgtaccacattttgttttcagataaatgacatgagggttgcttctacattttagtcattgtgaatagtgctgctatgaacactggcatacaaacatctctttgagatcctgctttcaattcttttgggtacatacacataaatggaattgctggatcatacagtaattctatttttaaatttttgagttgccgccatactgtttgccacagtggctatacagttttacacgtccacgcagtgcacaaggcttccaatttccccacatcctccccaacacttattttctggggttttttaaatagcagtcatcctaatttgtgtgaagtggtatctcactgtagttttgatttgcatttccgtcatgattagtgatgctaagcatcttttcatgtgcttattggcgtatcttctttggaaaaatgtctacttaagtcctttgcccattttaaaatcatgttgcttttctattgttgagttcttaattatatattttgatattgatccattatcagatataaggtttgcaaatatcttctcccatactctgggttaccttttaactgttgatactgtcttttgatgcaccaaattttttaaattttcataaagaacaatttgtttattttttttctttagctgcctgttcctttggtgtcattcccaagataccactgacaaatccaatgtcatgaagcttctgccctatgttttctaggagttttatagtttggggtcttacatttaggtctttgatccattttgagttgatttttgtatacaaacttagataaaggtccaacttcattcttttgcatatggatacccagttgtcctggcaccatttgttgaattgactgtgctttctccattgaagggtcttggcacccccatcgaaaatcatttgaccatataggtgaggttttacttctggactttcccgttgattccattggtctatatgtctgtctttatgccagtaacacactgttttggtcacagtagcttcttagcaaattttgaaatcagcacattgagtcatccagctatgttatttttcaagataactttagctatttggagtccctcaagattccatataaattttagatttttttttccttttctgcaaaaaaacatcattgcgattttgatagggaacgcattgaatctgtagaggcctttgggtaggtaatgacatcttaacaatattaaatcttccagttcacaaacatgggatatgtttccacttatttatgttgcctttaatttctttcagcaatgtttttctgcttttcattgttaagtttttaacctccttgttaattcctaagtattttattcttttggatggaattgtttttgtaatttccttttcagattgttcactgtttgtttgtgtataaaaatgcaacggatttttgtgtattcacgttgtgccccaatactttgtttaattcagttattagcattgatagttttttgtgggatctttaggattttctatctacaaggtcatatcatctatgaacagagataattttacctcttcctttccaatttgtgtgccttttatttctttttcttgcctaaatggtctagctagaacttcagtagtatgttgaatagaagtggtgaaaagcaggcatccttatctcatcctcaatcttaaaggaaaagcttttggtctttcaccagtaagatgttagctatgggtttttcatatatggcttttactatgttgaagtagtttctttttattccttatgtgttcagtgatttttgtcatgaaagggtattgaattttgtcaaaatgatttttctgcttcgattcagatgatcacgtggggtttttttccccctacaatctgtttatatgatatattacactgattgattttcacattttgaaccattcttgcagtctgggaataaatgccatttggtcatggtgtataatccttttaatatgctgctaaatttggtttgctagtattctgttgaaaatttttacatcagtgttcataagggatactggtttgtagttttcttttctcataatatctttgtctggctttggtaacagggtaatgttggcctcataataaaagcattaggaagtatttcttcctcttcaatactttggaaaagtttgagaaagattagtatcagcttctctataaatgtttggtagaattcacctgtgaagccctccaagtcagcttttctctgttgagagattattgattactgattcaatctcctaactaggtataggtccattcagattttcataatttttgtctttcacagttttttatatttccagaagtttgtccctttcatctagggtattcaatttgttgtcatacaactcttcctaatgccctcctataatcctttttcattctgtatgattcataataatgtccctgttttctttttttttttttttttcttttttttgggggggggacagagtcttgctctgtttcccaggctggagtgcagaggcacaacctcggctcactacagcctccgcctcccgggttcaagtgattctcctgcctcggcctcctgagcagctgggattacaggtgcccgccaccgtgcccagctaatttttgtatttttggtaaagacggggtttcaccatgttggccagactgatctgaaactcctgacctcaagtgacccacccacctcggcctcccaaagtgctgggattacaggcatgagccaccacgcccggcccagtaatgtccccattgtcattttttattttagcaattggaatcttcttttttcttagtccatctatctacaagtttgacaattttgttaatcttttcaagaacgcagcttttggtttcactaatctttttttttttttttttttttttttaaagacagagtgttggtcttgtcgcccaggtgggagtgcagtggcacgatctcggctcactgcaacctctgcctcccaggttcaagcgattctcctgcctcagcctcctgagtagctggaattactggtgcccactatcacaccctgctaatttttgtatttttagtagagacagggtttcaccatgttggccaggctggtctcgaactcctggcctcgtggtccaccggcctccttaagtgctgggattacaggcgtgaaccactgcgcccggccactaatctctcctattgctttcctattctctatttcagttaacactgttctaatctttattatttccttccttctgctagctttgcatttagttcttctttatctagttatttcactttaaagttaggaaactcactaattttggtattaacttctttatcagatattttagaattagacctatcgatcatgtcatactttcctcagattcataactgcatgatataataatcctgtgtattcgagtcaaaagacacagggactctaaagcaagttcttcatgctctgaaagcatattattctttccttttgtctttatgtgtcctagaagtcattagacacaaaacatggagtttcaaggttactgttagagaacatatcgtgagtctaatggttaattacttccatattatctaagttttacaaacctctgatgtattcttcctttggttttattgttccaagcttcacatctgggcttctcacaatgcctgatttttatagaaagaacacagtcatataataaaaaacactgatgtcagcacactgacattcaacccagtgttttatctggggctctgcttcaggccactgttgctgaatgctgtggactccattctccaagtgcacgtatttgttttgtgctttaaaatagctaaattattatatataactacaacatagaacttttaaaaattctgtaactcaggattttcacaattcaggttgagtccctctatccagtccaaattcatccaaattttactgactagccctcaaacctgagaaatagaaatgcctcctaacagacacaggccgtccgaaggtcaatcaaatcccatgggaatatgacaaaaagcacctttctctgacaagagagagccagtaattaaggtctcagccttgttcccctcatctctgcttggatcagaattcagtttttcaaataatgccctataaatgttaagccaaaaacataggcaacactctaccggggtcagtaccaggacaaagaacatcacattttatggaatctatctttacaatcgtatttttatgcaaaaaaactcaatgactactgtagctgggacacctcacagttgttcctgctacattcattttcatccttttgacttttataggcagattttttttgagaatttttaaaaattatatataaagacatttttaggaaatctgagctggtgtcctcctttcattccttagaaccagacaagaaggcaggaacagtgaagacaaaatacaatgcgcaagagcaggggcaggcaactgttttctgtaaagggcagccttcacaggccaaaccatctctaccgaaactactcagctctgctgctgtaacaatagacaagacatgatacatacaagaacggcatggctcattctggcacccaggcttatagtttgcctgctcctggccaacaacaaagatatggagtctgatgcccaagtttgaatactaactctgttttttactagctgtattaacactggcaagttatttaatgtttctagtggagtctgatgcccatgtttgaatactaactccgttttttactagctgtattaacactggcaggttatttaatgtctctagtggagtctgatgcccatgtttgaatactaactctgtttttcactagccgtgttaacactggcaagttatttaatgtttctagtggagtctgatgcccatgtttgaatactaactgttttttcactagccgtattaacactggcaagttatttaatgcctctagtggagtctgatgcccatgtttgaatactaactctgttttttactagctgtattaacactggcaagttatttaatgtctctagtggagtctgatgcccatgtttgaatactaactctgttttttcactagccgtattaacactggcaagttatttaatgcctctagtggagtctgatgcccatgtttgaatactaactctgttttttactagccgtattaacactggcaagttatttaatgtttctagtggagtctgatgcccatgtttgaatactaactctgtttttcactagtcgtattaacactggcaggttatttaatgtctgtagtggagtctgatgcccatgtttgaatactaactctgtttttcactagtcgtattaacactggcaggttatttaatgtctgtagtggagtctgatgcccaagtttgaatactaactctgtttttcactagtcgtattaacactggcaggttatttaatgtctgtagtggagtctgatgcccatgtttgaatactaactctgttttttactaaccgtattaacactggcaagttatttaatgtttctagtggagtctgatgcccatgtttgaatactaactctgttttttcactagccgtattaacactggcaagttatttaatgcctctagtggagtctgatgcccatgtttgaatactaactccattttttcactacccgtattaacactggcaggttatttaatgtttctagtggagtctgatgcccatgtttgaatactaactctgttttttcactagctgtattaacactggcaggttatttaatgtctgtagtggagtctgatgcccatgtttgaatactaactctgttttttactagccgtattaacactggcaagttatttaatgtttctagtggagtctgatgcccatgtttgaacactaactccattttttcactacccgtattaacactggcaggttatttaatgtttctagtggagtctgatgcccacgtttgaatactaactctgtttttcactagccgtattaacactggcaggttatttaatgtctgtagtggagtctgatgcccatgtttgaatactaactctgttttttcactagccgtattaacactggcaagttacttaatgtttctagtggagtctgatgcccatgtttgaatactaactccgttttttcactagccgtattaacactggcaggttatttaatgtttctagtggagtctgatgcccatgtttgaatactaactccgttttttcactagccgtattaacactggcaggttatttaatgtctctaggtctcagtttcccatctgcaaaatgggggtaatgaaagtactaatctcatatgtctaatatggagatgtacatataagccagtatgtgtaaagtgattagcacatggtaaataatatgtttactacattaatatgtgagcaaatatacattaaaaaggtgttattttgtgaacttgtaaatagttgaaataatgcattcagcttaggcaaccttgtttcaaaaaaaaaaagtgcaaggtttcagaaaagaagatgtacaaatgaccaataagcctatatataaaacgctcaacatcatttatcaaggaaatgccaactaaaaccacaatataacgtccttgcacactgttacaatggctaaaattaaaaagagactacatcaaatgctggtgaaggtgcggagcaactgctgactggaatgcatcatcactttggaaaatagtttggctgtatcttattttaacatgtaaaaacaagcaaacaccaccaccaccaccaccaacaacaacaacaaaaatgctcttatatgacccagcaatctcactactggtatttatccaagggaaataaaccacatgtccacccaaagactcatacatgaatattcacagcagctttattcacaatacctaatcaggggagacaacacagatgttcatcagcaggtgaatggataaacaaattgtgttatcccaatacagaccaccgctcagtaataaagaggaacaaactactgacacaaacgacatggatgaacctcagaatcattatgctaagtgaaaagagtcagaccacagtctataacgtacagttccatttcttcaaaattcaaaacagacaaaagtcatctatagatacaaagcagatcagtggttgctgcagccagacgtgtaggaggattgataccaaagggacatatggcaacttttggggtcacggaaagttctgtatcttcattgccatgataatcatcgtatattatattcatggcatacatatttgttaatacccaaagtatatacttaaagtttatttaaataaaaaggtacaaagaaaacagaaatgaggaagggagtacaactgcaaacagccaactttaaaaggtgagtaaggagctcagcacagaccaaaccaacaactgggattttcaatgcctcaggtcggcctggaggcccacaagtgctgtgaatgtgaaacccaggaacaaatctcctgggttactctcatgtatgtcgatgtccctttccgtctcccctctgtttaagaaaaaaaaaaaagctgagaagacaaactttaagttggcccctcccctaagacacctagctacctccttggggtgtgcaggcctttgtacaatcccctcgccttgccccttatgtatgggcatgatctgtgacttgcttctaacagaatatggcaaaggtatatgtcactcctgccaattacatttcataaaactccatcttgccatcagatcttcactagaagctcttcttgctgacttaataaagtacatggtcatgtggggaaagccctacctgagaaggaactgtgggtggtctccaggaactgtgggtagacttcagccaagagccggcaagaagccagggccctgagtcctactgatgcaaggagataaattctttcagtggcccaagcgagctgggaagtggcttcttccccggatttccatacgagaacacagcccagctgacaccttgacgagagctttatgagaccctacatggaggatccaggtgtgtgtggacacctgacccacagaaaccatacgattaaaaaatatatgctgctttaggccacaaagtatgtgataattcattatacaaaataaaaaatataaacagaggagaagatacctaaatggttaaaaagaaaaaacaatacacccaataaagtcggcattttcagaacacaagcgctaggcagagctgcctgactgttgtcaggatcatgcagcaacttctttaacaagtcatgctgccctgtgttccttcctgacaccatgacaggagcaaccactcaagtccagcatcctctaggccctaaagtgctactacatgtgactcacagacttcacaacagttctaagagcactggagaacagtacctactgtcctttaaagccagggccttactcccttctgtggagacacacaccccttggctctaagtggccccagtggacatgacacaacaatcccaaagagccacttaagctacaatgtaagattgttgagaccagccgggcgcggtggctcacacctgtaatcccagcactctgggaggctgaggcgggtggatcacctgaggtcaggagttccagaccagcctggccaacatggcgaaaccccatctctactaaaaacacaaaaattagctgggcatggtggcgcgtgcctgtaatcccagctacttgggaggctgaggcaggagaatcacttgaacccgggaggcggaggttgcaatgagccaagatcatgtcattgcactccagcctggcgacagagtaagactccttctcaaaacaaaaacaaaaacaaaaaaaaagattgttgagaccaatggttatgtgcatggggttctactctacagctaaagaggaagtgggatgcaagacaaaggcagttatttaacctctataacatatttagcaggaagctcaaatatgcagactattgaacagggaagaatagagtagggagagaaaagacgatagtgtagtaccatggggaagaacagtccaagaagtgtgaattgctctgccagggacagccctgcctgtgacgcatcacacaacttctctataaaacaaggctttatgatccttaaggcgtcttccaggtctaagagtctatcattctacattatataaaaatctttagttgaacaattatagtatcttggggggaaagtgtactaaggcatcaagaaaacaattttatctgctaagagtacttactcgtagtaagtaagattagtatgcagaattctgagtttagcacacacgatgttcttaggatttgggagcctagtcttataaatgtgaatgccatacattaggttgcaaagaaaaggccattcatatccacgaagataacaaaggaatatatatagtagcatgaggtgattttatttaaagtttaatgtcctcaagtaatcattccatgctcagtttcttataactgtaacttggaaatattgacatttcatatgcaagctataactaaaactaacttttctttataaccagctaggaaaaaaataggcacaaagtattattttataaagtctaccaagtaacgaacatcaaagaaatgcacatgatatagtcaggctttttctagcacttgtcagtacaagccagttagtggagtaaatcggtttggctgaaagtcctatgctgccatgcgacagaaaagagagctaaactatccacattccatagtttaccttctgtcactaataatctccatcatctacttaaaaatcttagagaagctgggcacagtagctacttgggaggctgaggcaggaggattgcttgagcccaggcgttcgagtccagccagtgcaacacagtgaaatctccatttctctctttaaaagaatgttaaagacatctacctcaatttttggcaatctcctactgtagcttgaaatgttaaagcttacatttagactgtgcatgtcagtttctattatcattccactttacagagaattaaaaaaacactgtgcttgcaacttaaactggtattaaactgacccctgctggcctcatcttttctgtttctgcatttatcagatgcttcaagagctaactgcattctatagttcaacctatatttgatcaggctgccacctcaaaaacaaaacgtgggacaaagatggctagttgtaccaaattccaaatggaaggatgccttcctcagacctttgtctattttatttgcaaaaacctagcaattaaaatcacactaatattccaaagaagtatctcctatagcctatgaatttattctaaaacctaatgcactcaatagacatttacagatttctcaaagactgccgggaaataaagatttttctaatcacagcacctgccctccaggtacttacaggcatttatgagtcattgaaaagatacatctgagaattcaattctagcatatcattggacaccacacaggtgagaaggaagtggggtccccattcagcccgtggtagagcctgcctcactggtgccaggtcacttgagattcgttactgaaatggcccaggacaatgtgttctcttccttctttgtgaactcactgtgctttatgaattataatggctgccattgattggcaacctactatgtgccagagactactacagttaggtgctttccacacactatcacatttaccctactcagtaactctgtgagataggtgattttatgctcaagcttgtatcatgggtgagtaaagctctgtgagaatactgatcatatcataccgcaatgtttttcctttaaagagatgtttctcctctaaacaacagcaaacaccttaagcacaggaaattacgttattgtcatctctgtatcctcagaacctcatatacctcagtaaaggcacatagtaggcactctaaaaacatctgcaaaacatacaaatgaaaatattattgaaagaatgtagctactaaatacatactatgggcataacctatgcttaggcactgagaaaacagtggaggaaaagaaagaagaggcaaaggctttgattcctgagcacagacacccatacgtgactatggaaagaaaaggagaagttccaagacataagtaaacagaatgctatgtcaatacagctcatactaccagtcagctcaaaatcaaacagaaaaaggactcctaaatcagaggacaatgacacactggtgctgggctattggaaatgaaacctattaaagaggaaaaaagagagaggaggtagaatgtcattaaattcctttctgtttttgtaacatatctacaagaccaaatgatgtgaaaaatagttctgcaagacggggactatgtgaatccagttttaaaggtccaaatatgtatactttacttatatagatcatggcatagtaggaaagacagaagatcataaaaacaaatataatgtagaggtctaaaaattgtttcctggtcaggtgcagtggttcatgcccgtaatcctagcactttgggaggccaagccaggaggactgcttgagcccaggagtttgagaccagcctgggcaacatggcaagaccctcatctctacaaaaaaaaaaaaaaaaaaaaaaaaaaaaaaaaaaagcaaaaaaattagctgggggtggtgttgcccacctgtaggcccagctactcaaaaggctgagatggaaggatcgcttgatcccaggaggtcggggctgcagtgagctgtgggccaaggtggcgtcactgtgctgcagcctaggcaacagggcaagaccctgtctcaaaaaaattaataataattttaaaaaataaaattatttgttccaaaaaaaaaaagctgcatgtatttttcttttcttttgcttacctatcattatttttccacatctcttttcttggtacttcagacagatgaagataaatgaagcacagtagttaacttctttgtttggatacaaaaaatcttctgtatcaacaatattgttatgcaagcactttaaatgttgcttctagcagatgagacttctgcttcaacatatgttatggggaaaaatgataaaaatttattcatgactagaataactgaacagtcaacaaaatctaactagaaaatgtaataaatcaacctggtttgttgcagttgttaattatctaaagtaaactgaagatccagtctctcactccaaacaagaataaataatcccagattctcagcactgtcaatactttctatatcatcctaccactgctgcaaacttcttccttcagagtgatcggaatttaacttcctctgcctgcaccttccctgagacaggaaaagccacaaaagaaataaggagctctaaaggttcttctgctcaacaatggcaccttaaaaatctaaaacttactgagggagcatgtaaccccccatagaaaataaaacagtggtcaagcttttgggatctggactcagggtggcttgggttcacaccacagttctacaaatgtaatcttgggcatgtcatctactttcctaagccagagataataacattgccaagagtgtaacagtgagtgatcatatgcacagagcttagcattttacctggaacctatgtgtttcatgagcatgagctattgccattattacatcccctttgctacatccctcccaaagtcctaccatcgactcgcaatctgaacaaagagaaaggacctcaaaatccttactctggctaaactgggctttaaatgtgtcagatgtgtccatcttgctttccttcctcaccacccctgcctgccaataatcagagccatggaaaagcttcccttgctcatgcataaataacgtcctcattcatatatacctgtgtatgtttaattacagtaactagaggtctcaaaataactcatatggttctaatttcaaatatttaaagctcttaatgacacttgcttctgtgagaccagaagaaatataattgccacagcgataacatctaaagcccaagatcatttctcccagaacttatagcactcacagaaatcgaccaggatctgcttgcagtatcttttagaatttctgtctcccactgacacaaccgagtcataaacaaaaactgcagcacttgccagctttcacagcccatgacaactgtgagttacacacaaccttcaggtacaccattcaccctaataactgatttcaaaataacaaaaggaagtcaagcatttaaatgtagcacattaatatttgactaaaatagcatatcaaccagtagaaaaatcaaacaaggtaaattactcatgaaagaagaactacatgaatttctcagaaacgaagtcttgctggagaggtacatgccatgtcacttgcaaccaaaagtacttcctcagagccaatatcaaaagcaccggtgagtatgctgcaaaacggcatagcaggctgtcagatgctgcatatcagctacttgagcagttagattaagctttcccaacaggcaagtgctgcagtacttctgcatctagcatctggtaatgtgttgcaaacgcagaacaaagaaagcagcaggctccgaaatctttcagctttcctttgaccatctgcagcacttaaacacttcagggttaccaggtcagcaacgtgaattctctcaataccatgaaacatgagcaaaatttccattctctgaggtttctaattcttttctttttcttttttttttttttgagacggagtctcactctttcgcccagaccagactgcagtggcttgatctcggctcactgcaagctccgcctcctgggttcacgccattctcctgcctcagcctcctgagtagctgggactacaggcacccgccaccacacccggctaattttttgtatttttagtagagacggggtttcaccatgttagccaagatggtctcgatctcctgacctcgtgatccgcccacctcagcctcccaaagtgctgggattacaggcatgagccaccgcgcccagcctctaattcttttatttttctttactttttctgattgtattgagataatcaaatgatttttctccttaagggagtatggtaaattgtattaataggtttctaatgtgaaaccagccttacattattggaagaaaacacaatctggtcatgttgcttttaaattatttgctggattcaggttgctaatattttatttaggattttaaaaactcatgtttactagtgatattgactagtaactgcctttccttttttttttttatttccataggtttttggggaacaggtggtatttggttacatgagtaagttctttagcggtgatttgcgagattttgatgcacccatcacccgagcaatatacactgaaccgaatttgtggtcttttatccctcacctccctccaccctgtcccccaggtccccaaagtccattgtattattcttatgcctttgcaccctcatagcttagctctcacttatgagtgagaacacacaatgtttggttttccattcctcagttacttcacttagaacaacagtctccagttgcatccaggttgctgcaaatgccattaattcattcctttctatggctgagtaatattccatcatgtatatataccacaatttctttatccactcattgactgatgggcatttgggctggttccatatttttgcaattgtgaactctgctggtacaaacatgcgagtgcaagccacatgcaggagaataactggatcctcacctctcaccttatacaaaaatcaactcaagatggattaaggacttaaatctaagacctgaaactataaaaatgctacaaaaaaaaaaattggaaaaacccttctagacactggcttaggcaaagacttcatgaccaagaacccaaaagcaaatgcaacaaaaacaaagataaatagatgggacttaattaaattaaagagttttggcatggcaaaaggaacagtcagcagagtaaacagacaacccacagaatgggagaaaatcttcacaatctatacatccaacaaaggactaatatccagaatctacaagaaactcaaacaaattagcaagaaaaaaacaatctcaccaaaaagtgggctaaggatacgaatagacaattctcaaaagaagatataaatggccagcaaacatatgaaaaaatgcacaacctcactaatgatcagggaaacaaaaatcaaaatcacaatgcaataccacctttctcccgcaagaatggccataaccaaaaaaatttaaaaaaaatagaagttggcatggatgctgtgaaaagggaacacttctacactgctggtgggaatgtaaaccagtacaaccactatggaaaacagtgtggagattccttaaagaactaaagtagaactaccatccagcaatcccactactcggtatctacccagaggaaaagaagtcattatatgagaaagacacttgaggtttctgattctaaagtaaaacctccatcccacaaaaagcttaataaaggataataacaaaaccttgctttgccagcacttttgtttaaatttttgtttttaagttccaggatacatgcgcaggatgtgcagatttgttacataggtaaacacagcactttttttttaatctgacaaatcacaaatcaccacacagctcccatcaatgcctcttaaaaacaaatattttccactgtcttagggaagtcccaatttctttaaaattcatcatacaaattatttcctcaagttttcactcaatgaaaattcctgagtataacacaagactgacattagttctgtactcaaactctcagaaaattagtgctagttttctacagactccctgaaggtctttttaaaaatttttagaaatttgtatgtagtaatgacttgccaatataaatgtaatacagagacactgtttttgttcatctttgtatatccacctagtatagggcatggcacataccagacactcaatatttattaactaaagagtacgtaggtctgctgcctctcaaatatttgataatcagacttttgaattctaaatttcaagtggagaaattttctccattgaccatcattataaaactgtagtggtatatctttggaaaatatatgacctcaagatataataaaaaaatctttttttttgtttttttttttgagacagtcttgctctatcatccatgttggagtgcagtgacggaatctcggctattgcaacctccgccccctaggttcaagcagttctcatgtctcagcctcccgagtagctgggattacagttgtgcgccaccaggaccggctaattttttgtatttttagtaaagacagggtttcaccatgttggccaggctggtcttgatcccctggcatcaaatgatccacttgcctcggcctcccaaagtgcaaggattataggcgtgagccacagtgcccagcctaaaataacattttaaaaaacaacaatcattttagaatttcatgaatatcaattgatcagaaaacattagtgaaagtccagagttgttttaaacttagaaaatattttctaatatatatagttttcggaataataattaggtcaatgagctaaagatttccttttacagtttcattacaaatttaaaaagcttttgtagtaaaaacccatgaatgtaatcactatttaatagtttatgttttctaaaaatgtgtttggcattccatctgttaagttaggactccagaagaacttaccgctatgtccaaactgggttggagggggacaagctgggtttaaattgcgtttctttcacttgctaggtgaccttgggcaagtcatactaaacctcactttgcctattaccacatctctaagatggacatagaaataccaagttttgggaatactattcttgaagtatagtaattagatttgggggggttttgtgtggttccttacacctgaccctgtctctgttttggccaggggcatccatctgcctacgggatattcaggtttatggaaacaggaatacaaagagaaagactcagtgttcaattatgacacctataaatcaatattttcagtcaacaagcaaaattcttgacagccaagctttgtcaagagaaaatgtgctttctaaattcctaaaacactaatttttaaaatgagggctgaaaacggaatgagaagctcaccttgcttccatgagcacagctgcagggtagaaccacctaggaaggccttggaacgttacacggcctggggcccccacccccagacacttagattggtctgggctcaggaactcaagcattggcaagtttttgaaatgccatcaggtaattctttttttttttttttttttttttttttttgagatggagtttcactctgtcacccaggctggagtacagtggtgcaatctcagctcactgcaacctccacctcccaagttcaagcgattcttctgcctcagcctcctaagtagctggaattacaggtgtgtaccaccacgcctggctaattgttgtattttcagtagagacggggtttcaccatgttggtcaggctggtcttgaactccgccatcaggtaattcaaatgtgcagcctggatttagaaccgtagctccacagagaagcttctggtttggttcaaaactacgatccacacacaacaggagggaaaacccagaagtggcctcctggtcccctacagccccatgcgtatgttatgcagtggatcctgagctttcctgtgacccagtgggggtaatgcagagactaagactccccagagtggagagatggcaagaataaaagctaaggctagtccaggcacaagactagataaaccaaccacctggggcagaagagaatcaggaccagtctgcagtcttgctcccattgccatggaaggacaaggaggggaaaatgcaaagaattgagcatttatctgaaaaaaagacaagctacccaaggactttaaactacaagaaacagaagcaccattaaggggtaagtttgtccaatcatgtacattccttacttaactgcttccccagatgggctgaggtaagaaaatgtagttcaattataaaatatttaaaagcctggccaggcacggtgactcacgcctgtaatcccagcactttgggagactgagttgtgtggatcacctgaaggtcaggaacttgagaccagcttggccaacatggtgaaaccctgtctctactaaaaatacaaaaaattagctgggtgtggtggcgggcacctgtaatcccagctacttgggagggtgaggcaggagaatcgcttgaacccaggaggcggaggttgcagtgagccaagattgcgccactgcactccagcctgggcaacaaaagcaaaacttcgtctcaaaagaaaataataatcttaaaaagcgattgttaattaaaattatccaaaacatgaaaaaagaaaaagattagggagctgtgtggccttctcatattactctagagcactgtttcacagcttcacccaaggattatttaattccctagaagaatgccaatgcatttgactttgttacttgctgttagagcacagatagtgtgaaactacaacgttagcttatagatttctgtccagcagaaaggataactctaaaaactgtggttttagtgcatgcagaacgtcaccagttttgtctccaatctagcaatcttattctaatgcctaaagatcagttccttcagtactctggacctgcattaactctgcctggtttcctcattaataagttaatacatctttggcatttcgttttgtatttctgtgagagtcaggttttaacttttcaaaaaatttactttgatagtatattttctttgcatgactggtagtgtatgtaaatctaccactcactgacactgatctcagtggacattttataagataattcgactgcttggtgcagtgcatggcacttggtaaatgctcagtaaatgttactgttcgtgggtgctagtggctagaggagattttacctgcatctaacagtaaccatgaactcaccaatggaggtccacaaccataatccagggcaaccccgggtaagtggatacacagacttcctcagtagggactattcccatatatcataaatatagggagccactctgctcaaaataattcccaaactatcaacacagacagtacgactcacttgtatatatttatcacgagtgtgtgggcctgtgaggaaaaaactatcataacttagcaaaatcagaaagtacacagatctaaaagaagccatctccttggcgaccaaaagtatgctgctccatacttaaaggaatcttcaaatgatgttcaaatatatgatgacaggagaaacagcaacacagcaaaataactacattagcatatgaagagaggaaattggactggggaagacctgagagttttccagcaaaaactggagaaaagggaactaaaccatctacattccatagttcatcttctgtcactaatagtgattattatccactaaactatctaaacttttggccaatttctactgtcgcttgaaattttaaaagcttctttttggactgttcatttcagttactgttctcatttcactagacaagagaagccctgaaaaccctagtaaagctatcagggaagagatatatggttaatttcttaaattatgaactccttaagtatgacttctctacaaaaagtttcttcatcaatgaagtgcacctgtaaaaaccattccttgtctaaccttgaaattggcctgtaacttcaaggcttaactttcgagtgtgagagtttcagacacatcaacatattttcaaggccataaacactgggtaatttttcatgctcaagtgtctggagtttcgttttcctaatatcaataagcaatatcacaactagcaaggcagaaggaataaaagcacctcagcctctcacaatgaactgaaaaaccctatattctttccttttttttccttcacatcccatttcttttaccttgcccagctggtggaaaaaaatctagcttccttctgaactaaacacacataattaaatacacacaatcttaatttaccacactgatgtcttcatcatcagctaccctagcaccatttcaaagcagcagaaagaaatataataatttataagccagctcctgaggttatatatttattttaaaacatgccagtttcaacaatataaaatgctttcccatgtttaaaaaacaagactatttgttaccttgtgatgggacaattaaacaagcttttaagcgtgataaaaaaaaaaatacataggttaataaagtagtcttgataaaaacaaagcaaagatttgaaaacattggtatttccataacctacagaatactgatgactagatggtcaagacaagcatcagttacaaattatgtatacagcttgctaacaaattagggaaacgttcccctctggtttctttcccgactacttgtaaaataatattcgcatacaaatttgcaattcaaatttgatgtcttatgagtgcattttgcagatcatgctctgagaaggaagagagtgagctaagagttgcatggaaagtataatttgctgctggcttttagccagaaacactagaccaaatgtttatggagaccacgaggcacctaagcaagcccagtgcatctggacttctcaatactagttgttgctatttatttatatgttaacctccaaataaaaggtcaaatagagtaatatctacattacacattcatacattttaaaatatatttattttacttacacagtacaggaaaggaagtgatttgccgtcactttgagaacacttgcaatagcaatgacaagaaaaaccagtaatttaagcaacactaataaccatatgtctggacctatgttcaactgtaatttacacattaagtataagcttttattttcatacttgagaaaacatgccaggtattcagtatttataatcatagttaacttgcagaatgaggaagctaattacagtagaaagaagaaaatattagccttgggaaaatatgaatttgacgatcacacaggtaggtagtaaaggagccatttctacctcccatgaccaatgcaatacaccagcatcttagacttactatccaacacaccagcatcttagacttactatccaatacaccagcatcttagacttactatccaacacaccagcatcttagacttactatccaacacaccagcatcttagacttactatccaacacaccagtaccttagacttactatccaacacaccagtacattagacttactatccaacacaccagcatcttagacttactatccaacacacaagcatcttagacttactatccaacacaccagcatcttagacttactatccaacacaccagcatcttagacttactatccaacacaccagcatcttagacttactatccaacacaccagcatcttagacttactatccaaaacaccagtgccttagacttactatccaacacaccagtaccttagacttactatccaacacaccagcatcttagacttactatccaatacaccagtacattagacttactatccaacacaccagcatcttagacttactatcctacacaccagcatcttagacttactatccaacacaccagtaccttagacttactatccaacacaccagcatcttagacttactatccaatacaccagtaccttagacttactatccaatacaccagtatcttagacttactatcactgtcaagtattaaagcagatatgatcactatatggataaatatattgctaataaaaatccactccaacataccagtcactccagcacagcacaatataaattttgtagggatatgctgcagtaaaccatgtgacacagtaaaaggaatgacacattacaagcttcccttaaacagaagaccatgaacacgtattgccaacctattacttgagagcatttgggggcaaaagagtcatgctgaaattggagtctctgcaaaaggaacacaaagggctgagcaaacaacaggaagcttaggcagggagcatggcagacactgaaaaaacataaggaaagggtcaacatatagccatgttcaagaacataattttagttaatgctaagtattaagactgaaaactgaaacatgggttgggaaaaattgctgatgaaatcaaggaagatcacaaagaatcattccaaaccaccatatttggtgggtaaatgtatctgtactgtaaaaacactgtaccataaaaaacaacaactagatcatgtatgatgctattccatacatggtggtaattatgaggccaatttgcatctcctcaccgagaaaggattgtgaatccccaaactacatcatatcaccccctaaagaatgttatgggtccctgacctagtggatgatctctccctctctccatgaggccccagcactgacagatatcttctgaactatatttggtcatgtagtctgaacaacaaatcattcgcttgctacctcatctacatgtattatgtacttggatgttttgctggcaccctagagatctggagcttttagaaggctactttaccataggtgtggtaagtgtgatcaatatatacctttaattaaactgtaacttattttaagccagtatcagaaggcaagttaaaaaattagaggactgtaacttctaagtagtataacacgcacattagcattcacccacgtgcttccacttttgcagacatggagcaaaagcagccctcctgctagtgagactactccaagaaaacccctcccccggcacagtggaaaaacccacgacagtctcagaagaagagcgtctatcccaggattcaaggttaattcctttgctctcaccttctcagaaatatcacttcatcattaataacccttttgcccacttatctttaaatcttcatctttgctggctcacacattcaaatctcttcaaaacaaaaaaacagaaccaaaaactccacactcctaattagtgccctattcttttcttctattcacagtcaggtttctcaaaatgatcaagcactcatgactctaaggtgctctagcaaagctcaccaaaggattccctattattgaactcaatgaaccttttcagtcctcacgttaactgacgtctctgcagcacttgaagctgttgacctccatgaagtgctttttctcccttggtttctatgatatctttctctccaggttttcctcccactttactccctctcagtcgcctttgctggcttctctttttcagcttgccccttaaatgttcctgttccaaagtgttccatccatgctgctcctattttcttttctacctaccctctccctacattccttccacctccacagcattagccatcatctgtatactctagagaatgtcttcctcatttctaaataccggcgtccccagcacatagcactcactcagtaaggtcagatgaaagcctgatgaatgatagacaattacagaagcaaccagggcccactatgttgcagagttagctttagcaaattctaatttcttgaccagattaaatctatctacaaatggtcagtcttactgagggctgactaccattgcctgtaagtgttcagctaagtgttcatttagtcaacaaatatgcagtgcctgctatgtgtcagcacagtgcctactatgtgccagctacatgataggccaaagaattcgtggagaaagccctgaaaatagaaacagacaactctttctgagtccatgtatacatctgtgtgtgatctgggcaaaccaattaagcttcctttttttttttaagacagagtcttactctgttgcccatgttggcgtgcagtggtgcaatctcggctcactgcaacctccacctcccaggttcacatgattctcctgcctcagtctcccaagtaactggaattacaggcacccaccacctcgcccagctaatttttgtatttttagtagagacatggtttcaccatgttggccaagctggtctggaactcctgacctcaagtgatctgcccacctcagcctcccaaagtgttgggattacaggcatgagccatcgtgcccgacccaattagcctttctgcctacaaatgtcttcatatataaggtgagaataatatatctattttacagggttactgtggaggttacatgagataatacataaatctaatatgttgcatattacttatgtctgttattcactgtgaataatatgtaataataaatattttatgtactcctttgttaaaacaagcttataagacaagttaaggcaggaattagtattcccactcagaatactaattctattagtattctaatagcagcaccagaacctaagcaatctccccaagcccactcacgcagtccctaggtggtaacgttctttagtgtcagagaccaaactgtgattctctttacttagtatctcttacagatcccactgctgcccagcagcataaaagatcctacccagaaaagggtctacagttgagaagccaaaggtcctaagatagtagccgaggagttgatgagcaaacaaagtgtttgttttcttaataaagaaaaacagttttctgcttggacacagtgtaattccaactataagaggcagcataatgttttcagtcagggaaaggtctccaatttcataagttttgatttaacaagaagattctaatattaaaaactgtcaggttgccacggtaacaatctatttgcaatcaagatgctggtggtattctgttatatttctctcaaggaaaaagtaaactagatgtagccaaggaatttaataaaagtatctgttggaccaaaaccaagatatgactgtttttaggcaatatgacaggatttaaatatacagcaagagaccctcaggttacaataccagttccatcaataaaattaaaagattttgaccttgacaccagtacaagctatagccatatgatctggaaatctgaatcctctgagcaagaaaaataaatcgttaaacaattgagatgacaggcatgggacaagaaagtcaaaattcatcagaaggagaacaaaatcaatccccaagggaggtatgaattataaagactaaatttctcacagaaaattcaaaggtttgatttgggtgttttgttctgctgttgtatgtatgcatgtatgcatgcggaggtaggttttgcactccaggacattcttggatgtttttaacttgctgctttcatctagaaaatgttagaaggacatattgaaaatgaactgattctagacaggagaggaaggaagtgactgtcaggaattaggccgctctgagtctggacatgcagactatgcagacagagaaacttcctccacaaccaccgaagcctcagtcacgcccatgaaaatcacatggattttctctacagttaagacttttcaagtacttgtttctacaacgattcaagaaatggtaacacttgcccccacaactttagccatgaacaactcatttctcttcaatgtgttaataactttacagaactgtatatgcatgctgaatgtctagaatgacaaccagaataaaaactgcaactcctttggcttcgacaataaattggcttcacaagaaaatacctacattcatgacagaagaaactggctcttgccttaacctatatagttaatgcagatttatatataaataacattatatactttttagaacatatatttttataaatgtatatttatatacaaaataactaaattattttctgaaacagccttgaacattgtgtgtaatctcattttctgtaagtcattttccttctactttctctataaaattggagcactgtcctctacccctccgaaaagacatttgttaaaatcacagtgaaggttcagcataccttagaaaatcagacattttaaattctatgaagttcagacaaaatattaatacaatatgatattcctatttaaataaactcctatttaagtgattaatgaatcatttatgtattattgtactatacttagtacagataacatatttttgttgagatagcgttcttaaagatcacagagattctgaaaatgcttctaggttgaggaacttaggtagaggaagctaacaatcgatgaatacaataaaggaaactcatgagtgatagagatttgaggaaagtgctagataatcatccagactttaaatagtttgggcaatgattcagggacataaatggccagcagttagaaatagagttggaactcaggagggggctctgacacagagacaaaaatttactcattcacaattaagtaatagttgaatctatttagaaaaacaatgtgaaaaagaaagtaagaaagagaaacaaggaccatctttgagagatgccaacatttaaagatccatggaggtgaaacaaacaaggtgacagaggtatcttcaaagtcataaaagaggagtttcattaaggaaacagtcaacaatatatgcctcagaggagtcaaacaggacacagaaagagaacaaaatactgtattcaacatttaggatgtaactagttacgtgagtgaattcacttcagtacggtagtagaggcagcagctagcctacaatgggttaatgagttagcagggaaacaacgcatccaagaatttgtcttatattctaagatcaagaaccctcaacgaacaaaggtaagtgattcaggcttacatcataacccttcctaagttaaaaggacaagagcatttgttcaataaggacagaacctgaaattactggcttgtaatgaaaacgtttttaaccctaaacaagaataaatttcttgactagaatatttttctgatgcatcaaatgtcaaatattcaattattctgatgtataaataccagagattcactgtattgaccagagaatgctatgaatctacccaagattcacaatacttttcaattaaattaagcaatttttccttctaagacttccatttcagttctaaatatgtgttatctccattcatccttgtctcataggacaatgatcttcatattttagaggtagacagctttactctttggtttctgttaacaggacatcttgaatttaattgccaatgttatttatgaattataactgtaagagtgcttttcagtatgatgaatattccatcatctttaatttttatgagatgcttaaaatgaagggggatgggacagtctagctgctcttttcctctcttgctacaccctcttctggaaagacaataaacaacataagctttttcctttgtctatataaacctgcaggttcacagacagtgccacttgtcaacagctaaagagaaataagaaaagaacttcagaaggggaaacattcataaagagcaagagcacactgaggtaaaaaaataataataataaatagaagctattacagcaggaaaaaaagaataaaacataagtgcatactaatatcaagaactacaaaggtggcaaattgaaataatctaaatactgaatattaatttttttctatgaccaaaatcatattaaagcttacaaacccaacctaatgcctaatgaactcatttaagttcaaagtacatgaatgtaaaagaaagctgaatataaagaggctatcttgtgttttcaatacaatttaagtgttattataggagctgccacatttgttcccaagtatcccttcataaaatatcagagacaagatggaggttttgtactaataaagtaaaaggtatacttccaccaggtaaaaactttctggacctaacagctttaaaaataagattgtaccaaaagctatctttatataatgatgatgactggaccatcaagaatatgcaacactccctgtatattatacttcatcatataaagaaggaacagctctacttttaaaagccagagaaaatgtctaggtctgcctagaactgtcatggccttaaaaatttcatggggaaaaaaaagagtcaaagtctcatggttttattatgcaaaacttcatgatttcaaacccaccagaatcaaataactaaaaaatgaaaatgaaaattacaaagaggcattacttatatcacttttaagattggcaaggatgaaaaagagtaacagtatcccgtactagcaaggctgtgagtaagcaagcagtgttcttgtatagggttggtggagtgtaaatgcaatatatattagagcacaacctggcaacatatataaaaatgtaaaatctgtttctgcaacttcatttctactaatttatcctatgtaaaaaccagtttcatatgcaaagatagatgtatactgatgttccctacagtggaaaaaaatggaaatacttcaatagcgtactggttcattaaattttaatgttacatgcagccaacaagtgtatgaaaaaaagctcaacatcactgatcattagagaaatgcaaagcaaaaccacaaagagataccatctcatagcagtcagaatggctattattaaaaactcaaaaaataacatgttggtgaggttgcagagaaaaaggaacgcttacaaactgttggtcggagtgtaggttagttcaaccattgtggaaaacagtgtggcgattcatcaaagacccacaaacagagccaccatttgacccagcaatcccattactgacacatacccaaaggaatataaatcatttatcatgaagacacatgcacatctatgttcatcgcagcactattcacaatagaaaaagcatggacaccctaaatgcccatcaatggtagactgaatttttaaaatgtggtacatatgcactggggaatactaagcagccataaaaaaggagatggtatcctttgcaagaacatggatggaactggaggtcattatccttagtaaactaacatagaatagaaaaccaaacaccgcatgttctcacttgtaagggagggctacataatgagaacacatggacacacggagaggaacaacagacactggggcgcacttgaaggtggaggatgggaggagggagaggatcaggaaaaacgactactgggtactaggctgaaaaatgactactaggtactaggcttaacacctggtgacaaaataatctgtacgacaaaccctcatgatacgagtttacctataaaacagtcctgcacatgtacccctgaacttaaaattaaagtttaaaaaaaaaaaaagttaacaaagtttaacatgttcatacaatggaatagtatacaaccattaaaaaattatacgtggtatgcatgtagctgtgtatatactaaataaagatataaatgtggacccaactgttaacagtgttggtctctaagaagtaaggtttctagggtacttggatttctcatttgtgcttttacttactttaacttttcataatgcacatagtttttttatagaccccaataaacatttcaaatgagtgataaaatgtattagcacagttgaaaatgcacatttgcatgtattatagacaatggcttttgttgtgttgaaggatcaaggggacttagatgtattaaaggtaatgtgatggctgtctatagtctgctgttgttattaccaaagagatttctaaaatacccaaaattgccttcttaggtgtacgggtgaggaaagcggccagcaatgtttaaagtattacctgaatgagaatgctattgatctttgtggtggtgtgggacgccaaggtatgaatctggaattttcaaatgcctctgtgctttccaggtactaaaaacatgaactctaaaattacagacacctaggttaaggatcagttctaccactgactagctatgtggctctgggcaagttccttcatcttcctaggcctcagtcttgtctcctggaatacagggataataatagtacgtacccccatagaactgttgtgaagatttaaaatataatatatgcaagccacagtgcctggaatacagccagtattcaatgttggctcttatccttctcaaagcacatcaagtttgctttttcattactgattacaaagacctcaggaaatcaaagtctggattttattgcaagcaaaatagaaacaagggatattaacttcagatcagataatagaaaacacccagcctgtcagtgaagttcattttctttctagaataatgctacccgtcctaagggtagttcagctttgtagagatagaagtcgtcactgattatcaataccaaccctctgactgtgtgaaaagtattaaaatactaccagtaccaaatgtgcacatggaagactaatgaagagcaaaacccaaatctgcctattaagcataaatgggaacttaagggaaaatctgaacaaagtctaatgaacaaataaaatataaatagacaatgaaaaaaatattgaaactagtccccaggacacttccaccattcgacagattcaaatcagcaaacatttattaagcaattcactgctctcaagaatgttcaattctcgtgcaggagccaagacaaaccaataagtaactgtgataaaagacaggatgagatgagtgctggaaaaattccataggtgcccgaaagggaggtagtacacttcctgcagggacaagggaaaacaataaagctacagtgggaatggttttcaggtatgagtacaaacaagatggccacaaattaagattgattcacctagcaagtctgaagtaatgagaatatgttttaataaactgcatgcacacattttatactgtctattgagagtctgttttataagaaatataatgttacgtgctataagggaacacaataacatttctgacatctcctaagctttacaatccagctggggagcaaattatgcatattgtattgtgaattccccaagggcaactgatgtgtcttttttatctttctattcccatcctcttgcacaatccctgcaacatcactggcactaaatgtctggcaaatgaataaataaataagtgactataatacaaagcagaatattatacgtgtcactgataatccgtattagagaagtttaagagagggacagaaagtaagcaaggaagctgcactatttctgtcatctagcactcactcctcatattcctctgaaaatcatcccttcctcattatctgtctctgtgattccttggaacagactcccagggaggacatgcgagctaaggcaagcacatagaaataccgcgtttccctggttatagcaattgcttcaagagtgcatacctgccccaagccccaccagtgaaatacaatcaccactaatcttggggattatgcttaagcaacaaaataataagttacttttcctgttgaatttggagctgagaggatgaaaacctagaacttttggccactgtcttgccaccctaagaagaaaggctatcagagaatcgaagcaactcacagaaggaaagcctagcaatggggggagaccagaccctaataatgttgtttgagcccctggccttagcaatgctaaaaggaagcatttttcagtcatagccaacaaattccttttgtgcttcattcaatgtgggctggatttttctgtcatgtgaaactgttttcatgaaaagactgaattagatttcatcactgaaaactgcagtgggtttttaaatacagaaggaattcaggtgaaaaaaactgtataaacaataagtgaagtaagaaaacagaagactacttctgttacaatgatttatatatatatatttcaagtttaagttcagatgaagactgaatagaatgggttagggttagctaagtaggctgagtatagcaaattggacagttcatgcttcacgaaggggtggctgctacccagctcaagaaaattactgcgatgtggaaactgacccaatatggccacaactcccaattttccaacaaaaagctcaatctagactttacaagaactggcaggagttaatagcaaaagaatgagtttatagcaacatacagaaccaataagcaagtctatgaggcaggatccagcagttagctttgtgactcagaggttacttaaatggccaagaaagtaaaatcaaatccatacaaaaggtatgtggacccaagtaaaggtttcctaaacaccacaaatatgtgggtcttctacggaacactatatgacaagagaaagaagagagaattgcggatatacagaaaaagcaatggaatgaatagctacagcactgagctcctaacacaacaatagctgaagagcagacagagtctatgctctcaagtcaggctgcctgagttcctacccaggctctcctactttgttgttctgtgactcctttgaccaagtgtcctcaagtataaaattctgctaataatagtgcctgcttcacagagttgctgtgaggagtgcatgagttgatacttattgtggttggcagaattttaaggtggccccaagattcctgcacccctggagtacacactctgtataataaatgagtgctgttttaagccactaagatcatacattcctccctcagtattgactctagcacccctgtggataccaaaatccacaggtgctcaagtcccttagattacatggcatactatgtgcatatagcctgtacctatcctcctgtatactttaaatctatacacttataatacctaatataatgtaaacactatataaattagttgttatactcttttttaaattttatattatttttattgtactgttatttttcatttcaaacatattttatttgtggtgattgaatctatgaagaacccaaagatacagatggctgactgtagtaatttattatgcagcaatagaaaaatgtgtacagcgataaagtacttagaacacagcttgacacataggaagccctcaataaatatcagctattattattggattctatttaagtgtacattctggtacatttaaaatagcattctaattacaaaaattcagtttgtccatatcatgtttgctagcacagaagatgcacaggcagacagatgcatcccagtgatacaaagaactagggcaggcaattgactaaaaaatactttctacaacacgtgtattgagagtgattttaaagtgattttgtagaaggaaactaattattgtgttcatctactttagactggaatccagttggaaataagttcaggatattcaatgatagtctactaacctaaaaacaaaatataacatcacaaagttatttgtaatacatattgggtcaacaaatacttagcagagaacaaagcataataattttactggtaaatgaaattatagttttatgtatgtgatagtattaaataaagatactatatttcagatgctcgtaactaagaaaacaagccataatacaaaatacatttgcatgaactcctatatagcacacgtacaaaacaaatagtataaatctgtataaagcaggcagcaaaatataatgaacttgaagtcattcccatggacatagccataatacatatagaaatttatttcagtttaaaaaactagttcaaagcacattgtaaaaataataaacatgaaagactttcaatgtaatgtgtacatatgccataaaagtacatatttctctgaacattagtaaatgaccagcaactgaaaatatgataaaaatagacttcaatgaatacataagcaggaaaaaaaatagagaggaaaaaggtatcataaagattttgatgtttagcctcaaagccaagtaaagcaagcccaaagcatgaaaatccacttactagcactgctagagtttggagttttctctttatcccaagcatttatcccattagccacacagtcaccattatctttaaaatacaccccctgcagcctaatcgctgtacaactcttgacattaagtttgaacttaatgttctgtcaatgcctctgctgctttctgagccataggctacaaattaataacttcatatgtaaagaggaaaagccccatgataaacctctgtgggctgcggcttgtttgtttttaaaaactaccaatgagacatgaaactttcatctttgttgagattttttatgttcctgcactccatcattaagagcagccttgcttgctacagcccaccaggaacaactaacatatacctgcttggtcttacaccctgcaacaggcacagaagatagaagctaaattctcatacgattacttggaataaggagcatgtgttactttacaatctattgcctaacataagtcccttttcctgaggttgccataagcttacatgagaaggtgtcctaaatctctcacagtaatgctgaatccgaaagggttcggagcactcattttgaggagcacagacctcattcagtgaaacaatgattaaagattctgtttcatattttattctaaaatcttacaagaagatacagaatcgcttccagaaaaatgttgaactccaacaacaatttaatagaattatagaaaatctcatttcaacacaagcctcagcagaagagcttccttgttatcttcaatgtaacacaaatcatctttttaacataaaatattaggaatcatgctaatttcacagctttgttacattagaaaaaaaagttaatggtcaattcaggctgcatccattttataatgtacagataaggggtattttctcataaatctgcttaaaaatgaatattaaagagggataacgtgacaccatgtcaaataaacaaataaggatgataaaggaaatatagctatttgaagaagattatttgaaataacacatgggcttccatagtcatatttagagaaacattctaactaaagtcagactttgtattaattaccacagaattcttaattacaaaatctaacatgaaggaataaaaaaacattttaaggttcctttcttcaaaaagtacacaaagttagcttgtcctacaattttcagtcattatcttatcttaataaatgagtatgatatttaacagcccaactctcctctttaatttgctcttgatgtctaatggcagcgttcaaccatgacaaagcaaaattactaaagttctcaccttcaagtttagaaagagctattgttgataggtgagccatgtactcacacaacttacagtggatttgctgaactctcttggtggcaccacaaaatatatttctgctcctgtcttcattacaaatcaaaattgaaggcttatacaaatttaagctgcattaaaaatattcaacaggatcccagcacattgggaggcggatcacttgaggtcaggagtttgagaccagccaggacaacatgacgaaatcctatctctactgaaaatacaaaaattagcagggcgtggtggcgcctgcctgtagtcccatagtcccagctacttgggaggctgaggcaggagaatcactcgagcccaggaggcagaggttgcaatgggcaaagattgtgccactgcactccagcatgggtgacagagcaagactccgtctcaaaaaaaaattcagcggggtgtatcttcaaactttgtgccattttttcccttgaaataaaaaaaaaattagaaactgggacagatatatttttcctatttgaatgctcatgaataaaactatattttatactctaaaattataataccttaacagcatggtggaaccactaacagatatggcttttcaatggatagtcactttagtactttagtataatacttaagagatcacacaatacataaaaataaacctctatctccaatttattatggtataagtattaccaaaattaaatttgtacaccacttttaaggtgtaatattgtaaaactctgcactacaaagaattaattgaagcaaactcgctcagataagatcattttgacctctgttcttcacgctagacattttcattacagaacaaaacagtcacaagtttactaatcctaaatgacttggcaaagccaatcctaatgacaaggattttgccgagtcatgtaggatttaagtgactctgtggttcctggtgagatacagtacttcaaaacacactggctgatcctcagaccaatgacctgacatcaagtcagatggaagtaactttgagtttcaaacataggggaggatgggtttttcttaagaatgaaaaaaaaaacaactcagcttttcattcagagcaatatattctgagaaacaacttatcattttggtaaaaacaggagaagcctaatcactcagcttctactctggagtataaaatagttttcacacttttagtccacatgaaaaatagctccgctgaatttctaattgctgtatttagtgctgaatttgtccttttatatattggccacctcctttttgaaactctcttcttttatagatctcaaaccacctgagatcccaaatcctgagtcaccttaagtggctctttctcttcatgtctttctaaaaatccttctcagtttattctgaaaagcagaaaacaaaaagcaaaataaacaaacaaaggcctacagccacgtttcccatttgaagaaccctgctctcataaattaggggattcttttttttttttttttttttttttgagacggagtctcgctctgtcgcccaggctggagtgcagtggcgtgatctcggctcactgcaagctccgcctcccgggttcacgccattctcctgcctcagcctcccgagtagctgggactacaggcgcccgccaccacgcccggctaattttttgtatttttagtagagacggggtttcaccgttttagccgggatggtctcgatctcctgacctcatgatccgcccgcctcggcctcccaaagtgctgggactacaggcgtgagccaccgcgcccggccaaattaggggattcttatcaggaagagaaagcagcacgaggagggctcacaaagggaagtgaggctcactagaacagccccaggcataaattgcaggggaaacctgaaatcaactgctcctaacccaaaacaggcacgtccgtcaagcatgaaccagcagcaagaagctccttggcatccagtcacaaggatctaatctcaactccaggtacctcggtagcctatttgcaatggtgactgttaaattctaggaagtcagcactgactcttccacctacagtatcttccattaaaggccaaatcaaatgatctccccactccaaatctccatcttaggtctccgcatcaccattatcgcagtctgctggagaatactgtgagcacctccatgtactgaacgtggaaagcaagatttacaaaaagaaggcagcacagttttgctttcaacgaatcttcaatataactatatttatttatatatttctttcatttatcctaccagacagggcggaaatgaagtcttaattatccttatttctccacatggtgctgtgaatagagtcagtacaaatttgttgaactgaaatttattaaactggttctttctgacctaaaagagccaagtaagaatcccactgctttgttttggccctatttgtccactttttcaatatgccatagaaataaaaggatgacaagtcaaaccaattttcccccacttctttactgcaaacaaataatactaaatattataataatataatactaaatatcacagtgatatagagaatgagggagagagtttcgtcccagaagaaggccctcctagccgactacaacagcaatctctagaaaaaccccctaccaaactgacaaattcaaaacagcaataccatatgatacttaagaggaagaatggttcacatttacaatttatgatagcacaaaggcactccagaattttatgttcagtgtactgaatagaaagcagctgttaggcaaagcatgattaaatgacttcaatatgggagaattaatcacattttcttatactcgggattctgctgtcactcaaaaataaagatggaaaggactgtaaggtcagtatttttaaaaacaacatcaaaatgggcacctaaactagtatccatctaaaaaatgtaaaatgactcacaggcctaagatagtaagattttattatccatctaaaaaatgtaaaattacttatgtgcctaagatagtaagattttattatccatctaaaaaatgaaaattacttatgtgcctaagatactaagattttaaaagcttatttgcactaaaagtttttaagaagcatccgttctgtattaatataattagtagaacatcaaaggtgcctccaaaaccaatatgtattttttaattgtgaaaaaaagtttaatactagcaatactaaaaaaaagttaaaaaaagcttaattgttaaaaaaaagtttaattctcatttaattttcatttcacagactaggctacaattctagcaaaacaatgcatttatcaaaatacatgatcacattatgccatggatgggaaaacagaaatataaaatacatgcagacaagaaaataaaagcaggcacttggattatcatactcctccagccagacgaaggtatagtgaactagagagttcaccacaaacaggaatagaataaccaaaaactccaatacatcaaacatgtcagaactgaatggctgcctgaaaatgaatgcccctgaaaacactatccttacttcctctgtttaccaggtagaaagtttgaggattctattttgtttctcatactctgtgtctactgtggtcaatcaaaaaaatctactgaagttaccgggctttgaaattacattcagaaaaaagcaagctggactgtgggataggtatttatcaatgaaatgctcccaaggacactaatgaggttttagaaaagaggaagccacttgctgagacattgccttcacggccaagagtctttactagccaattccatagcactcttcctatgaattataatttagaaaggcagatcccacccaattctagaaatataagttcaaataggccctaagaatctggtgaactccatttaaaaaatgatttgtctctgcaaaagaaaaaagaaaaagatttaactgactgcaaatgagctttactttatggaataccagacactacatgaggaaatctaggtttttaagacagagcaatgagcttgccaaaataaatcttcttccacaaaaaggttcataatagaaccctgttaaactctaaattttcctagttaatataacctggtatattatttataaacattataagcaatgttttcaggaaaaaaatttgctgtacaatacagcactgaattctatgtttatcattttgctataaagataattagaagtaattagtaacttggcagctccaatgaacaagacctgcttttttcagaaaccattaatcctttgattcttcatagaggacaagagaaatcggaggcaagtctacctgaaaagagagaatgacacgaatagactggaagaaaagagctccaaaatgtctggaggtgagacactgacattcattttcagcagccattcaatcctgatggactggagcttttagctcttcccattagtgatgaaatggccagcttaagatactagcacctaactggaggagcaaaataatggaagttgctgccctttctcttacccacttatattttacacttctgctttcccattcctgtcctaatggacatgtctaagagagttgtgaaaggtttcctagaaaaggcaccatgtttaaacgaaatttgccaggcagagctgaagaaactgtacgagcaaagcttggaagaagaaaaggaatcctgagttttaggggaaaggacaaagagtaaggcttttttttttttttttttttttttctgagagggagtctacctctgtcacccaggctggagtgcagtggcgcgatcttggctcactgcaacctctgcctcccaagttcaagcaattctcctgtctcagtctcccgagtagctgggtctacaggcatgtgccaccacgcctggctgacttttgtatttttagtagagacggggtttcaccatgttggccaggctggtctcgaactcctgacctcgtgatccacccacctcggcctcccaaagtgctgggattacaggcgtgacccaccacacctggcctaacagtaaggctttaaagagcctactcaactaatactgaagactgttagtaaatatgtgacctatggaatgatcacactctatagaatgatcacactgactgagagctctatattattttgtaattgaaaacatgagttgttttcaaaagaacttttaaataccaagatgatgcaagtttaaaccttccttgtcatggagaaaatgcccttccactccaataaactaaaagataatttttaactatacagaacataatgtcttgtttccacaaaatgctaaatactttgcaagattctccttgctgactctgaggtggcagaaagtgacaaatatcatccaaatcttactgatacaaggaaaatattttcagcacaaaaaaaatctttgtagcatcatcattgctctaaagaaaagctagaagcctgccataatgattagcaaactcatatagatatctccaggaaaggatttacaaaatgtcatcacatccttgtaatcatctaattatcaaactcagcagtgttgacaaagcacaagcccactcagctactgctaatgattattattcaaagctacatttctaccaaatcagaataacttacaggtagaagctcattagccttaggaaccaccctccttgaacactcacacgcacacgcacacgcgtgacacgcatacacacacgcgcacgcgcgcacacacacgcacacacaccccagccataactaggccttgctgaattgtcatttgctttcatgaccctccttcgtgtatatgagcagctttacgaattggttcaaaaatacccagcctttcaaaaataattccctatctagaaaaataccctacagacatctatatctagagaaataccctatggacattagtttgctaatgtcatagcaacagtgcggcaggcatcgtcaagctttggtggcttgaagaaacacactggcaatgcaacaatgggaaggagctaaaacgtaatgtaagtgacaatgcaacgtgaaggaatggaggcataaaggcaatgcaacaatgggaaggactgaaagcataatgcaagccatggaggaaaagcatacactcactgaatctccgcaatctacttgtcactacaccaggtgctaggaaaatggttacgaccctcaagctgcttgcagtctatgcaagcagtcagccagctccaggaacgtggcatgagatgaagcttgcagggtcctcaaatgccatacttaaaagccttgatttcatacaaaggcagtagggaatcaacagacatctttttgcaagagattaaatgatcaaatctgggttttttttcaattatctctaatggcaaaatataaaaatgaattgagactcagggaaacagtgagaggcaaggatatgagttagaggccatttaggtgagatcggaaggattttaataataactgggacagtgacaaaacaatataaaaataaaacaatagagtcaagagatctttaaaagcagcataagcagggcatacagaagtttgggggaagaatcagaggtattcctgatattcctggcacggctggctcaggagattgcaacgtcaagagagaagacagcaaaggtggagaagcagtatgctgtgcggaagaaaaggcagagtttaggcactgcacacgacgaatctgaagtaaaaccaggtcacatagatgaagatttttgttggtatatagaaaatatgggatgagctcagaaacacaggcaggcaagtaaagccatggcagcaccatattgtcattcaacaggtaaccagagacaaatcagcaaataacttttaaaacaaactggtgagacaggcagaaggacaatgatgagcaggttaaaagacttccgaaggttaaacactatcacacctcaaatctgcataccttgagatttaagtgggtattgttggttttggtttgtttgtttttcgtttttttgagaccgagtctcgctctattacccaggctgcaatgcagtggcacgttctcggctcactgcaacctctacctcccaggctcgagcgatcctcccacctcagcctcccaagtagctgggaccacaggcatgagccaccacaatttttgtattttttgtagagatgggttttgtcatgttgcccaggctggtctccaactcctgagctcaagcgatctgcccacctcggcctcccaaaggactgggattacatgtgtgagccactgcacctgggcaaagtgggtattgttccataaaatcttggccaaatgggaaacaagaaaacccacagtatagtcacttcttattacagaagacttttgaggcccccaaacaatataccttaccaacttctgctctaacctgaaagacccacagccactgaatgattgtgaaggaggaaaaacagaccctaggacaccaaccagcaagtcacacacgcctctgcagatgctgtattggctgaagaaaatgctgccacccatcggggaaggaaaggaaattctattaaggatatttttaattctgatcctaattcaggtgatcctaattaaacagctctgcataaacagtgtcttgataaatttttcctataagcatcaaaacgaaaaccaaatgtcaatcaaaacttgaaatagcgcccatgactgccaagtctggtcacatgtagctctaatgcttttcttttacttgacaagtatttattcaaaaacaacattttaaaattatttgcctatgtcattaatatcaagtataaatgttaaggtcaaataaatatcactaaaagaaaaagaggtgttaataaggccaaagagtattttcttatacactgcatatatagtttatagcatagaaaatgtttaaatctataaatgcatgtatctatagaatcatagggaaaagcacacccaataatggcttgaaaatgataaagactcaatctggagggctcctgaataattaatgttttaatatgcagtactaaaagattgtagaatgcagatttcaaaaggtaccttaactccatgcaaattccatgtcaattatctttattttcacatacagttgtggcaacatcagcacagaatcatttgacatgaataatccaccctcctcccactcaaactaccagcatttatttagatttgaatatatgaaggacagaggtatgtaaggcatgatgtaccacctggataaaaatagcagaaatcctgattaaataatttacagttttgcctagagcaatactttagtattagagaatattatcaaatattcttatttccatcattctggattttgctaaggcttataatggtccataattagggctctaacagagaactaatataacacagaatgcagtatggtggaatgcagaaaataagaactctggaatgaagaaagccatgttaaagctctgtctcttttacttaaatatagtgtgaccttacgcactttctcatctacaaaggcacgatacccataactcagagggctactatagaagataatgtgaaagtacacattaaagtacttggtagaataaaaaattaaaacaaaggagtgcggcactaggaaacttgtgatcaatccgccaattgtcccttgatctgttgatgtaagacaggtaccagtgtctaatactcatttgcttcctggaaagtatgggccaaaaaatgggaaatacaagacaaatccacatactcaaatatgtaatacagcagttctgtttataactgagttatctgaagggaaggcagacagctggtttgggaagccaaaatcatttaaacacggacatacagaatctctgaattgaaactcatcattagacaagctaatctagtttcaaatgtcgaacgatactattctgtaacttatttttaattttctgcctttacacagataggcttcaatataagaaacagatattgctgaaaggttgtctgtaatttaacttctgtttgctgtatcacattttcacttcaacttagcagctaagttcttgagcacttgggcatcaactaacagaaagggcattagacagaactcagaagacttcagttctagctttcttcctgtcactgggtgactacttccccctctctaagccacaactgatgtattctggagaaagggagaggagaaaaaatgggaaggctatggtatcagagagtttctgtgatctcttcagccctaaagttgtataattttattttgcttaaggaagaaaatggggacacatgacctattttcatgaaatttatagtctaagtgggaacctaagaaaaaaggacagacaacttagaaagtaggggatagtcacagttgtcaaatgcttggcatagaaaataacagtgactactgattttacaaaagggaaagctcaatcctaaccaagtagatttcaccaaagatctgagtagaaaccttaagaataagcaggacctcaatagagagggcgagggaagataaactacacccttccatgatgcaccagaaatatcacaaactcacaaattcaaagagcagtttacatatcatctaggcctaccttatagagacaacccatcctgacacgtaattctaatcctcagtgaaactcttccaggaagaagtagcttccagctgtaccaggacacgctgatacgttgttggaacgctctggttataaagctcttctagataataaaacagtatttttgtcctttcttcatcatgctttgtaaatagacatttatttgaatatgtctctttaaacatgtaacattaggtactaaacacagaaactgtaatgaaaatcaacttttgaagatagaaggaagactcttcctctttgattaagatgctttaaaagaatctggtttggcgaagccatccccaaactcgcctgcttacctttatgatataccaagtcatcttattttccacatcaaatggcaatgtctgatttttgcccctaaaaaaaacactctgtttctgcctattacaaaatttaatagagcagtttatcacagtttttcatcactcttaatattatatctctaaaacatatttgttttttcctcccatgaaaggtccttcttatttgcaatagaaacagccaaatcataatttaaagtttgagggcaataatccacaatctaagaaaaatcaaacaaaaactttgaacctgagttacataaccacaatatttctaatagaaaattttatctttatgtttcatttcaaaacaaaataacaaaatataacacctttaattaagaaccaaaagcatgatagcacatgtctgtagtctcagctactcaggagactgaggcaggaagattgcttgagcccaggagtttgaggtcagcctgggcaacatactaagaccctgtcttcatgggtttttttttttttttttgagagagtttcactcttgtcgcccaggctggagtgcaatggcacaatctcagctcgctgcaacctccccctcccaggttcaagggagtctcatgcctcagcattctgagtagctgggattacaggcatgagccaccacgcccagctaatttttgttgttttggttttttttttttttttttttgtagagacggagtttcaccatgttgcccaggatggtcttgaactcctgacctcaggtgatccacccaccttggcctcccaaagtgctgggattacaggcgtgagccaccgtggctggccaagaccctgtcttttaaaaaattaaaaattaaaggccaggcacggtggctcatgcctgtaatcccagcactttgggaggccgaggcgagcggatcacaaggtcaagagatcaagaccatcctggccaacatggtgaaaccccatctcaactaaaaatataaaaattagctgggcgtggtggtgtgcggcctgtagtcccagatactcgggaggctgaggcaggagaatcgcttgaacctgggaggtggaggttgcagtgagctgtgatcacgccactacactccagcctggtgacaaagtgagactcctactcaaaaaataaataaataaataaaataaaaatttaaaaaaaaaggaaacagctaagaatgacagtttaaaatattaagacaataaagtccctgctttttctattttataatttctttctctctttagtaaaataattgcagttttcttactataccattgagataaaacatttttaaattattgaattaaattggctttagagtaaaacaaaaattgactcaaaaaacaattactgtgtgtgtactgtgctcagaaatgtgaccagcaatgtaaaccgacagaaccaatggctttttagaaaataacaaagtatttccgatccttttttaagtagagaattttctcccagcacatcctatttccaattgtgtgcaaaaaaccttccagcttacaaatgttaattcaggggttggcaaataaaggcccagaggccaaatctggcccaccacctgctcagtctgcaagctaaggatgttttcttacatttttaaatggttggggagaaatagaaagagtatttttgaatatgtgaaaattacatgaaaaatcagtgttcagtgtcaatgtttctttggtatacagccacacccattcattcacgtattgtacacggggcctttcaggctacaatggcagagttgagttgccacgataagcatgtgaggtaatgcatatgttaatttgctccatttagccactccacaatatatacgtatttcaaaaaatcatgttgtacatgatatatataatttttatttgccaatttaaaataatttttttaaagaagcagctaccacagagaccataagtagcactctctttacacactacaaattgtcatgaggcagttgtgactcacttttgtctcctgcctggaaagcctaaatatttacaatgtgagcttttagagaaaaatgttcttcaaacctggaataattaatatagttattcatcattccttgaagaacttagtataatggcagtctctatgagtcagagctatcaagtaattactagatttcttgaatcttatcatgatattagtgtttctttttgtcaagtctcatatatttatattatgtattaatttttaaaaatacattatctgggccagctgtagtggctcatgtctgtcatcctagccctctgggaggccaaggtaggagaatcacttgagcccaggacttcaagaccagcctgggcaacatagcaagaccttgtctctacaaaagtaaagcaaaatattagcaaggcatggtggcacacacttgtagtcccagctgggcaggggaatcacttaagcctaggagttcaaggctgcagtgagctatgatcacatgactgcactctagcctgggtgacagagcaagatcctgtctttaaaaataattttttaatgaaatgaaataaaatataaaaacatttatcaaagtgtgctccacaaaacggaaaagggatactgttttctcacattccttcaatccgtcaaaaattaaagacctcctgcatacaatgaaggttgctaggaattcaaaataaataagatgtaattcctggctccacgtaattgcattctagtagagagacacagtattccagtagattgttgtcactaaaggaaaagccaaagcaatgacagtaacctttgccatttcataatgtcatacagacatttaaaaaatatcacctctgtctgcattaatggcaagttatacacttaaatagataaagcaacaaggcttgacaaacacatttatccatcaatactttcaagcaaagcattagccttacataagcaattaaccttgaccaacacgggtataaacaaaaatgctgattaagaacttactaattatccttcccaacttcagaagtttagctggcatctggtttttaactatgataaatatacaccaactcatcataggttattaacacataagtgaaaagaaatatttaaccaaatggctacgaatgaagaacacgataaacaaatatcatcattaaaaatccaaacaatgagttgttttctttgaaagcccaagtgtcctacaaacatcactttatttgaaggtagagaaatatttctgagaataattgtctcctgaatcaacttcgagattcaatctgttgtaataaagacaacatatataaatcatagatgcatgacaccgtttcataattagaatgccaggatctgcatgcagttaagcatcctagctgtttgcctgctttacttaacaccagaagagaagtataatcccaacagctaagtattctagcagctgttgtgagcagagtagagagatgtggcatgtagcagtcaccaccacacgtaaacacacaagcaccccggtgactggaggttagcaatcctggtgtgcctgctcgcttttagtgttaaatatttaatggcatatttttccttaatggaacccaggcacatctgatcagtcactgggatcatttagtaatgcagtcaaagttatcatactgccatttcacatcaactttgtaattagataatccatcactttattaattcaaaagattgctttctttactaccttatagcaggctacagcagtgaaacccaacagagctcatcaacaaaaaaggctctaaaatctggtcctacatgaacttgaaaccctcaagtgacaaacatatacacactcctgacctttcaaaacaacagaggtaatactcttcccacaaattagcccaccaacaacaatgaagtaacagagcaccagtgtatccagaatgagatggttaacagaactgaaaatttaagcttaaaagctgaatataacatgatcaactttgttctcgctttttattgaggtacactgttcaccagaggatgaaaaggatacacaaaaaagtcatttagtaattttccctccatgctgatttatatacttcactaaaattatgagggaggttatagcagaatatcacatccattatttatgatcactctaaatgtaaaggcacataccggccaaacacaagcatgtaatcttgaatatagtatcacgattttctcttgctttatttctaacataccacaaaatattaaatcgcgatttcttatcgtattgtgaattggtaagattctcgttttaacaccttcacagcttctccaatttaaaaaaaaaagaatcctccaataaaaaataatttactcagaatgaaactgtaaaatttaaatatcatagtaccaaaaacaccctctaaaatactcactttccaatctatgcaaccagtacatattgcaaaaccagctacagctaatataattaaaaattagattttggaaaagcaagctccggaggtcacatacgtgccctaaagaacaaaaataacatgctaccaggagaattattaatttgaaagaaagaaggagagaacatcttctcaaacagatgtggaatttctaatcaaaaaaattctgtggcagttgcacaacattataaagttcagcagtactttgcagagctccggaaacactaacaatggcatatgttctgtggtcaggaaggtcacttttattcttgttgccgccaatctaatgcctgtttttgaaacattctatgcaactagtctattttctattttattgttcagattttaccacatttctaatcaggctgccaaataaatttttagaaaagaaagttataagcccagaaaaaaaaattatatatttttctagaactctgtacaataatccctaaagaaatcttttatgtgcataaaaaaaatctcaaaacaaattctactgaaattacgttgagactatcaataaccattgccaataattatcaatggacattttaagggatagaatagagaaatacaatacattccatggcgtttcaattaattagaacatgacaactgaagcacgcttaattccatccttttaagatgcatgtgtgagaaagatttccatcatcaagggaagcctacttttacatttcccacgtgaaattccaagaaactactttgataccatggagtttctaagaatgttggcaacagtacatgatttctgtccacaatggctatgactgaaactaagcctcaagaaaagacaccattgcctgtttgcaaaatttcttctcaacaaaacaggtaattctcaggatctcaagagacaccagcactgggcacaactgtgagcaaccatctgagactctagtttacaaacagtggcagactgcgctcttggctagatgacagcacagggagatttaaaacaccaaagttctataatccaataaaaataaagctgagaggtgggagcaacagtagtagaaattaataatatgtgtcagacactactaagtacgttatagttgatcctccttgaaatctatgaagtagatattagtatttccatttacagataagaaaattgagatggagagaattttatttacttgactgaggaaaatgacctaaccatcatattattcagcctcccatttaaatttggcctctctctaactgtaatttttgtttgttttgagttggggtctcactccgtcccccaagcagcactcatggttctctgcagtctcaaactccggggctcaagcaatcctcccatctcagcacaccgagtagctaattgtaattttctgagtttcgaaggatatatttatgcttaggagtatatacattttctatatttgtagcaaatgtttcggacccaatcagtacaccgaatcacagcatttgtcatgccatgataaatttttttgagacagggtctcactttgtagtccaggctggagtgcagtggtgagatcacagctcactgcagcctcgacttcctaggctcaagcaatcctcccacctcagcctcccaagtagctggaactacaggtgtgtaccaccctgctctcagctaattttttttttaagtttttttgtaaagatggcatctcgctatgttgcccaggctgatctcaaactcctgggctcaagtgatcctcctgcctcggcataccaaagtgctaggactataggagtgagccattgtgcctgaccaataaatccatttcaaaatctaacaggtgctgggtggggtggctcacaccagtaatcccagcactttgagaggccaaggtgggtggatcacttgaggtcaagagtttgagaccagcctggccaacatgacaaaagcccatctctactaaaaatacaaaaattagcccggtgtggtggcgcatgcctgtaatcccagctactcaggaggctgaggcacaagactcaacttgaaagccaggaggcagaggtgcagtgagccgagatcacgctactgcactccagcctgggcaacagggtgagaccctattcccaaagagggggaaaaaaatctcaaaggaaattttgtttgaaaatggaagtggagatttaaaaaaaaaaaaaagtgtgtggtagagaggagaaacagcttgtagagatggagacatacatcttctcttctctaaacaatgtgaaaaagagccagcagagatgaaattggcctttattttttatatgcatataaataatcacatctcctgtgttcatctgtatatccccggtgcacttcctatcctttcaacaccttcattgctgtctgtggaaattaacacctttcattgctcacactttacacttttatctccgttcagccacacactccccagggaacatacaatctaagttttttaaaaaaaacaaaactatccaaataaagctgcaagtaatttgctctagcctctccatccaacagattatcactcagcatcccctcctctagagaaattctgggagtatccctaccctcactttctattacatttagtgcaaaacaaacattttaaacatcaagctcttattctaactctactgtaattactaaatataactgaaatctgtattccacaggtaacaacttcctttgaaaaccttctccggaggaggttgatatatttccctcaggaggttggaggaatcaacaccctcactccccaacagcatttctagaccactgtatatcactgtttcccaacaccagcctcgcttttgaaatttacgtcagtttccacttctgatatgaggtcctccttgacacccacccctagaaaaattcctccttcctatggctcatgttactcagtttttacagccaggcaacaaattcataagtggacaggatatatctatatagaaaactccacaatcaaactccaattgctattagggtgtgtgtgtattaacactggtgctaagagtcagagtcagactaacactggtgctaagaagtggggtgaaaaggaggaatatctgggaatatgaccgggaaaattacaagtaacagaagaaattttccaggtaaaattaaggcttacgcagcagatgcacgttcagcattgagaacccggtccgacaggaaagacacaccatttttccgccagaaactccagtgttcaaaatacaaactgccaacttttcaggcaataatcatgagcttccattagaaaaagccatcagctcaccagacgacgaaatatgctctcgggattaagaactttctcatcctccctgagccctttcctttcaggggaagtgcaagtttgataaagatatgcatattcttcaagtaagacttttgacctgctgaagttttctgccttgatagataattttgagatttagaattagccacatacttctacaaccctgtgtcaagagtattttgtacacactagacctgcaaataaataaataaaagtctgctgtacttgctaagcaaattcagattcaactaacaaacacctctcagcagggcaagagacttggtaagaaaagactaattctaatgaaggtttaaaactccgaagagaaagaacatctgtgtgaactgtaagtattaaaaatgacagatataaaatgagtctgaaaattagggaaaccagctgatagaaacatgaagattcattctactagtccctctatttttgtgtgtgtttgaaaatgtccataatttaaaagtcaaaaaaattaagacataagcaattttagaaaagctctcagaattccatatgcctttcaatgaaaattagatggtctaaaactggccgggtgcggtagctcacgtctgtaatcccagcacgttgggaggccaaggcgggcggatcatccgaggtcaggagattgagaccagcctggccaacgtggtgcaacgttgtctctactaaaaatacaaaaattggccaggtgtggtggcaggcgcctgtaatcccagctccttgggaggctgaggcagcagaatcgcttgaacccgggaggcggaggttgcagtgagccgatgttgcgccactgcaccctagcctgggcgacaagagcgaaaactccatctcaaaaaaaaaaaaaaaaaaaaaagatgggctaaaacataagcttagtatgtctattatctgcacagaacctgaatgaatgtaaatgagaggaaccaaaagaaaaacaaaaaacaagatcttgtttattgaggccaggtatagccagccttgttgacagcgtaaattcagaagtcagcagcttcctctgtatgtacaaactgtcagtcagggatagttgcatgttgacccgctttccacagcctaatgaactgacttttgaattttcgctgtgaagaaggctggctttacctggcctcaataaacaaaatcctgttttatgttatttttttatggtgcccgtttcttctctttgattaattaattttataccagagtaaaatgaggagaggagcagtagactgggataaaaatctctgcccagggatcttcacccagttcccgtgtgcttgatgtgacttgcaccatcacacaccgtcaacattctgggctcagtgactcatccctgaaagctgcaggatctatttaggttaatttaggatctttcatgaacaaggaaggagaaggagtcagggggcgggaaggagggagaaggagtcgggggagcgggaaggagggagaaggagtcggggggcaggaaggagggagaaggagtcgcgggggcgggaaggagggagaaggagtcggggggcgggaaggagggagaaggagtcgcgggggcgggaaggagggagaaggagtcgggggggcgggaaggagggaaaaggagtcgggggggcgggaaggagggaaaaggagtcggggggcgggaaggagggagaaggagtcggggggcgggaaggagggagaaggagtcgggggggcgggaaggagggagaaggagttgggggggcgggaaggaggggagtgatttaaggacaaatttataagcagaaaaatacaaattaaaaacattaacaaaactttcaccagaaagtacagaagccataggttattggctgctttcatctgattattaacctatattttaatgcagaagtgacacactaaggccaattatgcccaaaaatctcaaaactgtgtattttctagcaataacaaatattatgtggggagaagggtaagcattatattaaaaattggtacacttaatcatagcaacagaattttccccctatacaacatggagataatttcattataaaatacatgagactaaaatcttcagaaagaaagaagaactaggatagtaattcacattttacatgtagcaacagaaagtattttaaaatatttttcatggatattaataacatcagtaattatcactggaacattttccaacaatagaaataattaccacagaatagccacaaacttaacactaggaatgaggtaataatcatcataaggtatatttttatctttcagtaggtgttcgtgtttatagtgttgaacatgaaaacagccttgggcacggcacacgatactactacaggttataattttcagaagcatatgaaatagatgagaaagttttcagatgcactgtaagaaatcagtaaattttgaaatcaattttaaattatagataaccagaatataatgctaagatgacattaatcagaaaatcataaaaatgtaccatacagaataaaaatacatttgagaaaaactggaataaatctccagcaatcaaaccaattacatttaatttttcagaaaacagtaaattttaaaacatgccttaaaatattaatggcataaatatatcttcaaacgtgtgcttacaaattacaaaataagtggcaaaattgtcaaaagtaaagttttacttgttattaaattgtgatcaacattaaaacaaatgcaaacacacaatgtgagaaagcgaggacagcagatccatagcagtgagggggtgtttctgtcatccctatcccagggtaaatatcaagaagcaatcatttcatgcctatgggctagtgaagaaaaaaaaaaatcaatcatcgcactcttcctccctaggccaagataaaccctcggaatcatttaaaaaaaaaaaaaatacttcaggaggccgggcgtggcagttcgcgcctgtaatcccagcactttgggaggccgaggcgggtggatcacctgaggtcaggagttcaagaccatccgtctctacaaaaacaaaaaaaaaaaaacaaaatttagctgggcgtggtggctcatgcctgtaatcccagctactcagaatgctgaggcatgagactcgcttgattctgggaggcggagattgcagtgagccgagatcgcaccactacactcaagcctgggtgacagaacgagactctgtctaaaaacaaaaaagaaaagaaaagaaatggatttcaataaatttttcatttcaaagacaggctctatgcttaaacaaccaccataaaactcaatgaatgcaatgcaacggcaaacaagtccattcacaaaaaataatgggatatgctattttcttctgagaaaagaaagcatactctttcttccaagggtacactttgagaattcacaatgaacatactcaggcaataacaagaatattaatcaaacagaaaaattcatacccttctcaatgcacacaatacattctctcatgctctactcactatgataaggaagtaatataaggcattaagggtcttgaatttcctgtcaagattctcgacatttttgtaactaacaacaaaataaggagcaaatggttgatgtatggaattagcaaagagcaaacttaacacttacttttgcaaaggcttcaaaaaggtcaaaggcaggtggcagctgagaggcatcctgtatttcttctctcatgaaatgttgaaatgtcattacgagttgcctgaggccctctttcttatcttcagtcagtttgttaatatcttttttaaagagaaaataaatagcacaatctcaaagtaaacttctgaaggataattttcaagtgttcaatgctggctgttaaaccagatatttcctaccttacattggattttgacaaagagcaaatacatattgttttatcttttgacaactaaatatgatgcatatgttatcaattaaattctgccaaattttgtctgcaatgtaagatcaaacacctatcaaaacataagtacgcacatatatgaaaaagcattaaaaccaaaatcactgagattgtgtgttaccagattttctacatcattctgtacacacatacaaacaattatcagttcttattaagtcagtaaacttaagcagacttttccatgaaataatttacaactaggtcatgactaaactaataaacagcatcacctctaaggcaaaaagacagaaaataagaactaaaaagttcagataaagttcaaataggttaaatttgtcatatggctagtacatcatgaatagaacagggatcaagcacagcaatttcaacttcaagttatctgagttgaataaacaagataaaggagcctggcgccgtgactcacgcctgtaaccccaacactttgggaggccaagacgggcagatcacttgaggtcagtagttcgagagcagcctggccaacatggtggaaccccatctctactaaaaatataaaaatcagcagggcgtggtggtgtgcgcctgtaatcccagctactcgggaggctgaggcaggagaatcacttgaacccaggaggtggcggttgcagtgagccaacatcgcgccactgcactccagcctggacaaaaagagagactccatctccaaaaaacaaagacaaaaaacaagatatgatgtggcatcaacccaaacagaaggagatggttctaaaacaaaagaagaagaaaagttctaacgccaatactacccccttaaatatcattttcaatcataccacaaatggggtgttaaggctgaaaggatacaacaggtcaattaataacatgtgagagcatttcacttaaggtcatgtgtatgacactagtactgagtagggctaatgtgaagagtaaaacccatggtaacagatgttatttacctagcagtaatataacaagaaaatttgaatactttgctgtcttttaaaacttgaaaagatacatcaagttgaactacagcataactctgttgcttatgtctatgcatatcctttagattacttattcaacagaataacccaatgatttctttttttttctattttatatgcttgttaatttttttttgatggtaaatatatgtttttttattttatttattttttcttttattattattatattttaagttttagggtacatgtgcacaatgtgcaggttagttacatatgtatacatgtgccatgctggtgtgctgcacccattaactcgtcacttagcattagatatatatactaatgctatccctccccactccccccaccccacaacagtccccagagtgtgctgttccccttcctgtgtccatgtgttctcattgttcaattcccacctacgagtgagaatatgcggtgtttggttttttgtccttgcaatagtttactgagaatgatgatttccaatttcatccatgtccctacaaaggacatgaactcatcattttttatggatgcatagtattccatggtgtatatgtgccatattttcttaatccagtctatcattgttggacatttggcttggttccaagtctttgctattgtgaatagtgccacaataaacatacgtgtgcatgtgtctctatagcagcatgatttatagtcctttgggtatatacccagtaatgggatggctgggtcaaatggtatttctagttctagatccctgaggaattgccacactgacttccacaatgggtgaactagtttacagtcccaccaacagtgtaaaagtgttcctatttctccacatcctctccagcacctgttgtttcctgactttttaatgattgccattctatctggtgtgagatggtatctcactgtggttttgatttgcatttctctgatggccagtgattgtgagcattttttcatgtgttttttggctgcataaatgtcttcttttgagaagtgtctgttcatgtccttcgcccactttttgatggggttgtttgtttttttcttgttaatttgtttgagttcattgtagattctggatattagccctttgtcagatgagtaggttgcaaaaattttctcccattttgtaggttgcctgttcactctgatggtagtttcttttgctgtgcagaagctctttagtttaatcagatcccatttgtcaatttttgcttttgttgccattgcttttcttaaataataatttattaccatgggaacttcagatcccacaaccttatataaatctgtactagatcatcttcttgtctccatccagaagtattaaactgtgcagcaaatttactgtatgtgccctggctagttttgagttgaaatcacttacaaccttaacgaaaaggatctgcgccaatacaaaatcaaaacgaaacctacctttgcttagcactcagatatgggaagctttttaagtcatcacaagaaggtggctacctacatggtagtttcagagaagaatgatgcttcacactgccacagagactgagtcatctgttccttctaccttccttaatgtctaaaagatcagtaaccctaaaagctctgtggaatccccctgttcactaatcactcttctctgacatcaaaaagaaaacagaacaggaaaccaagagacagaagaagggaaacagggaagaaaaaaagaagaaaaatgattttgtcaactggactaatggttacactaccccatgtaacctgaacatcttcatggcgctttactaacccttatcaggacgaagctaccctggaataagtgaaataaaccagtgtgacagttgtatataaaaataaattttgttaggtttgcatcacattataaagaaacagaaaaacatagttaaaaataaatccattcaccaactcagcaaacaaattatagaaacttttttaagatgctgatagacaatcacttacttgactccagatcataaaatgagtaaagcttctctgattctgaaggtgctccatccatctgtgaaggaaaaggggaaaacgccaataacaatttcaagtgttccaatatataaacaaataagtttgagtacctttgtatatttaaatgaaagtccatcaaaaagaacattttctatatattctttctattcatcactctcattagactgaattaatcaacaactttaaaataaaaatctaacttgtatcttcactcaacagtttaatctccaaatgcaaaactcttgtacaaaaagttcccatatttttatattcataaaaccctctataaaatcgtgtaccggccaaaagagtcagtaaacaataggaaaaggtggggcatggtagctcacacctataatccccgatactttgggaggccgaggcaggcagattgctttagcccaggagttcaaggccagcctgggcaacatggcgaaaccctatgcctaaaaaacatacaaaaattagccaggcatggtggcatgcacctgtagtcccagctactcagcaggccgaggagggagaatcacttgagcccagcagttcaagcttgcaatgagctatgattgtgctactatactccagcctgggtaacagagcaagtccctgtctcaaaaaagaaaaaaaggagaaggacaaatcgggagcctacaataatttgagaaagatattcacactaaagatgggtaaaaaaatctaaaaggcttcaccacagcaagatttcacagagtttactgttttgccacttatgaaaaagggccgaagaaatcacttcagtgaattttaggaaataagataagtactcttccagtcaatactaattatgtatgtgtatcttccttgaagaggaaagtagaaaatgacatgctcgccctgtgcattagtttacaatacccaagttataaaggcaatgtaacagagattactaccatctcatacctcagagatagaacctcctccatctttattcccacaagaagatagcagggccttcaaagagagactgtgtatttcttcactgctacagattccatgattaataggaaaagaacaaatttttttgtctaagacactccctggaataatctaccttctacattaacatggggttaatttcagccttaaataggaataacacaggcatacctcattttatcacacttcactttatagtgctttgcagacattgcactgaagatttacatcatcgaacaagtctgtccataccatttttctaacaacacgtgttcactttgtgtctatgtgtgacattttggaattctcacaatatttcaaacttttggttattattatatctgttactgtggcctgtgatcagagatctttaatgttactactgtaattgttttggggtaccacaaaccatccccatataagaccacaaacttaatcaataaatgttgtgcgtgttctcactgctccgccgaccggcttattcccactgcctggctattcccctatctcttccctctcctcaggcctctgtattctctgacacaacaatattgaaattaggccaattaataactttacaatgacctataagtgaaaggacgagtcacacatctctcattttaaatcaaaagctagaaaaatgagtaagcttagtgagaaagaaatattgaaagctgatatagaccataagtcaggcctcttgcaccaaacagccaagttgtcaacacaagggagagttctgaaagaaaatgaaaagagctactcccatgaacacatgagtgataagaaagcacaacagtcttattgctaatctagagaaagtctgagtggcctggatatagaagatcaaaacagccacaatattcccttgagccaaagcctaatccagaggaaagccctaacttgcttcaattctgtgaaggctgagagaggggagaaaattgcagaagagaagctggaagttaacagaggttggttcataaggtttaaggaaagaagccatctccataacataaaagcacgaggtggccaggtgcggtggcttacgcccacaatctcagcactttggaaggccaaggcgggcagatcacctgaggtcaggagctcgagaccagcctggccaacatggtgaaaccctgtctctactaaaagtacaaaaaatttagctggccatggtggtgggcgcctgtagtcccagctactgaggaggctgaggcaggacaatcgcttgagcctaagaggcggaggttgcagtgagccaagctcacgccactgcaccccagcctgggtgacaaagcaagactccatctcaaaacatacatacatacataaatctaaaaaagtgcaaggtgaagcagcaagtgctgatatagaagctacagcaaatgatccaggagacctaactaaaataattgaatttggctacactaaacaacagatttttaatgtagatgaaacagccttatattggaagaagatgtcacttaggactttcatagctagagagaattcaatgcctggcttcaaagaacaagtggacttttttttagggactaatgcagctggtgactttaggttgaagccagtgttcatttaccattcctaaaatgccagggcccttactatttgtggtaaatcgactttgcctatgctttaccagtgggaggtcaaaacagcaacatgaaccggagttcagaagattcagaagaacttggttccaaccttcatggataacactgaggggtcaagacttcagtagaggaagtaagtgtagatgtgatagcaagaacgaaggagctggaatcaagatgaaaacctaggaaatacccttctacacatcagtcttggcaaagaatttatgatgagtcctcaaaagcaactgcaacaaaaacaaaattgacaagtggacctaattaaaataaagagcatctgcacagcaaaagaaacctgcaatggagtaaatagacaacttacagaatcgaagaaaatattcgcaaactatgcagccaacaaaggtctaatatccagaatctataaggaacttaagcaattcacaagtaaaaaacaaacaacctcattaaaaactggacaaagggccaccacagtggctcgcacctatataatcccagcacttggggaggcctaggtgggagaatttcttgagcccaggagtttgagaccagactgggaaacatgatgaaacttcgtctttccaaaaaaaaaaggaaaaaacacaaaaactagcggggcgtggtggcatgcacctgtggtcccagctactcgggaagctgaggtaggaggactgcttgagccccagaggttgaggctgcagtgcgccatgatcatgctactgcactccagcctggggcaacagagtgagaccctgtctcaaaaagtgaaaataaaaagtgcacaaaggacaagaacagacacttctcaaaagacaacatacaggtggccaaaaaacataggaaaaatgctctacgttactaatcatcagagaaatgcaaatcaaaaccacaatgagacaccatctcataacagtcagagtggctattattaaataaaaaaaaaacacatgctggtgaggctgcagagaaaagggaacacttatctactgttagtgggaatgtaatctagttcagccactgtggaaagcagtttggagatttctcaaagagttaccattcaacccagcaatcccactgttgggtatatatccaaaggaaaataaatcactctaccaaaaagatacatgtactcatacactcatcacagtgccattcacaacagcaaaggcatggaatcaatctaggtgcccattaacagcacaatggataaagaaaatgtgatacataaacactatgaaataccatgcaaccattaaaaagagtgaaatcatgtcttttggagcaacatgaatgcagttggagggcattatcctaagtgaattaacataaaaacagaaaaccaaataccacaggtttttactcacaactgagagctacatattgggtggacatggacacaaagatgggaatagcagacactggggaatacgagggggaggtaagaagcagggagtgggcaagagatgaaaagctagctactgggtaccatgctcactacctcggtgatgggatccatcataccccaaacctcagcatcatgcaatatacccatgtaacaaatctgcacatgtaccccctgaatctaaaataaaagcaaaactttttttaaaacagagagaagtagagcctaaagaattataaattaactgattaaaaattaactgattttctgcaatctcatgataaaacttgaaaagatgaggagttgcttcttatgaatgaacaaagaaggtggtttcttgagatggaacctactcctggtgaagaagctgtgaggcatcatatgttacagtgaaatcatttgcgaaaggaagaggcaatcaatgcggcaaattcgactgttgtcttattttaagaaattgccacagccaccccaaagttcagcaaccaccacttgattagtcagcagccatcaacatccaccagcgaaaagatgatgatgcactgaagggtctaatgatccttagcagttttagaaatatattttttaattaaagtatgtacattgttctgttggcataatgctactgaacacttaatagactacggtataatgtaaacataacttttatatttactgggaagccaaaaaatttgtgagactcattttattgcaatatttgctttattgtggtagtctgaaactgaacctgcaacatctctgaggtataccggaaaatgcaattgcatatgtttatttaaccaaaacccagctatatttcatgagttttatactcacaagtttgaagacaactctgccaagaagtcgaacggagtctggaggatatctgggtttgcagcttttaaggcatttgcattcccgcttgtggtctggccaagcttttttctattaaaacaagagtggggagaacataggtgacctaaaatttaactttcatttatactggttttgaacatcaagagtcataaacattaaattttaatagtccaaatgtaactgcacaatagaaaataaaagcaatattctaaatctgaaaataatccaggatgagtctttgccaaatatgcaattactatgcaaggacattaaaagcctcagcttcacctctgtgctttcatttgtcccctggttattacctggctagtggagtccaaagaaagagccattacagcttacttaataatgtataagatggtcttggaactgattaaacaggattcaacaatagtcattttgaatacaaaaggaaaatgtcactccaaattagaaaataaaacgtggttcagaagactcaaaatagggatgacagccttctgaatttctgtgctgctacagaaatatcaggagggctaacacacccccaaatataaaatctctttgttttaaaagcaacataaaaagaactattagctaaaatcattaaatgtccagtttgtcctggatgtgtctaggtttgtatctatgtcctggcttaaatattaatagtgccccttttcactctgaaaagttctggttttgatgacaaattatatggtcacctaagccatgatcctagccatgtgttgatgtggctaaagagaccattgagtcagttgccaatgtacagatgaatggactaaagggaaggacactatccttgagccttggatcagaaaggcgacggctcctttcacacggaatcactttcatatggaaataaaatccagatcatctaatatttagccctggtgagtagaagaagcctcaatcaaatgtctctcgtgttatattctgaaaattggaatttccattactgaaatgcctgataccacttactcattcttatttcaaaaattataaatctgctcctcaatttctgggtctacaaaatcaatgtgctgttcataatttttgttttagcatttacacttcactcacttctaaacaagactgagctgattcaaagtaaagatgtgtatgaaataagactgcaaaaccagaaacagaacatattaaaattatggaagggggaaaaaggaaagcacgctagcatttacttagcattctacaaggtactagatacatggctaagcaaataacgaagcacgtttcacttgattttcgtaacaatccaaatggtaggtattatccctctattacaaataaaggctcaaaagctgatatctaactatcaaactgcccaaatacaaaaagagagagtaaaaattcttagcatgctaaacatgagagctgaataatttctgcattacatttgagtatttgtacgtcacatttatttgagatgccttacaagcaaggcaaaaaagaaggcataatggcttatataatcctcaactgacagaaagtaaaaacatacagtttcaccaagtattaaatcacaggagggatttattccaagaatgctaatcaacacactgaacaatgtccttaacaacagttcacaactataatggcctttcatatgacttctaatatcagtactcactgaaaggcataatattaaaatacaactcagtgaaagaacaagcttctgttgctcagggggctagtccttgactagcaattagcaattaccaatgtgtgtaagaggcctaaaatatacatggtacaattgtcaagtaagttttaaaaacacaatatcatgttgaccctacttagagattcaaaatatacttagcatcctaaaagttctaaaagtctatgcactaaagaaatgtgtataaattatttaacacagtttcccatgcttgttattgtcaccctttagagagttaggttggtattcactaactcagatatatctatatattttttttcacctggtctttgtatgtgagtgggttaagctaacaaatttacattcatttgcactcacaagaaacaagaatgttaacttttttggttttttactgatagaagggagaaccataactttggcgttagttttcctttgattatagaagttgagaaacctgtcagatgctctcatggacagagcgtgtaggcaggaacggataacatagtgccagtgggtctatcagaaagtaccttaggctctgttcaaatgcctcagtgtccagctgaacagggctcacactcagcaaaacaaggcagagataatttgaggcaaaagaccttaagagcagattttaatcaatgctcattttaattacaagagatcatccataacccctctgttaaaacctaaatatttgagcagctcagcctcctgatagcttaccagggtgagataagtacaaaacgtacaccagataatgaacaaccgatcagttagatgacagcatttggaattaaacatccaaattttggaaaattcctgttaaaacaactttaggtccttaacataattgatatagagctccttttctcaacaataactagaaactagacaaaatgtttcttaaacttattcctagatcattgcctgaaaacatacttattttctcatttgcttcagcaaaaatatgttcattatttccatgaaaagccaaatcagatcatttaggcataaatagagaaagcaatcataccacttaaaattggtctgtaatatggtaccacatatcagcccattccttttctttttaaaacattaactgttaaaatttatcattcagcttcacctatcacatcttaccataagggttacgaatacaagcataccatagaaaaggcttacaaagaaatctttttacgcagctcctttgactttgaagcaaaacgtgacaatcatacaaaaacaaaaggcattatcttcactcaacaaactaaccttggtcaagacctcgatgacacatttgtcatatatatttgccaatttctcaaaagacaaccttcctgatttacattttttcctattttcttacattacttccaatacaggatataattaagattttgctcataacattggctgtagtattttcttttgtcatagctgaaaattaacaatgatgtacaataagcatgaactggcttgagagacaaaggaaattaaaatactacattaagaagtaaaaacaaaaggagacaagagtttcatgctggaaaaaaaggaaatgacatctataacacaattctttcagtgcatgcatgactcaaaaaacaacttcagaatctatacagtttcataatgtatttttatagtatttataacagttcacgacataaactcattaaccacaccagtagttctcaatgggagtgacgcctatcttgagggttgtttgagaaatttatgcgggtatttttatttgtcacaaggtttatggaaaattacaggcacttaatgagcaggaaccaaaggagccagacattctgtgtcggacagttctccacaatgaagaattatccaaatccaatgcaactttcaagtgtccaaccaaattccatgacggtggaaaacttgtttataattgtctgagcctagaactaaatctccttttacatttaaaaacaaagagctcgtttttacataatcctaacagcactgaattttctaggtaaatcaaaggaagactgtattttaagaattttacctaaattactcaattaaagccatatcactgaaggcaacaccacttagagtacttgagttaccaatacaacacggcttctgacccgcatctctacttcccttctcacagtgactctatgtataggtgcaaatatgtgactaatgatgtcttccagtctaatacctcagcatttatatactaaaatacatattattttatcataggttttaattttctttttccttatattccaattatggcattatattaatgttttgaaaatatgtaactaggtatattgcactacctgtaaaatttcatttcaagatagtagagagggcaataaaaatagttctcacaaaaatggggagttgggtctgaaaagaactgagaagcccagatctaaaaaaatgctacacagttacacatgccacacacatacacaagaatatatttttaaacacatagcctaacacccaccctagggattctgacactacccatgagacagaatcaagcatcccactgcagggctgctatggtttcaatgtgtacctcaaagttcatgtgctggaaacgtaatccccagtgcaacatgttgagaggtggggtcgttcagtagcacagcgctcacgaacggattcatgtcactattgcaacagtgggtttgctataaaagagagtccggccctctcttgttccctctcaggagcacgctcccgtcatgtgacgccttctgccatgctaggatgcagcaagaaggcccttacagatgtaatccctcaaccttggacttcccggcctccagaaacaccagccaaataaacttctattgtttatgaatgacccagtctgcggcactctgttaatagcagcacaaaaacagatcaagacaagggcattccatgagtagctaaagttgaaaaaccactgagttaaactaaattacaaaggaggtcgttatatatactaaatagatgaaacaaaatacaattctataattatcattgaactattgttctatagaaataaatattgtataatattaaggtggaaaaagtgttttaaacagaacataaaatgtaaaaaccataaaggaaaataaatatatattcaattacataacaataaagaatttttgtcttgggggaagaaaaccagaaacaaggtttaaaggtaataaaccatgaaacagtctaaaatacatatatagacacagtgttaaatgtctccaatatacaaaaaggccttacaaataacttttgaatatttcaaaaaatataaataaaggtaaaggaaatgaataggaaattcatgactgaaaaagaaaaaccaatagacaactaatacaaaccacaccagtgctcaaagacatgataacagaaactagataacatagtgtcccattaatttggcaaaaatgaataaaactggcagtatttagaagcatctaggatttggggaaataggcattttccagccttgttagtagagttgtaggctgctctgatctttctgatgggtatttggtaatgaatatcaaaattgtaatgtgcatattgttgacacagaaatattattcataaagtaatttattttaaaaaatttaaatagtataaagaaataaatttaagaatgttccaccctaagcaacatagggaaatcccatctctataaaaaaaaattttttttagttagccagacatgatggcatgcacctgtattcccagccacaccagaggctaagaggagaggatcactcccagctatgctggaggctaagatgggaggtcgagactacagtgagccatggtcacaccactgcattccagtctgtgtgacagagtgagaccccaggtctcagggggaaaaaaaaaagaatgctcacaatagaagatgattaaaatactgaaagttaacttttccagcttttcctaaaagaaattgctatttttgtctttctctttatagctttccattactatttaaattttctacaaagagcatggagtttatgaataaaaacaaatataattttatgtgtagtaactgagaatcagggagaagtacttttatacgaaagggacagcaaaattactgtttaataggcactggtgcttcttaactttttaatgtttattttggaaatctagttgcaactcaaagcatgatttaaatgtgttaatttttaaatgttaaaaaatgcttcagtgaactgttctgtaatgctgatgcaatcttttttaattcagagattcactcagtaaattcttttattagtttggctatattcatgtctgtttttcttaaatgagtatagtaccaattaagtacaccttgcatgaaacaggtgttcaatacatattttatgatttattctaaaaccagtaccattcagggggtaaaatttactatatattatcattatttgaaattaaggccatacaaaaagaagaaatgaaagtagactctcacaattctttctttgaccaataagagatggtcttgattacatgattatgaaaggagtgtattgatgagatgttacactaataagagaaaatcaatttatttctttcttacgcaaaataacatttgcactattatcatatttccctctcctctttacatacaaagtccctattgctcactcaagaacccatttaaatgctgttaaacaccaagttttggttggagtggatatccattttagggtagctcattattgtttgggatagagtgtaagaagggtcatcctgtattgaaccttggattgggtaaaatacatccaattcatgacatcagctcactaggtatttattccataagaagattagattcaaagatctgcaaggcagtcttccaatgataaaattctgagtctgtaacatccattcctaacaaatatctgaattatgtcaaaataggtttgaaacctgcttgggttaggcttacaatcattgaaaatttgcaacagtattttcctcagctatttggtcattaaggatgaagaagctgtctttaaaaatatagaaaagaaaatgaattttttgagcccacttattcaacagtttcatataatattaactaaacatcttctacgtgaaatatcacagtgatttttttcctacatattcaggacttactccactcacaaacaatcatctacagaggtttcctatgggcaaaacttaggatagttgagctgccacgcaacttgcaggaaataaaagatactcgacagttttccatttacatccagtttgcttgatagcaaataaataatgcctcctcctttatccttgaaatgtagtccaatattgaattacagattgtcagatgcaggcagatctgaaaagctggaatctgggaaaagaaaactggaaggctaagcaggttgtctaacagctacagttgactgacaggtattgattaagatcttgcaaaaaaatctctttagagcacactagagattagtgatagatatgagacttctcactttaaaagcttactgaatgctgtatcaaatgtagagcaagagcatcttctcactagtcttaatcaaattagatgaatagagctaaatataaagaaggaatgtgccatgaaaatggtcttagggcataaggttgacaagaggaaaaaaagaacgtgaataaatgaccatttcttgggcaaatgggaattacggtctcctgttaagtgaggaacctataatatgagacaataataacaacagtgcccccaaagtaagtcaatcatcatctactgcagggttccaaaaatatatggctcataggtaaaattcattttacatttttacatttatgtaaaattcaaattcatgtacgttctaattcgtgctacatttttagtaaaattgtacattacagggatagagccacacttattagttacattcattcatttcatgctacatcagagttgaacacatacgacaaaaatcatatggccacaaagcctaaaatatttactatatagttctttacagaaattagccaatgcttgatctaatgagagatcatatgaagacgaaatgacttaattgatagtttggctggaaagcaaaataaatcatgcacttccacagacttccaatcttatttggaaaaagcatctatcctagattaatcaaaatatcaacaccagcttctagctgaatacggtaggtgagcacatgtattttatttcctcaaaacaagtaattatcaaattttttactcccaaagtgaactggaacagccatcaatggatgagtggcagggaaggatgtggttagccccatttgagagtgaaaaagtggtggtaagaggacaggctgcagaagcagggtcaaagaggccacatgtagggacagtcccatctgagagggaaggtcagcctgccaagcagaattccagaaaggatctagaatcaaagactatacattggtagaatggaattgaaaaatagatgagaaagagaaaattaaccacaagtctgtatgccaaagagtctcaaaacaccccttctctacttttggcttgattgagtaagcaatggaaggttaatgtacagaatcttgttgaatttgatgctaagattatctctgatccagattattgctatagcctcctatttggtcttcctgccctgactcttacccttctacaacggcttcttcaaacaatagtctaattctttgagtggcttaaaaattgtgatcactgtattacagaaaaagaaataaaatctatgcatacttaatagctctgtggtgaccaatatgtttcaaactacttacttgaaatataatttacattattaaattatatttaggttggtgcaaaagtaattacttttaatggcaaaaaccacagttacgtataataaaatgtatccattttaacagtatagtttgataaatttttgtttttttgagatggggtcttgctatattgtccaggctggtctctaactcatgagttcaaacaatcctcccaccttagcctcccaaagtgctgggattacatgcacgtgccaccacacccagctttgataagttatgacacatatatctccatataaccaacaccaaaattaagctacagatgttagtactccccaaaagttcccttgtgccccttacattcaagtcctccatcccaggcaactcagtggttttgtctctataattgtaagatcagttttgtctagcctagaacagtcttacttcttttcatctggcttcattccctcagtacagtgttttgagattcactaacgttgcggcatgcatcagtagtttgttcctcttaatggacaagtaatagtacagtatgcatctctttattcatttacctgtggatgaatatttcacttgtttccaggtttggaacattgaacatttatgtacaagttgtttttgtagatgtaagttttcataactcttaggtaaataactaggagcagaactgctgggtcatacagtaagtacacctttaacattattacaaactactaaactttcccaaaacaatgataacgctttactttctcaccaccagtgaacaagagttccagttgctccatcaccttgccagcacttgacaaagtcagtccttttaattttagtctttctagtgggtgtgtagtaatatctcattatggttttaattttcatttatctggtgaccagtgacaatgattatcttttaatgtatatcttcttaaagtatctattcaaatcttttacctgttttactcagttttcttactactgaattataagtattctttataaattctggaaacaacttcttggttggggtgagagagagagaaggagggagagaaagagaaaaggagggaaacagggggaaagagaggtctcaaatattttctccatgtctgtagtttgtctttccaaggagctgaagggtttaattttgatgaaaatcaatttatcaatttttcttggaggcttagtgctttctgtgttctacataggaaattttatgtaccccatatccaaagagtttctcctatgttttctcggttttatagttttagcctttaagtttaagcttattgaacctaaatcttattaaatctagtgaagaattgtttttacttttatcatttattttccatgtgcatattagcacaattttttgaaaagatcatcctttcattattgaattatgttggcacctttgttgaaaatcaactggccatatatgtgtagggctatagtttttatatttttatttctgaatacaggttgagtatgccttatttgaaatacctgggaccagaagtgcttcaggttttggatttctttggattttgaaatgtttgcgttatacttactggctgaaccatcccaaacctaaaaatccaaaatccaaaatactccaatgagcatttcctttgggtatcatgctggtgcttaaaatgttttggattttggagcgctgcagattttttgatttgggatgctcaacttgtattatgatgtgttgacattttaaaaacctttctgactaaggagaagactgctcctgctcctcccagggacagccaattctaagaaatagcaaaaagctcaatcctgagcatgcctttgataggcaaactaaatgatccacagccatacatcctctgtctggccctaacaccctaagaggcaatattcttctgccttaatcatcccagggccaggtaccaggcaaacagagaccacccttaaaccccaggatcccctgatattactcaaactagccaatcctaaactgagaaacacctatgaatgccacagtccagggacaaaggctcaccaaaaacccaagacctaatcatagaactatagaactggccgggcacagtggctcacgcctgtaatcccagcactgtgggaggccaaggggggtggatcaagaggtcaggagatcgagaccatcctggctaacacggtaacaccccatctctactaaaaatacaaaaaattagccgggcgtggtggcgggcacctgtagtcccagctcctcgggaggctgaggcaggagaatggcgtgaatccgggaggcggagcttgcagtgagccgagacgttctactgcactccagtctgggcgacagagtgagactctgtctcaaaaaaaacaaacaaactaaaaaagaactacagaacagttcctctcctcttacatcttgccatcacactactaaaggcctatttacagtggttccttttacatcacgtctagctatcaagaaaaaactataagacatactgtattagtacattcttatgctgctatgaaaaaatactcaatactgggtaatttataaaggaagacgtttaattgactcacagttccacagggctgtggaggaaacttataatcgtagtggaaggggaagcaaacacatccttcttcatatggcagcaggatggagaagtgcccagcaaagcaggaagccccttataaaaccatccaatcttgtgagaactaactcactatcaagagaacaggatgggggatactgcccccacgattcaattatctccacctggtcctggtccctaccgcgacacatggggattatgggaaccacaattcaagaggagatctgggtggggacacaaccaaactatgtcacatactaaaaggcaaaaaaacatagtttgaagagacagagcgagcattagtaccagactcagatatggcaaggatgttggaattatcagactaggaattttaaaaaactataattaatatgctaaggattccagtggaaaaggagacagcatgcaagaacagacaggggatataggcatagaaacagaaattctaaaaaccaagaagaactgctagatcaaaaacaccaacaaaaataaagaatgcctttgatatcttattggcagactggacgtagctggagagaagaatctctgagctgaaattatctcaatatggtaaccaccaacattaagaagcaaagacaaaaaaagactttataaaaaaaaaacagaatatccaagaactgtggaatgattatataaaggtataagatatgtgtaataggatatgtcagaagaagaataaagagagaatggaacagaagaaatacttgaagtaataatgactgagaagttctcccagattaatgccaggcaccaaaccacagatccaggaaactcagagaacaccaagaaggataaaagtccaaaaatctatacttaggcatgtcattttcaaactacagaaaatcaaaagttttttaaaatactgagagaagccagatttttatagctaaagataagtatatgtctgttttaggtgtttatagatactgaaatggtttcagtaatatgtcattttctgaaaatctcaaaacacttgaaaggtgtgtgcaatggtttgaaggtctgtaccctccaaaactcatgttgaactttaattaccattatatcagtgttaagaggtgggaccattaagaggtgactcagccatgaaggctctgtcctcatgggcaggattaattccagtatttgatgccctcttgtctcctggcccttccaccatgtgatgtcacagcaagaaggccctcactacatatagccatcttaatatagaacttccaggcctccagaaatgtgagtcaacaaatttccgctcttcacttatacactgatggtgggaatgtaaattagttcagccactgtggagacagtttggagacttgaactaagtcttgaactaccatgtgacccagcaattccattactgggtatatacccaaaggaagataagtcattctaccaaaaagacacatgtacccatatgtctctccctgcgctgttcacaatagcaaagacagggaatcaatctaggtgcccatcattggtggactgaataaagaaaacgttatatatatatatatatacacacacaccatcaaatactatgaagccataaaaaagaataaaatcatgcccttgggccgggcgcattggctcatgcctgtaatcccagcactttgggaggccaaggcaggtggattgcctgaggtcagcagttcgagaccagcctggccaacatggtgaaaccctgtctctactaaaaatacaaaaattagccagacatggtggcaggtgcctgtaatcccagctactcaggaggctgaggcacgagaattacttgagcgtggaaggcagaggttttagtgagcctagatcgtgccactgcactccagcctgggtgccagagcaagactctgtctcggaaaaaaaaatatatatatatatgtcttttgcaacaaaatggatgcagctggaggccattatcctaagcaaagtagcacagaaacaggaaatcaaatacagtatgttctcacttacaagtgggagctaaaattgggtacacaagtgtataaatatgggaacaacagacattggagaatataaggaaggggaaggaggaggaggtgcaagggttgaaaaactaccttttgagtactatgcttactttttgggtgacaggttcaatcatactcgaaacctcaggatcacacagtatacctttgtagaaaacccgcacatgtacccccagaatctaaaataaatgttgaaaacaaattaaataaatttgaaacaataaaaataaatttttttctttataaattactcagtgtcagttattctattatagcagcacaaaacagactaaaataaacaacttacatatagaggaacaaagaatcatagccaacttctcagaaaccatgtacaagagagtggaatgaaataaagtactgagagaaaaaaaaattactaatctagaattctgtaccctgtggaattacccttcaaaagtgaagggaaaataaagactttttcaggaaaacaaaagttgaggaaatgtattgccagtagacccacccgcatgaaatgttaaaagaaattctgtagagagaaggaaaattataaaggttagaaacttagatctacataaagaaagaatgagaatcaaagaaggaataggtgaaggtaaaataaaaactttcatttttcttattcttaattgatctaacagataatagtttgttcaaaagactgctaatagcatcaatgtatttaattatgtatgtttatgtataagctaaataaatgacataagagagggagcaggggccgggcacagtggctcaggcctgtaatcccagcactttgggaggctgaggcaggtgtactgcctgagcttaggagttcgagaccagcctgggcaacatagtgaaatcccatccccacacaaaatacaaaaagtagccaggcatggtagtgcacgcctgtagtcccagctatttgaggaggtgctgaggaaggaggatgagttgaactgaggaggtcaagtctgcagtgaggggtgttcaggccactgcactccagcctgggtgacagagagagatcccatttctaaaacaattttttttaaagagagggagcaggaattaaaagtattttgttattctaaggtactcattctacctgtaaagtggtaaagtgttatttgagagtaaacttggattcgtcgtaaatgtatattgcaaactctggggcaatcactaaaaaaggagatatatctatatctgatgttctaatgaagagaaaagaaatcatacaaaaggctcaactgaaaccacaaaaggcaaaaaatagtgaaagacaacaatcagaacaaataacaagggcaacaaatagaaaacagatacgataaatattaacccaactatatcaataatcactttgaatatcaatgatctaaatgcatcaattaaaagacaggaatggtcgcagtggatcaagacacaaaacccaaccatatgtcatccacaagaaacccattttacatataaatagattaaatgtacatggatggagaaagatataccgtgctaacactaatcaaaagaaaagcagaaagagctacattaattctagatttcaggttaaatgtcacctctacaggaaacccttctgtatccacctactcacaggtgagtttgtgctcaccccaatcacattcaatcatataatcatgggcatttgtcactgtctctctactccataacagaagctttatcaaagtcaggaccttatttacttgctcactgcctattacttatcataccaaccaccaggacttagagcataataatcactctaactcctgtgtagaaaataaattagaagttggaaagaatcgtagttaacaatgcagctaatccagaaaagagaccatggtaacaggtagtactaaagaagctgacgagaagggaaccaattcagatctttaggtagtaaaatagtaaaatcagcacgacatgatgactaaatggatctgtcgccaagaaaggatgagaatcggagatgacacctggcaactcagactgctgggtggctggtgaaactgttcactgaggctggaaaacatgaagggaagtgggtctgggggaagataatgtactcagatttacacgttacaccagagacgcctgtgcaacagccaagtggaaatcaggagaaaggaggctggagacggagtcttgagaaggattaatatacagatgccacttgaagtcataggagcagataacatcacacagcaggcaaaggtaaagtgggaaaagaaaaacttccggctccagacacctgtggaggtcaaaaactgaaatacgaccaaatcgttttaaacttcatgtagtactccctttgtgttgacagttagatacaaagctgacttatctacagtacattccgtgcaaagcctatcagtttcaggccgaatttatgaagtaaacaaagcttgacttccttcattatcactgctttggttatggtagtctaagaaccagcctattaaatcactctgttaagtgcttactaatgtgggattaattttctacccatcgaatatgaatcaaatcattccacaactaagcataaaatgtaaacccaaaaatacgattcacatttttaaagaggtctataattatcaatataaaatagagcttgtatctgctaatacagtgcttttaaaaagtatataaattacaatttgatggagtgcctaactccttattttgctcagcaattaattcattcaactagaaatgtatatattatcaatcatattaaatcctcaaaaggtaaaataatacttggtgaattacttgaaattgacttacttgctatcaccactgctgccattttttgttttgaaaatgcttttttataagaaattttagcctgctcctcctctttgatctcataatcatgtgtgatgttctgtttatagcaatagagaaaaaagactggacctccttctatgaaattatatgatagacacctgataataaggtatagaccagaatataaagccagtgatgacaaaaatattttgaccagtaacagaaacagtactgtacacaggagtaaatacatatgtcgatgtgtacgctatatatgatgcataaaccaatagtttggtgtatatcctccatccataaaatagacacatatggattatctctgaaaaacagaagtagaagcgggggaaggaagctggggaaagacttttatgttttaccctgtatgattctatatggtgtttttataataaaaacatatccttgtattgcttatgtttaaaaatgaaatgtgcaccagatgcggtggctcacggctataatcccagcactttgggaggccaaggctggcagactgcctgagatcaggagcttgagagcagcctggtcaacatgatgaaaccccacctctactaaaatagaaaaaattagctgggcgtggtggcacatgcctgtagtcccaactacctggggaggctgaggcccaagaattgcttgaacctgggaggtggaggttgcagggagctgagacggcaccactgcaccccagcctgggcagcagactaagactctgtctcaaaaaaaaaaaaaaaaaaaaaaaaaaacataaagaaagaaatgtgaataccaatagcactgacaccatcctgtgggcacaaggtacatgttacacctgcaataccccaatagcctctctcagacaacttgatgccatggtcccacacatcaaatgctaagctagtgaaccaaaatcatgtccccctggggtatacatattatggattttatactacagatttacatcctctgtttcaatttccattccaagtgcttttgcgttctgttcatcactgttcacagttcagtatgtcatttaattttgcgtagttttgtgggtatccacaataattacaatgtttaatgttgtattttaaggttgagataaacacagcagtttaaacgcatatgttctggccaatctttaactccccctccacacacacaaacacatactctagctgttattacatatatccttcatcttgctagctgttttcctgttaccttccacagtatatctgacagtgacattgttattgatgccacagtaaacagctaatatatgtagtaaaaacacatgcactacaggtaatcaaaatgacatacccacccaccaaactcctgctactcattctaatcagataatggcttttctcttccctgagtgtactacaaaaggatgatgtggcactagaggaaaaatagtcacaaaacaggggaaaaaaatgttttattaagtaaactgtttattaagtgttttattaataaactgtttaggtcattgagattagaaagcaagtttgcctagacttgtgtcaaataatatgataatctgtcgcttctctatgtactctgtttaatctgaagttcctagaaacaaatagctgagcttcacgtgaataaaacacctagaacatcaccataaaccaagctttctggaacgaatactgtataaaaagcagtattaatgtttcactttttgcttttagttactcttgttggtaacaatcttacataaatcagggatctttctagcttcgacaaaacttttgtttaaaaaatgaggtagaaataatattattgttttgaaatttcctatcctattttaattagaaagtgttatactggctgggcacagtggctgacacctataatcccagcactttgggaggccaaagcaggaggatcactagagctcaggagtttaacatcagcctgggcaaacagtgagatctcgtctccattaaaatttttttttaaattacctggccatggtggcacgtacctgtagtcccagtggctcaggaggcagaggcagggagaccgcttgaacccaggatttcaagactgcagtgaacttgataacaccactgcactccagtccaagagacaaagcaagactgtccccaaataaaaacccaaaagccaagaaacaaaagaataatacaatatataatggaaaactagacctaatcagaatgttagagcaagaacagaatttaggtttaaaagagcagttaaaagtctgaatacctgggtttcattcctgaaacttcagagcctactagttacagaatatttggcaagttggctgtctctctgtcctcattgtccttattaataaaataaaaataataatagtacctaattctcacaagactcttggaaaatcaaatggaataatacagtgcctggcacacagtggatgcctaataaatattaactcttattgttagtacagattcagaaactgaggcccacacagtgtgtgttttccctgagataatttaaccagcaaatgccagaattagcatgagaacctggaacccctgatatttttgaacttttgatttcttttccattaagaccactttttgtgtcgtctcaaattactttcaaaggataaaatgagagagaagaaaacccctgagacaagcatggcctaaatttaaaagaaggaaagaagaaactctggaggtgtgtgtgcatatacaaaacataagaaacaaaaaggatgagtggagggtggcagggaggaggcaagtgacatagacacaaaacctctaattagacttttaataagatgtaactcattaggacataattacatttcttattaaatgattaatcataaggttagaagaaaaggtcatgctgaatgttaattatacatcctttcaagaatttcaaagatgttaacaacagtactcgtaaattaactcaaactcttggcaggatatttggcattatctttaaaaattcaaaaggcatatatcctttcaacaatcaatacaataagaatttatcctactaataatttggggaagtgtgcaaaatgtgcaaaacaggatgtgaagtgcattattggcaataccaaatattagaaaagtgccaagcattcattaacaaagaaattattattatggtcaattcatacaatgaaacatatgggatacaaaatgttccccaaagtagatcgttaaatgaaaaaaaaaaagtacacaagaattcatgccagattaaactatatctttttttttttaaacataggatgtagatacacaaatatgtctgcacaagcaaatgctgcaaagacacatgagaaacttaacagtgattgcctgtggaaatgagaattgaagtcggggggcaataagatggggaggaatagacatttactttcacatagtagacatatacacacacacacccaatttttaaccatatatatttaacatcagttttaacattttaatgtccctggcaacctgtgtgactcagcaggtgaataacaagtaaaagtaaattaaaggctgtaaagaagtagacacaggccaacaggtatagtgaaggacaaatttaagagtaaagaatttgaaagcttcacttatatatggctgaaaagtcttacctgacacttagcactacagtatttggcgacgcggcactgagagcatcgcatcagcttttccttcctgtggggaaaaaaattaattctgcattaagaaatgagtgggaaacatagtacatagttgaagaaagaaaacataagtcaacatacggacacccgtatgttctgtttactccattatgtacagtcccttaagatttggattttcacactgatgagcctcctcttgaaccttccatgtgagacactgatagaaaaactaagtccttttgtctgacagaagatggcggggaagaggcaggaccagcttgcagctcccgatcggacagacagagcagcgtgtggggactcacactgtgaacttttgatccaacaactgccacagcaacataccaggtaaactaagagaatccacagaccctctgaaggaactgtatcgccactgcaggctccctgagactctgaaaagatgtgagctgcctgcttgctcagcagggaggctggcggtctggggcaagttctcagccacagtcaccagctgcctggaaacagactccgtgctgctgtgggggcacggtgggagtgagaccagcctttaggactgcgggctgtgtgggagtgggatgaggcctgtgactgctggctttcccccacttctctggcagcctgtgtgacccagcagaagcagccataatcaccctgggaacataactccattagactgaaaaccacatccccatcccaacagcagccgcagcaatccccagccaaggagaatctgagctcagacacacctatccctgccccctggtggtctttctctaccagccctgggtgccaaagacaaaggccataatctcttgggagctctatggccctgcctaccacctaagaaacctgaataggtaaccaggcgaccttagggcaagtttgcttcctccctgtaggaccacagctgatgtgttcctgaaagcaccaactcctggctggaggccaaccaacacaaaaccagcacactaaacaaaaatacaaccaagggcccttgtagagtccacttcacgcccctgctacctccatcagatcacaggactcttagcagtcactccccagtaccagcccagagcccagtacctccactgggtggctagacccagaagagcaaaaacaatcactgcagtttggctcttgggaagctccatccctgggggaggagggagaacaccacatcaagggagaaccccttggaacaaaagtatctgaacagcagcccttgagtcccatgtctcccctctgacacagtcacccaaatgagaaggaaccagaaaaacaattctggtaatatgacaaaacaagctctttaacaccccccaaaagatcacaccggctcaccagcaatggatccaaaccaagataaaatatccggattgcaagaaaaagaattcagaaggttaattattaagctaatcaaggaggcaccagagaaaagtgaactccaacttaaagaaatcgaaaacctgatacagaatatgaaaggaaaattcttcagtgaaatagcataaataaaaaatgatcacaacttctagaaatcaaagaaacacttagagaaatgcaaaatgcactggaaagtctcagcaacagaatcgaacaagcagaaaaaagtacttctgagcttgaagacaagtcttttgagttaacccaatccatcaaagacaaagaaaaaagaatttttaaaaatgagccaagcatccaagaagtttggaactatgttaagcatgcaaatctaagaataattggtgttcccaagacaaaaaaaagaaatctaaaagtttggaaacattatttgagggaataatcaaggaaaacttgtctgaccttgctagagatctagacatccaaatacaagctcaaagaacacctgggaaactcatcacttagacacacagtcaagaggttatccaaagcaaagatgaaggaaagactcttaagagctgtgaggcaaaagcatcaggtagcctataaaagaaaacctatcagagcaacagcagatttctgagcagaaactgtcagaggcatgcatgtgaaccagggcaactctatcttgaataggagctgagttaaatgaggctaagacttactgtgctgcattcccagacagttagggcattctaagtcacaggatgagactggaagtcggcacacaatacaggtcataagtaccctgctgataaaacaggttgcagtaaggaagcctgctaaaactcaccaaaaccaagatagtgataagagtgaccagaggtcactggtggtcctcactgttacactcccatcagtgccatgacagtttacaaatgccatggcaacgtcaggaagttaccctatatggtcaaaaaaggggaggcatggataattcaccccttgtttagcatataatcaagaaataaccataaacatggacaaccagcaggcctcggggctgctctatggagtagccattcttttgttcctttactttcctaataaacttgctttcactttactctatggactcaccctgaattatttcttgcatgatatctatgaaccccctctgtaacaaaaccctataagctagaagggattggggtcctatttttagcctccttaaacaaaacaattatcagccaagaattttgtatgcagcaaaactaagcttcataaatgaagtaagatacagtcttttaagacaaatgctgagagaattcgccactaccaagccagcactacaagaactgccaaaaggaactctaaatcttgaaacaaatcctcgaaatacaccaaaatagaacctccttaaaacagaaatttcacaggacctacataacaataacacaataaaaaaaacacaaggtattcagacaacaaacagcacaatgaatggaatagtacctcacatctcaatactaacattgactgtaaatgacctaaatactccacttaaaagatatggaatggcagaatggataagaattcaccaactaaatttctgctgtcttcaggagactcacctaacacataaggactcacataaacttaaggtaaaggggtggaaaatgacattccatgcaaatgggcaccaaaagtaagcaggagtagctattcttatagacaaaacagactttaaagcaaaagcagttaaacaaaacaaggagggacattatataacaataaaaggactagtccaacagtaaaatatcacaatccaaaatatatatgcacctaacactggagctcccaaatttataaaacaattactaatagacctaagaaatgagatagacggcaacacaataatagtgggggattttattattccactgtcagcactagataggtcatcaagacagaaagtcaacaaagaaacaatggacttaaactataccctagaacaaatggacttaacagatatttacagaacattctactcaacaactgcagaatgtacattctattcatcagcacatggaaaattctccaagatagaacatatgatagggcacaaaacaagtctcagtaaatttaagaaaatcgaaattatatcaagtactctctcagaccacagtggaataaaattggaaattaactccaaaaggaaccctcaaaaccatgcaaatatatggaaattaaataacctgctcctggatgattgttgggtcaacaatgaaatcaagatggaaatttaaaaagtctttgaactgaacaataacagtgacacaacttatcaaaacctctggaatacagcaaaagcggtgctaagcagaaagttcggagcattaaatgcctacatcgaaaagcctgaaggagcacaaatagacaatctaaggctacacctcacaaaactggagaaacaagaacaatccaaacccaaatgcagcagaagaaaagaaataacaaagatcagagaagaactaaatgaaattgaaacaaacaaaaaaaatgcaaaagataaatgaaacaaaaggctggttttgaaaagataaataaaactgatagaccattagcaagattaaccaagaaaagaagagagaagatccaaataagctcaactggaaatgaaatgggaaatattactgataccacagaaatacaaaagtttattcaaggctactatgaacacctttatgtgcctaaactagaaaacctagaggggatggataaattcctggaaatatacaaccctccaaaattaaaccaggaagatatagaaactctgaacagaccaataacaagcagcaagactgaaatagtaattctttaaaaattgccaacaagaaaagtctaggaccataaggattcacagctgaattctgtcagacattcaaagaggaaccagtatcaatcctattgacactattccagaggatagagaaaaagggaatcctccttaaatcattctctgaagccagtatcaccctagtacaaaaaccagggaaggagttaacaaaaaattaaaactacagaccaatattcctgatgacacagatgcaaaattcctcaacaaaatacaagctaactgaatccagcagcacatcaaaaagataattcatcatgatcaagcgggtttcataccagggatgcacggatggcttaacatccataactcaaatgtgatatgccacataaacagaattaaaaacaagaatcacatgatcatctcaatagatgcagaaaaagcatttgacaaaattcagcattcctttatgattaaaaccctcagcaaaatcggcatagaagggatacaccttaaggtaatgaaagctatctaagacaaacccacagccaacattacactgaacagggaaaagttgaaatcattccccctgagaaatgaaatcagacaaggatgcccacttttaccacttctactcaacatagtactggaagtcctagccagagcaatcagacaagagaaagaaatcaaaggtatccaaattagtagaggaagtcaaactgctgctgtttgtttgctgatgatatgattgtatacctagaaagccccaaagactcatccaaaagctcctcgaactagtacatgaattcagcaaagtttcaggatacaaaattgatgtacacaaatcagtagctctgctatacagcaacagcaaccaagctgagaatcaaatcaagaactcaatcccttttacaatagctgcaaaaaaataaaataaaataaaatacttaggaatacacctaactaaggaggtgaagacctctataaggaaaactacaaaacacagatgacacaaacaaatggaaacatgtcccatgctcatggatgggtagaatcaatattgtgaaaatggccatattgccaaaagcaatctacaaattcaatacaattcccatctaaacaccactatcattcttcacaaaactagaaaaaaaaaatcctaaaattcatacggaaccaaaaaagagaccacatagccaaagcaagactaagcaaaaagaacaaatctggaggcatcacattatccaactccaaactatactacaaggccacagtcaccaaaacagcatagtactgttataaaaataggcacaatgaaacagaatagacaacccagaaacaaacccaaatactgacagctaactgatcttcaacaaagcaaacaaaaacataaagtagggaaaggacaccctattcaacaaatagtgctgggacaattggcaagccacctatagaagaatgaaactggatcctcatctctcaccttacacaaaaatcaactcaagatgaatcaaagacttaaatctaagacctgaaaccataaaaattctagaagataacatcggaaaaacctttctagacattggcttaggcaaagacttcataacaaagaacccaaaagcaaacgcaacaaaagcaaacataaatagatgggacttaattaaaccaaaaagtttctgcacagcaaaagaaataatcagcagagttaacagacaaaccacagagtgggagaaaatcttcacaatctatacatccgacaaaggactcatatccagaatctacaaagaactcaaacaaatcagcaagaacaaaacagttccatcaaaaagtgggctaaagacatggacagacaattctcaaaagaagatatacaaatggccaacaagcatatggaaaaatgctcaacatcactaattatcagggaaatgcaaatcaaaaccacaatgtaataccacctcactcctgcaagaatggccataatcaaaaaatcaaaaaaataatcgacgtaggcacagatgcagtgaaaagggaacacttttacactgttggtgggaatgtaaaccagtacaaccactatggaaaacagtggagattcctaaagaactaaaagtaaatctaccatttgattcagcagtcccactactgggtattctaccaaaaggaaaagaagtcattatacaaaaaagatacctgcatacacatttatagcagcacaatttgcaattgcaaaaatatggaaccagcccaaatgcccatcagtcaacaaatggataaagaaaatgtggtatatatatacaccatggaataacactcaaccataaaaaggaacaaaataatggcattcgcagccacctagatggaattggagaccattaatctaagtaaagtaactcaggaatggaaaaccaaacatcgtatgttctcactcatatgtgggagctaagctatgaggatgcaaaggcataggaatgatacactggacatcggggactcaggagaaacgttgggaaggggtgagggataaaagactacacattgggtacagtgtacactgctcaggagatggatacaccaaaatctcagaaatccccactaaagagcttattcatgcaaccaaacaccacctgctccccaaaaacctattgaaattaaaaaagaaaaagaatctcagagaaaaaaataataacgcatggccctggacccatagatctccatgtactacaggagaatgctgtggtacgcacccccagcaccgcccccacaaaaaaatgtcctttttaaaaactttggtagaatatacgtaacataaaattcactattttaaccattttaagtgccctacttcacttcatagatactgatctctccatatcaaattcaaatccagtccataaactggttaaaagtattttatacccttcaaatatacaaattttgtcttaaattatcatatagtttaattatgaatatactcctcctgagaaatggttttaaaattccatttaattcaattactactttagacatgctgagttgagatgctttaactatctcccccaaatcacctgggtgacaaaaaagcagatatttttaaaaacctgaattatagctctccctctccctctccctctccctttcccacggtctccctctccctctccctctccacggtctccctctccctctctttccacggtctccctctgatgccgagccgaagctggactgtactgctgccatctcggctcactgcaacctccctgcctgattctcccgcctcagcctgccaagtgcctgcgattgcaggcgcgcaccgccacgcctgactggttttcgtatttttttggtggagacggggtttcgctgtgttggccgggctggtctccagctcctaaccgcgagtgatccgccagcctcggcctcccggaggtgcagggattgcagacggagtctcgttcactcagtggtcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcccagccgccatcccatctaggaagtgaggagcgtctctgcccggccgcccatcgtctgagatgtggggagcgcctctgccccaccgccccttctgggaggtgaggagcgtctctgcctggccgccccgtctgagaagtgaggagcccctccgcccggcagccgccccgtctgagaagtgaggagcccctccgcccggcagccaccccgtctgggaagtgaggagcgtctccgcccggcagccaccccgtccgggagggaggtgggggttagcccccgccaggccagccgccccgtccgggagggaggtgggggggtcagccccccgcccggccagccgccccatccgggaggtgaggggcgcctctgcccggccgcccctactgggaagtgaggagcccctctgcccggccaccaccccgtctgggaggtgtacccaacagttcattgagaacgggccatgatgacaatggcggttttgtggaatagaaaagggggaaaggtggggaaaaaactgagaaatcggatggttgccgtgtctgtgtagaaagaagtagacatgggagacttttcattttgttctgtactaagaaaaactcttctgccttgggatcctgttgatctgtgaccttaccccccaaccctgtgctctctgaaacatgtgctgtgtccactcagggttgaatggattaagggctgtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgtgagaaacacccaagaatgatcaataaaaaaataaataaataaaaaggaaaaagaaaaaaagagagagaggcaggaggcttagagtcagagaagtcaatgtggtgctgggatctgagaaaaagaacctggaagatggtcagttgctggctttgaagatggaggaagacactgaaccaagggatgcaggacaagctggaaaaggcaaggacacagattttccctggagcttcccagaggaagccaacatctggattttagtcccataagactcatctcagatttgtgagctccaggactgtaaggtaataaatgcgtgtggttgtaagccaaaaaaaaaaaaaaaaacctgaattgtaaaataaaaacaataaatctgatggtaaaattcacagtgacaaggatcagacgggactgtgtatagtttcaaggtggtcaagggctctaaaagtcaacctataatactaacatcaatgacaaaacagaacagctctttctaagcacttctgatatgacaggcacagtacgaagctctttacatctattaactcacactaaatttgaaacagttctgtataaggtaagcagtcttattatgccgactttagagatatttcaatacgttttcaaaagataaaaagtagatggagtagtacacactgctaaggcatcacaccataaagtgaaagtggcaggtgatactgaaaggataaaaacggaatcctatagagaatcagaacttgaatacatcaggtacctcacccctgaaagaacagaagtgagttatgggacgtaaaacatggggagtggttaaaagtctaaataaagcaacatcaaaaaattccatccacccccaagtgcagaactctagcttctaggtatcaatactccagcaacaagccaaacccaaacaatcgggccctagagttcttgattgtaaccacacaccacactaccattcttcagtgaaactggatacaatcaagtcaacacttagctgttcatgagacacacttcaaacaaaaggacatgcaatggtggaatgaaaaggatagttcagacaaatatgaactcaaaaaaagcctgtgtaactacataagtttctgaaaaaaagagacttgaaggttaaaagcattaatagagataaagccaatacacagtgacaaaagacttccatcaccaactgttacatacaaagtaaccaatatacccagtctcaaaatctataaagtatacatcacagatctctaaggaaaaaatgacccatatacaataagttaaagcagggcctggaatacagcaggtaccatataagagttagacattataaattctctttcagaaattcatagatctagaagataaagaataagtagataaagaagataagaataagaccagtctgggcaacatagtgagccctcatttctacaaaaaaaaaaaaaattaaaaaattagccaggcatggtgtcacaagcctgtggtcccagctacttgggaggctgaggtgggaggatggcttgagcccgagagactgaggctacagtgagctgtgatcacaccactgcactccagcctgagcaacagagtgagaccctgtctaaaaaaaaaaaaaaaaaaaaaaaattaggaatataagaatattactcaagattcagtcgggttaaaaacaagggaattctggggaaatgatggcagtgatgtaattttttaatctcctcgactctccccataaaaaaaaagtaggacagtaaaacctaatcaccactccccaccctggaaaacatcaataacaaacctcaaaatatgactgggtggaaaaaactatgagtggttctgagagcagaattaaatcagtatctttattgtaggaaacaaggcaacttaacttccaacagacctgtaaacaaggaggccccaaatcgccaaaagctgtccagcatagaatgccaagccaatctgagaaccgcagccaaaactgggagagggttctttctttagcaaacctctttaagatgaattccccagggctgctctgaaccctgccttccctagacctggctcctcagattttctcacttccctctctcttgtctaagttaatcagaggctatgtctgttggctaaaaataaagatccacaagtacatacaaaatgtttgttcttgattttaaaaaataacgagcagaatcaagatacctaagaagctcaggtgatgaacacctagcaaatatcaatccttcatttcctcctccctcccatagctaccaaaaaaacgctataataaatgttgacacagaagtttggtaaactaactaacaagataattcagagtacttgaataatttatgtgtcatttaaggtgtgatggcaattccttaacatgagttatttaaatgtttgggattgtttttacatattaaatgactaaataaataaatctaaattcttactttcaaaaaaaaggcaagttgagtccaagaaaaaagtgatgtgtgcttgattaaaccaactactgaaactttgatatgttactgcttttctctttggggcatggttcagagcagcagccccctggcaggctcccctgcagagaaaatacttgggcagcagtgagagggaacaggaggtcagcagaaacacagccaccagacagtacgagaaaaccttctttttctcttaaaaaaaaaaaaaagcaagagggccacatctgtaatttcaacctcagtgacacgcttggggagcatagaatcatctcaaaaacaaaattggccaggcacggtagctcacgcctgtaatcccagcactttgaggtgggcggatcacgaggtcaggagtttgagaccagcctgaccatggtgaaaccctgtctctactaaatatacaaaaattagccaggcatggtggtgtgtgcctgtaatcccagctactcaggaggctggggcaagagaatcgcttgaacctgggaggtggaggttgcagtgagccaagatcatgtcattgcactccagcctgggcgacagagcgagactccatctcaaaaaaaaaaaaaaaaaaaaaatcaccacatgtcatttcaaattgaacaacaaagccgtattttttggggaaaaaaagagaaatgtctatgtcaaatcaaaaacataattaattagcagtttatagaaaaaggaccacttattttaggtagcttcagaggctaaaacaagaaatagtgaatggaagttagaggagggcagattttacctaaattgtaacgatttttctggtgacagcaactgttcagaagtctaatgcaatgccttgagaagcgtagggttcccagtgacttgacatgtttaaggagaatctagtagtaagtatatttgctagacatgaggtaagagaatttccagtattgcaaaagagaaggagttagataagttttcttccaactccaaaattatttggttttgtttctcttgtgcaaccaataaatataaactaaatttgaagatgacagaaattgtgcatattttaaggcaaagtatggtggtctcagaaaggtagagaacatgctgtttgcagagtgtttgtctaaaaagtcgatccagaactggagtttctgaatgaaaaaccgcaacctctgcctcccgggttgaagcaattcttatgcctcaacctcctgagtagctgggattacaggcgtgcacaaacacgcccagctaatctttgtattttagtagagatggggtttcactgtgttggccaggctgctctcgaactcctggcctcaagtgatccgcccacctcagcctcccaaagtgctgagattacaggcgtgagccaccatgcccagccaaaaaataatcttaaaaaaataagtgaggaatgtatcagtcagagaaaagtgatttttaccttttttcccttcatttcaaagatgaatattagcattgtaccaccaaataagagaagatattgatattattttttaccaaaataaatgggatcgttagcaacccaccctcttcaaaaaaagcaaaaaggaatcccctatcacttgttcatacaaacctgactctagagaacggagtgtcatatcaaagaaaattcttaggttactcagtgtcccagacacagtggttcatggagcacaagttaagtcctctcttctgggtataggctgggccataattagtttctccaacagcctaagctactgaaatgtaaaaagaaaataaaaactgggcaaaattaattgttcttcagtcttccagtatacaaattaaaaacttagatatgggtatagcaggaacaaccatctctaagaaatttttaagaagtggggcgtgaaattaattgagtcactcaaatctcaactatgggggtactatcttagggaccatctctctatccttcttgggtgtcagagggaaagagtatgtccatgtttagaaactctgtgctaaaaccataaaaccagttaccagacagtaggaaggaagtttcctggaatggatatagaaaacaaaaaaatcctagtgactcccaaattccccccagccctgggacccacagaatccactttaaacttcctatagagaaaaaaattcatctacaacacattcctatataatcaactcattattcagagctccttcctagtaacatgtcttaattacctaaaagtctctgtgatggttaatactgagtgtcaacttgattggattgaaggatgcaacatattgttcctgggtatgtctatgaggttgtggccaaaggagataaacatttgagtcagtggactgggaaaggcagaccccccctcaacctgggtgggcaccatctaatcagctgccagcacagctagaatcaaagcaggcaggagatcgtgaaaaggctagactggcttagtctcccgacctacacctttctcccatgctggatgcttcctgccctcaaacatcaggctccaagttcttcagttttgggactcagactggcttccttgctcctccgcctgcagatgacctatattgggaccttgtaatcatgtgagttaattcttaataaactcatatatacagatagaaagatagatagatattccattagttctgtccttctagagaaatctgactaatacaaccacttagcagctgtgtaatactaagcagtttaacctctcaaaaccactgaactaaaatgagcataaataataataataacattacatgggccctgagatttaaatgaaacttaaaaacttaatatcatgcttggttcacagaagtgctcggtaactattactcattatcatcacagttttactattattttaagatttttaaattgcaaactttcaagatgtttctagatatcatctgaaatatcttagtactaacagattaaacaatactaatatattaactagtttagccactgtacacaaattcagaattttataaacctttgaatgtttataatccttagaatatttttcctagttatttttgggaaaatttcagaatttttaaaaattgaagtgattacacccaccatccacctatcaaatggctattaacacacaccagtagatgtggtcaaaattgtacagactcataggaaaatagaattgatttggattcatttttctttcttttttatttttgagacagggtctcgctctgttacccaggctggagcacaatggcacaaacacagctcactgaagcctctacctcccaggctcaggtgattctcctacctcagcctcccaagtacctgggaccacaggtgcatgccactacacttggctaattttttaaattatttgtagagacagggtctccctatgttgcccaggctagtctcaaacttctggactcaagcaatcctcccacctcagcctcccaaagtgctaagattagaggcgtgattagattagagccactgcacccagcctgggattcctttttctacattccatttcatcttatttcacatttctaacacaaagtataaaacaaaaaaaaaaatgtaatggttagtatttcgaggaaaattaatctatacttcactggcaccataccttcctaggagaaacacaagcaccttaaatccagcactttgggaaaagcacagcaaaatatgtggacccagttagaatccgagaggcagaccagctgcttgagtactccccttccactgtctgcaaccctctaaactaaagctaatatccttgtggagcctgtgccatctgataaacacaaaccccaggtgtgaattcaacaagtgctcagcaaccggccaccatgggcatcatcgcataacgtcccgggtggatgacagtggagagggtaatgcagtcactgcttcttggagatggcaatcaagaaaggcagaccaacacacatcacttgcagaatgaaccataatacaaaaccattttttgagaagtgacacagactatacaggaccccagttcaggtgaaggaaatgtcactttctgatgaataaagagtgagtggcagagaatggtaggactattttgggggacaaggaaataaaaggttttagtagtttagggttcaaaacctgcaatacttactaggggcgtacccttgtaacatcttgtagcctcaatttcctcctctgcaaagtgggaataagtgacttactcacgggactgcaaggcaaactatgagataatctatatggagcgcctgctaacacagcaccaagcaaagtatttagtgcagagttaaaactgaggctgctgggtgtattctcaaattgttcaggatagttttgtccatctctatcagaaaagtttcttctatatcacttccatggttactaaaaacggaaaaaagctacatctacgtgtgtcacaaatgtcgtcatctccacacaggtacacagaccatttattaataccactttttgaaacccacatgtagccagactacttggctctaatttcaaattttgactagtatcctaagtatttgatacctcaatctacattcactgaagtcataagttttaatgtgatcagaataactgacttcaaagtggtctaattcaagaagctccaactttaaagttgtaaaaatgctttttgaaggttgcatttgtagaaatgaaatttgaaaagactattaaatattcaataatattaaaaggcaattacaactcctaacattctgtttgctttaggcaaggtaatgtctgtaacaagctaaggagcaaattaaaacgccagggtccttatgttttataacaacacggttctaaactctcctcatcatactaacagtatttaaaagattatacactgcctgttgtaagtcactcggacagctaatcattggaaataagtgaattaagaatcggtattaaaatacactggcttgtttttcaggtggagcacagtgagtagactggagaaagctgtgaccaagatgaactgcagaaaaggaagttttttctagtaacaacacccgtccctaaataagcaacctcttcagtctagtctagtaacacaactctgatcatctaagagatgtgttcaatttccctaagtcttcttgaaatctaaaataatttttaaaaaatgaggaagaagaaaaaaatctgatttttcccaaagattgaaatcaaacaccctttaggtgtataactattgctagtacaaatatcacagtaaatacatttttaaaaagtaccatgggtaaaatttcaaataaggtataacaatatttgatcaatattttcataacatactatgacgtaagccttcaaaatggcaacagatgcccaccttgagttcagttccagaaaatattttgtcactctagaaaaattctctctcttacttcctccaattagaaaacaacacatcagcaccatgcttccacttcagcttcgggggtgggaaaatcaaaagctaaattcactaattggagtcgtttgttcatttaagaggcctgaagccatcttctccttctgcctgctttaaatatttgctcttctgttttacaattatgtataatactttgtttaacttttaactgtaaattgcctcaagtctccttggaactaagcaatgacaaaatctcaattaattcattctctcttttggaaaataaaatgacactttaagtttataaagaaagactagcatgctgcctagttcctaagtaaagaaaccttcaaagaagaggccttaagagacatggaattaaatgttacagctgcaagtgcactataattaattacaaattctcatcgatttttattaagaggtcaatcatctgctgatagccatggaacgacagttaacgggggttggtgcaagcactttgatgcctgctgaccctcctctagtgagcatgttgtatgcccaagagaaggctctccatggccctaaaataccactcagatatttttcttatcaaacacccatctgagtttgagcatatctttttattctatttttttagcacatgtctgtagcagccagagagtttaagaataccttgagatgaagtatagacatccctctaaaaggctatgactacaagtcatttgcacttagtatgaattaatttattcagataatcttacttcctttttccacttagctgagattttaggaatagagattttgcatagagtaggtacagaaagaggagataacagtgctgaacatttaaaaagcctagaaagaagcctgtaatcccagcactttgggtggcggaagtgggtggatctcttgagggcaggggttagagactagcctggccaacatggcgaaaccccatctctactggccagctgcagtggctcacgcccgtaatccaaggactttgtggggccgaggcaggcgggtcacctgaggtcaggagagaggagaaaatgcagtataacaaaaagggagttagaatgtataagaacatttcattttccataaagtttggagtcaggcccaacatgctctcaagtatgaaatacagaaagtacaaggaggaggaaaaattctaagagaactgaagagaactgtactttaagcctggctgcttcatttactgctctccatctacaggcaatgaataaatgtatccacccctaaaggtattctaatcataataataaaagctacctagaatgtcaaaaggaattttcatatcacatatacattgtaaaattaagttttttcaatgtattaaaaaaaagactgaaaagaaatagaccaaaatattgatttttttctttaaatgatacgaattggggtgatttccccctccttttattttttccatttttcagttttatataacaagattattttacttccatgatcaaataaacataaacattaatgaaaaggaaatatgtattatttaacagccttaaattgtgtctagtctaacgcagggcatagagagaaggacagacagacagataggtatgtcagctttaattacaatttattccaatgtttagaatagtaaacacaaatatatactttattcaaacataatttaaattaaatattctttattaattgaatttatttctaactggcattagctacaaaggatgttatcaaatgaaatatttcttagtttttgataacatgagaagctgacaacttacaataataaaatcagtatcatatgctaaatacaaaaatctaatagttctggatttaatatcttccacaatataaaaagcaatcatttcagaaaagaaaccgttattaaaaagaagaaaagcttttgccatatggaacttgggttgctcagcctttttctgaaaagatgtctcaacttcatctgatggttcatattttatcattttctttgacttatatgaacttgaaggtcacccagataaagtaaaactttattcttttatattaacttttatttgatttggagttagtcaatcaaaacattacttgtttgaaaatatagacatggagaaatctttaacaagcaagatatgacagaaattaaaggctattccacaaaacaaccctgccattcattcactgattcattctttcaacaaaaatatactgacccccttccaaatgccaagcacttaattagaaacacagtgggcactgtccattgtttacccaaaaaccaccccactctttcctagcatgaagaaatactgtgatttgctgatgtagcaaacacagaactcttgatttcagggagaggagattgccagagccggggaataaatcatgattaatctaaacttaaaaaaaaaatgtatccctcatgggcactggccactctaagaacaagccatgtggcccggttttggctaatgacctgtaaacaggtacactcacttctcattattcatatattccatatttgcaaattcacttattcacttatatttatctgtaactccaaaatcaacagtcacagcatgtctgcagtcagttgtggacagaagaggaaaggccaaaaatgtgtgtcgcccaatatgtatgttcccagctgaagtcaaacaagaagacactgccttctcagctctcacagtgtaagcgtcctttttgcagaccacttggtgctctgtttttctcatttttctcgatttgactgtataatatggcccctaagcacagtaccacagtgctgtctcgtgtccctaagcacaagaaagttgtaatatatgcctcacagagaaaatgcatgttttagataagcttcactgaggcataagttatggtgctgctgaccctgagttcaatgttaatgaatcaacaatatatattaaataaggtggccgggcatagtggctcatgcctgtaatcccagcaggagtgtgaggccgaggttggtggatcacttgaggtcaggagttcaagaccagcctggccaacatggcaaaaccccatctctactggccaggcgccgtggctcacgtctgttatcccagcagtttggggggccgaggcaggcggatcacctgaggtcaggagttcaacaccagcctggccaacatggtgaaacctcatctctactaaaaatacaaaaatcagcagggcatggtggctcatgcctgtaattccagctactcgggaggctgaggcagaagaattgcttgaacttgggaggtggaggttgcagtgagccgagatcgcgctgttgcactccagcctgggcaacagagtaagactccgtagcaaaaattaaaaaaaataaaataaggtgtctttaaaaagaaacacataataaaacaaggttatgtactgatcaggtgacaaatatgttgtgactagaggctttcaggaacctaatcctgtatatctactaggaggaatgaatggctcagtattggctaattcagttttcacagtaactttataaaacatacctactggaaataataaaaatgaactacatttctaatgagagactttttttttttttttttttttttttttttttaccaattttcaaccttctcagcacaagacacaacatgagagtaaatgccaccactctgttacatcaaatagccaacttccaatttttggatgagaaaaataagttaactatttgtttaagccactacagtggaagtgtattcacaaagatgtaacaaaatggtgcttcctccttgtcagtaaacagtacagtggtcctgaaagaacacagcgaagatgttctacattctagcataccaagtcttacatatgctgcttattttctagtcaaatagagcagcacgtgttaatacttatatttctgcccttcaaaattaaggtcaaaagatcggcaataatgtgaactggctaaaatctaatttttttattgttgttgtttttgtttttgttttgagacagagtcttgctctgtcactcaggctggagtgcagtggcatgatctcggctcactgcaacctccgccccctgggttgaagcaacaatcctgcctcagcctcccaagtagctgggattacaggtgtgcaccaccacgcctggctcatttttgtatttttagtagagacggggtttcaccatgttggccaggctggtctcaagctcctgaccttaagtggtccaccagcctcagcctcccaaagtgctgggattacaggcatcagccaccacacttggccttaaaatccaattcttaataaagttttggactttattattacttagaaatatgcctagcttctcaaaaaaactattttgacacgtgataaaggaatgtctggaaaacagatatggtctgattaagatataaatatgatggtataaatattacagtattacatatatatacacacacagctctctacgtgtcttgctatttcatattgatagaaccgatcttatgttcatattgatggacattagtgttgataacaatgttttaagctattataaacaagcagggcacagtagctttgggagcccaaatcctagcactttgggaggccgaggtgagcggatcacctgaggtcaggagttcaagaccagcctggccaacatggtgaaaccccatctctactaaaaatacaaaaattagccaggcgtggtggcaggtgcctgtaatcccagctacttgggaggctgaggcaggagaatggtgtgaacccaggaggcaaaggttgcagtgagccaagatcacgccactgcactccagcctgggcaacagtgcgacactccatctaaaaaaaaaaaaaaaaaaaaactaaacataaataaaccagtataaacaacattacaatgaacacatacttgaactgtgcacttatacaattctttccaaaactttctggtctcagtcctgacttaaaaattactgaaggatcttaaagaggctttacttaggtcgacttctctactgatatttaatgtattacagattaaaattaagacgttaaaaaaataacgtattggccgggagtggtgtctcacgcctgtaataccagcactttgggaggctgaggtgggcggatcacctgaggtcaggagttcaagaccagactgggcaacatggtgaaaccccatctctactaaaaatacaaaaattatctgggcatggtggcgcacaactgtaatcccagctactcaggaggttgaggcaggagaatcacttgaacccgagaggcagaggttgcagtaaaccgagatcacaccattgtactccagcctgggcgacagaggctttgtctcaaaataataataataacgtattaattcattcaaaagtaagaatcctattacatgtcaacatattttaataaaaaataactaaatttttcaaaacaaaaataagttagtgaggaaagtggtaatgttttacttttttgataatccttttaatgtctggcttaatagaaagcagctaattttttttatgtttcttcattcaatctactgcaatgtagcttctggaagacccacagtatactcatgagataataagaataaaaaaggcaaataattctttttttttttttttttgagacggagtttcactcttgttgcccaggctggagtgcaatgacgccatctcagctcaccacaaactccgcctcccgggttcaagcgattctcctgcctcagcctcccgagtagctgggagtacaggtacctgccaccacacctggctaattttgtatttttagtagagatagggtttctccatgttggtcaggctagtcttgaactcccaacctcaggtgatctacctgcctcagcctcccaaagtgctgcgattacaggcgtaagccaccatgcccaaccataattctgaattattatcatgaaaatagttttcacttaaatccctgaaagtcccatgggtactcccagaggcctccggactccactctcattccatttctttaaagtatgtattcctagaagtaaaactgctgagttgcaagaaagcacaacttgaacaattttgcatattgacaaacaggtctccaaggcagctggaggaatttacactctcacagccatataatgagagttcccctaaatctgtatctcatcacctcttgataccgtcatttcacattctgccggtctgatgggtgaaaatgttatctcaatgtgctttcccttgacaaatggtcagggtttgagcatcttttcatgtctattcaccatgcataatttcccttttatcaactgcctgttcatagcatttgcatattttctactgagttttcttagtgaatttaatcatttgttgagtgcctgttttacaaactcatttctcacagactgtgtctgtatttcacaactaggcactatgaaagaatataatactgtaattaaatagcttacactagtgccacgtggcctggaattaaaatttagttgaccactgtgatggttgatactgagtgtaaacttgattggattgaaggattgatcctgggtgtgtctgtgagggtgttgccaaaggagatgaacatttgagtcagtggactgggaaaggcagacccacccttaatctgggtgggcaccatctaatcagctgccagcacagctagaataaaagcaggcagaaaaatgtaaaaagagagactggcctagtctcccagcctacatctttctcccatgcaatgcttcctgcccttgaacatcagactccaagttcttcagttttgaaactcggactggctctccttgttcctcagcctgcagatggcctattgtgagaccttgtgattgtgtgagttaatacttaataatctccccttcatatatatatatatacacacacacatatatatatacacatatatatacttaataaactcccctttatatatataatataatatattatatattatatataattatatataatatatttaatatattatatataatttaatatatttaatatattatttttatatattatatataatatatttatatagtatatataattatatataatatatttatatagtatatataaatatattatatatataaagcaatctccctgtttatagctcatttataacaatcctcagaaatggaaatttgtaattgatcaaccttgactaaacaagaagattcccaatggcaataaactataacatctatttccccccagagaaaatgagaaagaaaacaatattttatatatatattattaagtatatatatacttacacacacatacatacacacacacacacacacacacacacacacacatatattccattacttctgtccctctggagaaccctaactaatacaaccatttagcaactgtgtaatactaagcaatttaatctcttgaaaccactgaactaaaatgataataaataataataataacattacatgggtgtaataagaataaaacttttaaaaacttaatatcattcttggctcacaggagtgctcagtaactattactcattatcatcacggttttattattaagatttttaaattgcaaactttcaaaagctgtttctagatattatttgaaatatcttagaactaatagattaaacaatactaatatattaaacagcttagcctttctagaaaatcagaattttataaagctttgaatgtttataactcttgggatgtttttcctggttattttcaggtccttcacatatctaacaatgaaaaattactgaattaacgtaacagttgaagttattcgcagaagtaaccataggtatagctaaacagtaactacttcttagcctgaaagcaaccaaatatgaatacaataacaatgaacctaatgtttctggaaaaatcattaatccaactgacttttaaaagttttgaaaaggccgggtatggtggctcacgcctgtaatcccagcactttgggaggccaaggcggatggatcacttaaggccaggtgttcaagaccagcctggacaacacggtgaaacctcatctccactgaaaatacaaaaattagtcaggcatggtgacacacacctgtaatcccagctactcaagaggctgaggcaggagaatcacttgaacctgggaggtggaggttgcacctcccagggaggtcgagatcacaccactgcactccagcctgaggatcagagcaacactctgtctcaaaaaaaaaaagaaagaaagaaagaaaaaaaaaagttctgaaaagtcaacgtccatacccaaatagatggaaaacttctacacatttttctcatatctcagaaaaatattcagagataatacagtacattaaatacttttatttttctacctagataataaggaaggctgagaaaatcttaatgcatcaccttcatcctctcctatacacactaggctaatacgaatagttttcaatacaggagaaaaaagataattaactcttttcaggtaaactaacccatttcactaaaaagcaatctccctgtttatagctcatttataataatcctcagaaatggaaattcgtaattgatcaaccttgactaagcaaaaagattcccaatggcaataaactataacatctatttccccccagagaaaatgagaaagaaaacaacttttgaaatgtcattacttgaatgctttttaaaaactatgtgatattttaaatggaaaatgttaattatcttttaaagaccttcttctgaatgccatatccttcctattgttgctgttctttcattactggtcccataaatacactaagagtctttttgtaccatggctctggtaggttctggatatataaggatcaataagacagttcctattttcaaggactgttgatgctacgacagaggcagaatagcaggaacagcaataatgctcaccaagcgcctattatgtgatgtcaggttctgtgctagatacctgtaacatgcagttgttgaaaagtaggaatcttgaaattgagatatctgaagtaatagttactgtgctggggtgtggccatgggtatagccatgggctactgtcctaggctatggccatgggaagaggtagctagggtaaggtaaaggcaaagagaattggaagtggggacaaacagcccaggtgtcagatggatgctcaattcgctaagaatgatgttgccagtaatgataaagaaagaaaaagtgagccatgaatgttaaggaataactggaaggtgaggtaatggggagtagaatggcaaatgcttcagaggagctggcaattttgaggaagaggaaaaatggtgtaaatggatgaagaggagcaaaactgacactctctgactctctaggcctctagtcttaaaggacttactctcactggccagaactcagtcacatggccatgtctagaaagtcggaacatttcattctttagctgggcttactgccacctcgaataaaactgaagttcttttattaaagaagtgcccagcgaatatctggtagataaccagcagtttttccataaaaaaataaaaacaaaacctattatgatacctgaaattattttaacaggtataaatgataaacttgggatggcattaaagtgattaaagacactacctggtgagaaacagaggcgaacagagaccaagtttatcgatgcttttgtgtaaagttgcatacacaaaccgcaatcaagtcaaaacagaagacttgaagatgttctcataccatgaaggaagaccaatgaactcagactggtcaatgtactggaggcaacaaggacttccttagaggagtgagtacatccagtacctctttatatcgccatccatgtctcccgcagtgccctgcatattttatacagtgaataaatgtttgctaaagaaacaaatgtgtttacatatggaagtattttcaaccaggccttcaacaccaataactgttgacacttttagaagaaaatcaaagcagcccctgcagcctcagactcctccagctgtcacctatgggatccagcctccaggccaaccgcaggctccaggccagctcctgtagccccagacccctccagctgacacctatgggatccagcctccaggcccaccgcgggctccaggtcagttcctgtagccccagatccctccagctgacacctatgggatccagcctccaggccaaccgcgggctccaggtcagttcctgtagccccaaatccctccagctgacacctatgggatccagcctccaggccaaccgtgggctccaggccagctcctgtagccccagacccctccagctgacacctatgggatccagcctccaggccaaccgcaggctccgggccagttcctatagccccaaacccctccagctgacacctatgggatccagcctccaggcccaacgcaggctccaggccagctcctgtagccccaggattcagactgaaacccaaagactcagcctccgggcccagtccagccccatgtcagccgctacaactctaggttccaggctcactagaatgccaggtcagtcctcacagccctagactccaggccagcacccatggacccacgctccagcaaacccaggacccatgcccactctatagactcagagtccaggcctgcctcagtaaactcagcatccacagccttaggcaccaggctagcacctgtgaacccaggctccagaccaagccccgtggacccaggctcaccccagcaccaggccaatcccaggctctaggctggtccctgtgaccccagactctaatagacccaggatccaagctcattccagcagacccagggtccaagtccaccctggtcaaccctagtgccaggttgccccacagatccaggctctaggattgcccctgtggacccaagatccagacaggtccccacaggcccaagaaccaggtctctttctgcatactcaagctccaggctcaccccagcaccaggctaacccccatggactcaaactcaaggcccatccacatggacccaggcacccagacaatcctagtgccaggctggcccccacagactcaggctcaaggcccactccagggccaggctggccagacttcaggccagcccctacagacacatgctccaggctcgcacccatgagctcagtcaacagactcacccagtggacctcaccaccaggtttcccccatggacccggggtctagtccttcaaacccaagatccagacctgtcccagtgggcccaggctccagacccacccccatggacccaggtcccaggcctgcccacctattgacccaggcacaaggctagcctgcccaagaacttgaggtagccctccttccctcaggaggcggaaagaaggcaaattaccttacaggcatgaaagacaccaaaggaatcatcaacttggcctctgtttacacagcaggatctaccagctgggaatgcatttgaatgagtgttggggatgggtagatcagagatctcaatattcagtaaaaagaatctttctgagaacgttctcctcccaaaagggcagaaggccacaactactgaaacacaaagcctgacttcatttgagagactgactccaccccagaccaatgaatcagaatctacatcttaatcaaatgtctaggtgattcatattgcactaaaggtagaaaagcactggtctaatatacaacaacaacaacaaaaagccatatctgaaatggaattacagacaattattttggatatgaagcctctttggtttaaaaatgcattatcctttaaactgcaggcagcaagaggtaatacatcacatgaaataaaagctgttatgatgctttttggaagatgatcaaaatatcaagatggggtcaggcatggtggctcatgcctgtaatcccagcactttgggaggccgaggtgggttgatcacttgaggtcaagagttctaccaaagttaacaaataactcctttcagcaaaaccctgctcctttttcttaggccagaataaatgccaacatgtttgtttctcctgccatgttaaatatattacaagcttgctagctttcactctgttattgatatcttcaatacatgaagaggaagtgcaagataaacagaaacatttatagtcaagggaaacacaaaggcattaaataaaattaaaagatctggaatggtgagtctgattagtcagggagcagacacctggtgtcttagacaaaacaaccattaaaaaaaaggaggatggaaaatggaatgactcacttttactatatatgtatctcatatgaagtattttcttctgggtaaactagaaaataaaatgcaactattttggagcaatattataatatggaagctgagagataattatccttcagatatctttttctgtcaggctaaataatgtgtttcttcatctttccctaaaatcaggtctcataaaccttcagagtttccatttcatgtataggttgagactaaatttagaaaaatcaggtcccataatgttctaaacagagatggacacacacacaaaaagaaaatgtaaccattgaacaaaattagattatatttagaaacagaattttttttttttgagacagagtctcactctgtcgcccaagctagagtgcagtggtgccatctcggctcactgcaacctccgccacccggattcaagcaattctcctgcctcagcctcccaagaagctgggattacaggtgcccgccaccacgcccggctaattttttgtattcttagtagagacaaggtttcaccatgttggccaggctgttgtcaaactcctcacctcaagtgatctgcccgcctcggcctcccaaagtgctgagattacaggcgtgagccactgcacctggtctaaaaatagaaattttatgtgtgtatatatatcaataaaagtatcacaattactgtccttaaaaagcctaggtttggaagaaaaattataatgggaaacatactgtgacagctcagtaaaagacaactaaggtagttaactgattctcctatttactatctgtcaaaagacattatttgtagtagctgaattgagctgattttcttcatacctcagaaatatttcacccatgggacattacataatattctctaggacttacgcagtgataaatacctgaccaaatttataataaagaaatctttcattcatacatttaaaaaaaatgaaacaaatcaaaatcatgcaggataaagcttaggtattttctgcctaagaattttactgaataaaatcttacaagactaggtttttcctatgtgctcaaatattgaaaatttatcttttgtctccagcatgtctttcaaactgaatttaattggtaaattatttaaactatgtgcataacacaatacttacttgaaaattgatctgagtgaatcatgagcatgtaacatttgagacagagaactacatgcgaattttaagtactaggaataaattgaaatacttcggatatgcccatttcctaagtatacttaggatatacccatttcctaagtatttcaatttattcttaatacttaaaattcacatggcactacgggcttttaaagtattttataaatataaatattttaaaaatattaaaatgttataaatattaagccttactgcatttctgctcccacctcaaatctgtgtatactgcattaagtcatattcctaggagagaaaggacccaccttctgtaacttaaaattaacactagaaatgtttccagtaaaggaaataaaaagaattatctgagtgaaagaattcagtaaagaaccccgtataaatagtactgccctccaaactgtgcattatattgtctatgaacaagaaatgaaatggacatggaccatcaaaagcgggaactgtgtagagcggtgcttttcaaacaaatcacttttttaaaacaaacacaatcactaaaaatgcagattctaactcagtaggtctgaaagtggggcttttctgcacttgtaacaagcttccaggtgatgctgatgcctcctgtccacggaccatactttgagtaggaaggcagtagaacacatacacctttttttttttccgccactctttcgcccaggctggagtgcagtggcacgatctcggctcactgcaagctccacctcttgggttcacaccattctcctgcctcagcctcccaagtagctgggactacaggcacctgccaccacgcccagctaattttttgtatttttagtagagacagggtttcaccgtgctagccaggatggtctcgatctcctgacctcgtgatccatccgcctcaaccttccaaagtactgagattacaggcatgagccaccgcgtctggcctaaaatacatacatgttatctggaggtgcgaaagcccagtgccagaagaccaccagttaggtttatcggcttgctacagtaaaaggagaatgcgtactctaggaaactgggcatttctgcaaaggggagttaaaatgaacttgctatagagattgtgttttctactgggtgatatgggagaaggtaaagaaaacagaagtctgttgtgaattcagtgttgtcaggaaccaaagattactggtagactaaacattttaataatttttatccagggagcaggaggaacaaagaggcgctaaagttgataaaaaagcaattgtcagccaggtgcagtggctcatgcctgtaatcccagcacttttgggaggctgtggcaggaagattgcttgaggccagatgttccagaccatcctggccaatagtgagatttcacctctgttatcttttaattgttaaaaaaaaaaaaaaattgtcagtcactcatgttactgaggagaccatataagaactgagactgacccaagaacaacaaactatgttttacctcttggtctctatagacaatatgacaatgagagaaagggtgggagaaattgaccacttattacatagtttacccctcccgccgtgtatgatgtgaatcctgttatacattataagattgttatacaatcctatgttatacaatgttatactttctgatataaaaaaaaaaaacctttttgtgcacagaatatgaaaaagggactacacaataagcgagagtcttcgaggtataggccagtacattaatatcctttggggaactacctatgttatatgactctcatgaaaaacgcacaagaaaagcagatagagaatacagcaagcagactgctttgcacacggtaaagggcagtgctcagaaatactattaagaaataatattaccatttagaagcttcctttaaatgaaaataactgtggataaatatcccttctaaccaccgcatgaggcaacgtacttagcatatggtatacggtatgagctttagacatggactgagaatcttggcttcacacttaatatttataatatttagaggacaacttagttaacttttctagcttcagacttcttatctataacatggaggcaacactgttaactttgttttaaggagtaaataaaatatgcaaaacatttaatgtattaagtacctcacagttggccctcaacggcatttaaagtgaacatggtaccaaaccagattcaaaatgccagtttaacatttattcatcccacagatatttgttaccatgtgccagacattgtgtttagaaagaaatgtaatattttaaaagtacctggcttcctggagtttacagtctagcataaggacaattaatctgacaatagaaagcacaggatattaccagaacacagagcagagagacctgaagcaaagcagcagtgtgaggcagggaagtctcctcggaggaagaaaacctgaaggaaaagtaagagttctgaaggacttctagttacagctatgtggagaagtcagtaatttgttactatataaaacaactataaaatttggaaaaaattatattaaaaataacatttcagagcactgaaaatagaccaaagcagagaacaaatgaaaaagcattcattcttgaaaatcacctcgaggttgaagtcagtttctggggacctccttgtagaaagcattcattctggaaaatcacctcgaggttgaagtcagtttctggggacatccttgtagaaagcattcattcttgaaaatcacctcgaggttgaagtcagtttctaggggacctccttgtagaaaacattcattcttgaaaatcacctcgaggttgaagtcagtttctaggggacctccttgtagaaagcattcattcttgaaaatcacctcgaggttgaagtcagtttctagaggacctccttgtagaaagcattcattcttgaaaatcacctcaaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctagaggacctccttgtagaaagcattcattcttgaaaatcacctcgaggttgaagtcagtttctagaggacctccttgtagaaagcattcattcttgaaaatcacctcaaggttgaagtcagtttctggggacctccttgtagaaagcattcattcttgaaaatcacctcgaggttgaagtcagtttctagaggacctccttgtagaaagcattcattcttgaaaatcacctcgaggttgaagtcagtttctggggacctccttgtagaaagcattcattcttgaaaatcacctcgaggttgaagtcagtttctagaggacctccttgcctcaggctgcttctaccctacactcagctgccgtggtgaaaactttgacaaacttggggctgtctgcaaaagccagtatctttgctaccagaaggggcagatctgctgcgggatggggggcaaaactccaggtctttatcagctaaagtagcaaatgtggtgggagacaaaaagggaaaaaccttacctttgttccctaacgctatagtccaagttggggcaagtggtaggaggatcccttgagcccaggagttcacggctacagtgagctatgatcatgccactgcactccagcctgggtgacagagcaagattctgtctccaaaaaaaaaaaaaaaaaaaaaaaaaaaagcaaactccataagaaggaatactggaaattgttgatatgtaggtaaatataaaagcctgtatattatatactgtatttttaatttctttacaaatcctaagattggcttaaggtaaaaaccattattcagtggataacatatatagatggacagtacatgacaaaaatagcacaatgcagaatggggagggatgaagctgtatgggaacaaagttaccatacttcactagattaagtaactataaaactttcagattatgctatgttcaagattcatcctgtaatccttaaagcaatgctatccaacagaaatatgagaaccataaatataagtcacatatataatttttaattttctagtaatattttaaaggtttttaaaacatgaaactttaacaacatattttatttaatccaacatatccaaagtattatgacaacatataatcaatacaaaaattatgaatattttacattccctattaagtcattgaaatctgatttgtatttcactttagcacacataaattcagactagccacatttcaagtgcacaacagccacatgtagctagtggctactgcagtgggcagtacagcactagagcaacaacaacaacaacaacagatgacttttaaaaaaatcaacagatgaattaaaacggtacactccaaaaatatttaacgcaaatgtaatagaagaacagaggaagacaaaaaagacatcaaacctatagaaaacaaaaatcaaaatggcagacataaatccaaccatatccaaaattacattaagcatgaatgtaccaaacattcacatcaaaaggaagagaccatcaggctggagttttaaaagcaagcttcagctgggtgcgatggctcatgtctataatttcaacactttgggaggtcaaagtgagaggatcactcgaggccaggagttcaagatcagcctgggcaactaagcgagactctatatctgaaaaaaaaaaaaaaaaggcacagtggcatgcacctatattcctagatacatgggaggcttaagtaggagaactgcttgagcccaggagataaaggctacggtgagctttgattccaccactgcactccagcctgagaaacaaagcgagaccttattgagagagagagagagaaagagagagagagaaagagagagaaaaagagagagagagagagagagaaggagagagggaaaaaggagagggggagagagggagagaaggagagaggaggggaaaggaaaagagaaccaaaaatgcaagactcgaccatattctgtctataggagatatatactagattcaaagatacaaacaagttcaaaagaaaacaaaccagtaatcataagaatgctgcagtgactatattaatatcaaacaaaatacactttaagacacacatattactagagacaaggaggaacatttgataatgaaaagtaacacatttcataatgaaaagctaaatatgtaaaaaggagagagggaagaattttctgagcattaaagatccagaagcaagagaggtgctttcctatttggtactcccgtctccagctgttcatatcacattcccaactcctatcagcacaacccatggcagcatcctataaatctcatcttaccccgaacattcaatgtcttcaaattcctatgcctttgaacatacccttgcactatccataacactgacctcaatatttgcatcagaaactcccactcatccctccagtttcagcttatcaccaaacccttctctgaatacttcaccgaagcttgcaaatacctacaataaagctctcattgctctccaactatcatttgaatttccctccagactttcatcctttttttttccagtttgcagcatcaggttctatcacaaaacatgacacataataggcattcggtaaatgcttgctaaatgaaggataaacgaacaaatgaacaattgaacacatgtaggaaggaccaaggttggtgaaaatgggagttgaagatttttttcacaactcatatcagaggaattaaaatagaatgaccaggaaacatgaaacgcatgaaagaattactttaggcaataataacaataataaccaacatgagaggagcactcactatgtgtcaggtactgtgctaagtatttcacatatatcaattatttcaatcctcataataactccattatgaaggactacttttgagggggtttttagacacaagatctcactgtcttgcccaggctggagtgcagtgtggctcactgcagtctcaatctcctgtgctcaagcgatcctcccaggttcacctcccgaatagctgggactacaagaacacaccaccacatccagctaattattaaattttttgtagagatgtggtctcactctgttgcccaggctggccttgaactccaggcctcaagtcatcctcccacctccaccttcaaaagtgctgggattataggtgtgagcccaccatgcctggccttgaaggtactagtttttagagatggttcaacagcaaaaaaaaaagaaaaagaaaaagaaaaaaaaaaaactcaattagaataaagaaacatttcactaaaagaagatacacaaatagtcaataagcatatagaaacatgttcaacatcatcaatcattatggaaatagaaatcaaaaccacaaagacaggcgacttcaaacacactagaaggctgtagtttaaaaaacagagaatacaggtgttgacaaaaatgagaagaaagatccctcatacttactggtgggaaagtaaaatggtttatcacttaggaaacaacctggtagtcccacaaatcgttaaatactgagtaattatacaatccatataatgagtacaagttttattttagaaagaaggaaaatgttctaaaataggtaatggctaaacaactctgagactatgttaaaaaaaatacacagaactatacaatttaaatgagtgaagtatatgagatgtgaattatatctcaatgaagttctttttttaaaaaactaacttaaaaaatgtttaagcttgaccattataatccagttactcagtgacagaaccagaggctgcctgatcccgtgttcaggattcctacatacatcacaaaatcactaagagaagcatcacaattagctcattttcaaaaaggacttcatctatttctctcaaccaaagcaatacattctaacataagcactttgtgtactgatgtaatatttctcaaaaagttaaacagcatgagaaatttataatattagataaaattacaggctaggcatagaattgcctagtggctcatacctataatcttggcactttgggaggccaaagtaggaggactgtttgaacccaggagtttgggaccagcctgagcaacatagcgtgacccccatctctaaaaaaaaaaaaaaaaaaaaaaaaaaatttaattagccaggcatgctggcaggcacctgttatcccagctacttgggaggctgaggtaggaggactgcttgaccctgggaagtgaggctgccgtgtgccaagatcgcgccactgcactccggcctgtgcaagagagcaagaccctgtctttataaaaaaatctaaaaacaattgtcttatttctaactctgaactactttctatgctttggtgacatctatggtgaaaattgaaaactagcattaacagctagaaagaagcaaaggatttttccacatgaattccatctttcttagctttgcttttatttcacagaaacagaaaataaagaaaacctaatcagttaaattactcctctctggtgtcacatcctaataaataactgttatccttatgtccttcaagaaagaaatgatactagtaggacaatcatgtatgttttctgattactcttatcaataagtacctaaaatattaggcaaactaactcatatatagcacagctatgtagtatgtataactgacaaaacccaagatctctaacacattggaatgtaagtattcatttcctttaagaatagaatccaaacagctgtttctcaccaatatacactgtgagagaactcctgtgtacctccttgccataacgaaaggaagtttaaccccacagtacacaaacctcactgcacacacaagatcctgatgtcagaacaccaatactgaggggcgtacaatgtaaacatacagcaggaacctatggcagaggccgaaccttaatcatttccaccaacctttggaattctgctttggatttcactggaacacaggcttttgacagagaaatcagaatattcgaaaacaagaaatcaccaatatcaggctcttaagtcctattgttgtaaagactgaacaatgaacatagcagcaatcaactcccaaacttagctatgctttattatatgagagcctcccgaactcagctatgctttatgatataagagaggctcccgaacctagctatgccttattatgtgagaggctcccaaacttagctaagctttatgatatttgagaggctcctgaattcagctatgctttatgagataagagagcctcccgaactcagctactctttattatatgagaggctcctgaactcagctatgctttcttatataagacagacccccaaacgtagctatgctttatgatatgagaggctcccgaacttagctacactttattatatgaaaggctcccgaactcagctatactttatgatatgaggctcccaaacttagctatgctttatgatataagagaggctcctgaactcagctacactttatgatataagagaggctcctgaacctagctatgctttatgatataagagaggcaattcggtcacttgttgggtagaacctcctgggacaagcagtcaacagcaagaaagcaattcctgctccctccattttaaaacagaaggctctatttttaccactatccccaagcaaccaaaccagaaccaaatagcatggatcttttggaacgaggaaagctctaaatgccaaagtccaagtgtagaaatatatcttaacattttgctccatccttcaaatgtttcaatgaaatgtttcaatgctgtctgaatagcaacctcaataccaacatctctcatgcagtccaagtggaaatgttccgtttcttctattttccttcagcctgagacaaattgattcttttcaaagagtcatttcaatcatcctcacgggttctcttaaaatagacaaggcaaaaccactggctgttacgtgcctctcacaagttccacctttttcacaagtggacaatgtgcactactactgcgagtggacccccacggtcagacagggaagaggaacccaccatggctggacagggaagacgaacacaccacagtcagacagggaagacgaacccaccacagtcagacagggaagacgaacccaccatggctggacagggaagacgaacacaccagtcagacagggaagacgaacccaccacagtcagacagggaagaggaacccaccatggtcagacagggaagaggaacccaccacggctggacagggaagacgaacccaccactgtcaggggagaggagcccgatcgctgcctctatgctctgccaccacctagtgaataagaacaagaaaatcacatggcaagagcctgcagacgtcaagacacctatgatagacacctaagatgatagggtggcttttaaaacctgattttaagattacaaggttagctaaatatctgaggtagtttaccaggaaaaagaaaaatgtttagaggaagaacttggtcaagagcctttatgagagtgagggtcactatatctcatcatgtaaggggccttaggaacacaccccaaattatcggacagtctagaaaaatactatttactttaggatggaagtatgagttgctcatatataaatgacagaaataaattagcttttgcaaattgggctttataggtatacgtacatcaatatcctactggtacatgtctccatttttcttgatcctatactgtttggaaattttagtgttagcttctcagctagctgattattcattatcaaagcttttttgttcccaacggctcacttactaattatatatcaaaccacaaagctctcgaagtttctgctccctccttagcatcctatctggaccatcagacagcttctggatcagaactggatatacatcatcaacgcacactggactaattcaggataactttcctaagaccaaagaacaaactattatgcaacatcggtttattttgatacttaagataaccagtgctttcatatactcaatgatatggtttggctctgtgtccacacccaaatttcaagctgaattataatccccagtgttgaaggagggcctggtggggcacgactgaatcatggggcacattcccccttgctgttcttgtgacagtacgttctcacgagacctggttgttctcctgccagccatggtgagatgtgcttgcttccgctttgtctttcactatgattgtatgtttcccaaggaagcagaagactgtatggcctacagaatcattagctgatgaaagctcttttctttataaattacccagtctcccatgtgtctttatagcagtgtgagaactaatacactcaacaagtacaaaaactacggcttaaccacagcaacaatatttatttaccaagcatggctgaagatactaaaggagtgtgtcactgtgatgtagaatttctagagattaggaatccttaggatgggtatgctcttcggaaaactgtaccatctctttgcctgttcatggaccactgtcagtctgttgcctgttagaaacctggctgcacgacaggaggtgagtagcgggcaagcaggcattaccacctgagctccacctcctgtcagatcagcggcagcattagattctcatagtagcataaaccctgctatgaactgtgtgtgcgagggatctaggctgcacactccttatgagaatctaataataaatgtaatgtgcttgaatcatcccaaagccatcccctgtcctccagtctgtggaaaaatgatcttccaagaaaccagtccctggtgccaaaaaggttgggactgctggtacatcatatattagctctgtgaccttcttaactatttcagatgataccttttgtgctctcggttgaaaaaccatctccgaagataggagctattttaacacagctatcctaaattccttacttatccatcatggaaaaaaacaaatgtttattattgccaggccctcaagaagtgaatggtctagtaggaaaaatatacctagacagatgtagtcacctgatgggttcttcttgcctgctgcacagatagagctgattcagagacaacagtataaatgacagcagtggagaaagaggttacaaacacagagccagccaagcaaaagaacaggagtttattactcaaatcagcctccccacaagctcggggaccagggcttttcaaggataattcagcaggcagggggacagggaatggggaatgctgactggtttgggatgaaatcataggggtgtagaaaacaggccttgtgtgttgagtcggcctctggggtgggggcacaagactggttgagtcataaaaaaaaaaaaagcaagaaaagaaaagaggagaggggaggggaggggagaaagaacaacaacaacaacaacaagactggttgagtcctgggtcgtgggtctgggtggaatccgtcaatcactagaatgctaaagtctgaaaaacatctcaaaagaccaatcttaggctctacaatagagacgtcatctgtaggagcaattggagaagttacaaatcttgtgatctccggaacaatggctggttatggtctaactatccctacatctcagcagaatttcaggctcttcccatcatcctaatctcatcggctttcattaattttacaaaggcagcttcagtccctgagcaagaagggagttaatttgagggagggactgttttcatccttgctccaaggttaaacgacacactcaattcttcccgtggttagtttggcccacgcccagaaatgggcaaggacagcccgcctgtgagcttagaaggcggagtcagccatgctggacttctctgtcataatcattgcaaagctggtttcatagatgagaatctataataaggtatggtaaaagctaccatagagagatgtacaacatgcagtggtgatgacctctacttgggaatagcttcacaaatgaaatacttagagtggttcttaaagggcaagggttaaaccaggctgacaaggaaaagcatgtacaatggtaaacagtacattcaggggactgtaaatagtatagagtgactgaagcacagagcacaaagagggagacactggggctcaggttagtcagatcagcaggagccaaaaggaggaggagactggaagagaaaaactgagaatgaggtatgcacaatggaggaagataaacaggtgagagcattcacagaacccaaagaaacagaattcaagaactagtgatgagtctgacaagagctatataaaatagacagtatcaaacaacatccaacacccagccctctttctactattaataaaaagactgattgcccagcgtaattagtcataccataaaggagtagatagttgtagattttctcttgagatttcaactgtacacaaatttttcatatattttatttttattttatcttatttatttgttttgagacagagtcttgctctgtctcccaggctgcagtgcagtggcatgatcctggctcactgcaacctccgcctcccaggttcaagcgattctcctgcctcagcctcacaagtagctgggactacaggcatgtgccaccacgcccagctagtttttttgtatttttagtagagacagggtttcaccatgttggccaggctggtcttgaactcatggcctcaaatgatccacctgcctcggcctcccaaagtgctgggattacaggtgtgagccaccttgcccagccccatattttatttttatttatttatttttgaggcacaacctcattctgtcacctgggctggagtgcagtggcatgatcactgctcactgcagactccacctcccaggttcaagcaattctcccgcctcagcctcccaagtagctgggactacagatgtgtgccaccatacctggctaatttttgtattttttttacttctttgtacttttgggtttttccacattgcccaagccggtctcgaactcctgggctcaactgatctgcccgggtcagctttccaatagtgctgggactacaggcgtgagctaccatgcccagcctctcatttttaatagatactattttaaaaagtactgtgaaaaagaaacaaaaatgaaaaagacacatgcctatccttaaggaacttatgtcctaccaaactataaagtaagccataccatttatggatttgtagcaacatgtcatcctgtcaactttattactgaggctatgagatgtattaacattggctttcaaattatttgtattagcaaacataaaattcaagcatagaaattgagtctgatctaaaaatcagcaaattacaattatgaatttgttatattctcactgtatccacgtcctcaaaactctgacattagcaagccattaaacaagaccactaagattacattaattttatactaaagttgtatgctaaaattttcatctttctctgtttcatctttctctgttttcccaaaagaaaaaaaaaggtaaagatcaaaagttatatatttcagatatataatcctaaaaaatgctccattgctaggtgactaattttaagacactgccatcagtttaacaggtcactcgttcatttattcatctaacatttatttacccacatactgtgataggcagtgaggaataagcacagaacagaaacagtgcctgccttcacaaagcttagtctagcaggatagtaacttaagacactgaaacagtatattaagtgccttttacaaatattcttcgcagctataccagctactacttgcatttcaacattttatttcaaagccattatttatttgtttgtttattttttttgaaatggtgtcttgttaggttgcccaggctggtctcaaactcctgggctcaagcagtcctcccgcccgagcctcccaagtaactgggattaccggcacatgccactgtgtctggatccaaaaccatttttttaaaattatttcagtgttaagacaactttaagaaacaatattatgattggtatcggtcattaattgtgctattttatgacttcaatcttttgatgcagtatagtttcctggccatttccaatagaaaattccttgcccctttcaggctactgtagttgagatacaagacttgagatatttttctaagagaaaacaaaacaaacaaagcagccaagagaaacaatatcagccatgtaataaaatacccaatgtactttatttcattatcctaggcaaataaaaaaaaaaccactatgaattatacagtatacaaatatgttttcttcggaaaacactgaaaaacagattcatgtggaaagaaattactttattcctaccactgtctttttcagacacactcaaaattcataaaattcacaaaatctgaagctcataaatcaaaagaaactgttcatacatcatgaacactatactaactttttaaaaagtattcgaggcagctgaacatcatcacagtatcttaagactcatatttccttagattaattcagtgatcactttcaaagcaaagctttttatgaaagctaaaataaaatttctaggtaaccaaggagagtctttcaaatggaaaaaagctgatgatattaaactctaaaaaataaggcccaggcatggtggctcacacctctaaatctcagcactttgggaggccaaggcaggagtatctcttgagcccatgagttcaagaccagcctgggcaacacagcaagaccccatctctatttaaacttttttttttttgagacacagtcttgctctgtggcccaggctggagtgcagtggtgcaatctcggctcactgcaaactctgcccctcagatttaagatatcctcctgcctcagcctaccaagtagctggattacaagcatgtgccaccacacctggctaatttttgtatttttagtagagatagggtttcaccatgttggcgaggctagtcttgaactcctgacctcaggtgatctgcccacctcagcctcccaaagtgctaggatacaggcatgagccaccatgcccagccttaaatttttaaaaataaaaaatagagtatgtaataatcatataaagttctaaaacatccagtagcaatgttcttaaatcccagtaattcaggtgcttttttttttttttgagccagtttcactcttgttgcccagactggagtgcaatggcacgatcttggctcaccacaacctccacctcccaggtccaagcgattcacctgcctcagcctcccgagtagctgggattacaggcatgtgccaccacgcccggctaattttgtatttttagtagagatggggtttctccatgttggtcaggctggtctcgaactcccgacctcaggtgatccgcccatcccagcctcccaaagtgctgggattacaggcgtgggccgccgtgcctggcctcaaatactattttaagattgttcatccataatacattgtagtctgaaagaagaataacctctctaaacagtacctattaccttcatcctctctttttccaatataatggcaaaagacagagttgtgatatttttactgtaatcacagaaacatcaattcaacatatataggattagcatatcacacatttcagcaaatatcaaaatacagatgtttcttcatcctgatgaacaaatttattattaaacttgccaactattttccaaatttataaaagaccataataaaatgtgaggcaaaactgttcaaaccagttaaaatgagtctcgatcagctaaaatgattaacaacgccatcttaaagatgatcccatatctgagcacgtgatacctctgtgatttcagggcacaaatccctctatccatcaaactaaatagaagggttagagaggttaatcgagacagagtgtctgtaacagacttctgcatttcattctccactcaatatacttcaaacatcattgaactatttgttatgttcttatgaatcaatgctcccttcacagtcaagatagaggctagaagccactgtgtgaagtaataaagcttacctttgcaaatcctcatcaagctgatctgatgattaagtctatgtgaggcttcctaaacaactgaagtgtaatcacaactttaattagaagctcaaatggcactgctaaacacctaaataaaacatgagcaagtacaatagccacctgcaacgagcaatgccattttccagcctccatttactataaagagatttttctctattcagctgcacaatcacttgggctacatgatctctggcctagcaatagcagtcaataatttaaaatcatgaaaataaattttcaatctatacttaagttctattatgcactggtggtagtcaaaaatgtcacagactgaataaaaatgaagctcactcatttgctaggctggcaccccattctacccgaactgtccattaagagtcaccattaaaaacaaacaaaactcatatggcaaacttctgataaaccaatttactctatttgtggctgattaagggtgatcctggactacatggcttttttagttcctccctgactaatggaaaattactagaagagtaaggactacacagaactagttgcataaattacagttggccaggtgcagtggttcagcctgttatcccagaaatttgggaggccttggtaggaggactgctttaggccaggagtttgagaccagcctgggcaacatagtaaggccctgtgtcttaaaaaaaaaaaaaatttaattagccagaaatgatggcacatgcctgtagccccaagtactcgggaagttgaggcaagaggattgcttgagcccaggagttaaatcagatggcattagtgatggttgcacataccaagaaaaatatatcccagtttccttctttactccctgttttaaacatatatcctatcttcctagttcatctcctctggtctctccttctatgagatatggataatttattccctatccttgctgccttctaacagtagtataagagaaggtataatcagtggtaagaacatttaactaggaaataacccagaggtccactgacagaaaaactgataaagtgtggtctatgctataccacagaatatcacaaagtggtgaaaattaataactaatgctatgtgcaataacacatacatgctgaaaatgtaatgctgagcatttttaaatttcataagactatattcagcaatgataccatttatagggctcaaaaaacaagaaatatatatccgtgttcaagcacacatacatttgtgacaagcatagaaaacatatacaaagcatgtgaaacgtctcagataccctgattcaaagtcaagggtctcatggaaatttattcaggtttggatgcacacctgacttggcatgtatgctgctctacataggacacacccaacacaaccaacctagtgttgctctaaggccgctaacctttaaaataaataaagccagccagcatatcacccttcattgacctatcttaaattcgaatcacaatgatagctgtaagtggaaattttttgcttttcgttataaaagctttacacataccctggtggccaccgctgctgaggtcagcagcaccacggcagctgtgaaaggttagcagttttgtttttgtgtgttgaggccttggctcaagatcccatctgtgctgacttcagactgaagggaacacatttcctccagcctgaaaactgaaacatatgccgcaataattagagcttccttgagtcagttcagctgaacccaggatgctgagactgataacctgtgagcacactagaagacttcacatacggcacccacctgctagacaaagacagacatgaagacatggccacgaggcctccatatccaaaaagacagaagtcccatcatctatatgtattatgtctatatctgcttgcagactcctgcttctgctaaaaagtacagtgaggagtttgcaagttaaagagacagaactaagtcaacaaaactgcagcatttagaaagcccctgcaagcacttgatctctgcgtcctctttacttgatctctgtgccctctttacgtgatctagacttgtgctctccaatactggccacatttggctagttaatgaaaattcaataaaattgaaaatcaacttcctcggtcacattagccacatttcaagtgatcaataaccacatgtgactactggctgattaccatattggacagagcaagtataaaacctttctttcattacagaaagtgctttgggcagtcctgacttagacactaatccacttttttactcttattatattgactcataataattgtaaacatttatgaggtacagcatgattctttttttagacgggatcttactttgtcactcaggctgaagtgcaatagtgcaatcacggctcactacaacctcaacctcccagactcaagtcatcctcccacctcagcctcccaagtagctgggactacaggtgtgcacgaccacacctggctaatttttatattttttgcagagatggggtttcaacatgttgcccaggctggtctcaaactcctggactcaagtgatctgctcatttcagcctcccaaagttctgggattacagggatgagccaccatgcctggccatacagtatgatatttttacacgtatacacaatgtgtaatgatcaaatcagagtaaagtagcatatccaccacctcaaacatttatcatttatttgtgttggtaacactcaaaatctgcctttctagctactggaaaatatacaatacgttgtggttaatagacactaatccacttttaaaacaaaaccaaaaccgccaccagcatgctgaacatcaaaatcccagagctagccagaaaatgtcaaggattagtcacccagcacaattaatctgagatggtccacaggcttccagggttgaggcttctcttaagtggtgtctttattttatttcattgtttactgtcgcacagcgattaaaagaatggactctgaggccaggtgcagtggttcacgtctgtaatcccagcactttgggaggccgaggcgggcggatcacgaggtcaggagatcgagaccatcctggctaatacgatgaaaccccgtctctactaaaaatacaaaaaaaattagccgggcgtggtggcgggcgcctgtagtcccagctacccgggaggctgaggcaggagaatggcgtgaacccaggaggcagagcttgcagtgagcccagatggcgccactgcactccagcctgggcgacagagcaagactctgtctcaaaaaaaaaaaaaaaagaaagaaagaaagaaaaaagaatggactctagaattagacggtttgagcctgaatcgctgcaacagtctgttaattattcaaactctctcattctcctgtaggttaaatcgctgcaacagtctgttaattattcaaactctctcattctcctgtaggttaaaatgggattttttttttttaaatagagacagcgttttgccatgttgcccaggagcttgaactcccaggctcaagcaatctgcctgcctcagcttcccaaagcgctgggactacaggtgtgagccaccgcgcccagccaaaatggggatactaatagtatctacctcatagatttgtttaaaaattaaatgacacaatgtttgtaaatctattagtaccatgcttggcatagagtaagagctctataattgttagctattaactattattatccttgccaaaaggaaggagaagaaaagcatgaggctgaatttttgaattttgcccattaaaaaatatcggagctctggtaaagatgcactatgagagaaaatcaacacatatgatctgtttcatcttcagccttgtagtttaataatttcctttctcacctttaaaaagcttgtccttgccttttcgctcttcttgtaagtctctcttcagtgcaccgtgtccatagtgctacgtgttaggcactattcaaagcacatgacatgtaccagcttaataaattctcacaacaatcctacaaggtagatactcaatgtgcctatttattttcaagtgaaaaaacggagacacttagaggttaggtaactagtgcaggatcacatagctagtaagtgacagtgtcactggctccaaaagcaggcagtatggatgaagaatctctgctccatcacagccatcgtgcaaaattgcttcgatatgcagcagtcctcccttcaaaacaaacaaacaacacctttcccaagctatcgacctggtaatattattatagtttatttaattagattggcaggacaggcaaggagaagtctcttgggatttggatatgacagcagctctcattgtcctgtcttctgactaaatcccctgggggatgtggatggaataaaactctgctattcagaagggttggcattgccccctgggaggtctggaaatttatgaggatagtttggttttcacaataattggggggtaccatcactctgaaggagacaaaggtgcttatatcccacattatctgtcacaatcacatacaattttcaaatgtccactttagacaatttaggtctagattgtaactgctgattatgtataaggagcaattctcatattgttctagtgtatttaatatagttctaagattgcaaccaccaggtaaaatgaaagaaactggtacttttgtcttcaaaaccttagcaggagttgttcatcatctgagactataaggtcatgctatttgaatcccaaagacaacacagctgtatcagtctccaattagagccgcacattcacagtaaggctgcgccatgaccgctctcctagtgccaaaacatttatataaaacaatgtcctaggcagctgaggctgctataacagaataccacacattgggtggcttatatgcaacaaaaatctatttttcggccagacatggtggctcgtgcccgtaatcccagcactttgggaagcagaggcgggtggatcacctgaggtcaggagttcaagaccagcctggccaacatggtgaaacctcgtctctactacaaatacaaaaattagccaggagtggtggcaagcgcctgtaatcccagctactcaggaggctgaggcaggaaaatcacttgaacctgggaggcagaggttgcagtgagccgagatcacgccactgcactccagcctgggcaacagcaagactccgtctcaaaataaataaataaataaataaataaattatatatatatattcactcttgaggaggctgggaaatccaaaaatcaaaacgtctgcatattcagcgtctgagagctcactgctcattcagtgtaaatgaagaaacctgagggcaggtttcttcatttacagatggtgttgctgtgtgtcctcacttggcagaaggggaagtcagctcccttgggcctcttttatgagggcgctaatcccattcatgaggactctgccttcctgagctaattacctccccgaagcaccacctcttaatattatcaccttaggggttaagatcacacagcatataaattttggaaggacacaaacactctgaccacaacaggtaatagacaccatttgataaataattttccatttatttcttctttatattttcattgggtcattatattgctattttgaaactgtctatataaatagttatatattatctaagactctcccttcaggatagcatttgtgtgtgtgtgcgtgcatgtgcatgtgtgtttcaaaatacatgtttataaaaaggggttttgtgcttaataggggtgatgtcctctgctcggcatctctgggaaagaactggtctacagaataagctgttgctgtttcctatcaatattttactatacaggaaaatcagagctacatgtccttaacaccagctttctggtgagggaattactgataagtaatgagaattactgataaacagagagaaaaatgaaatttatgagttctccatcaagttctggcctctccccatcctaatccctatctcagaagcaagtcttttttttttttttttttttttttgagatggagtctagctctctcacccaggctggaatgtagtggtgctatctcagttcactgcaaactctgcctcccaggttcatgcaattctcctgtctcagcctcctgagtagctggaattacaggtgcctgccaccacacctggctaatttttgtatttttagtagagacagggtttcaccatgttggccaggttggtctcaaactcctgacctcaaatgatctgcccgcttcggtctcccaaagtgttgggattacaggcgtgagccaccgcacccagccaagtctttaaagtataaaaccttaaggttcatatccttcacccactttttgatgggtttttttttcttgtaaatttgtttgagttcattgtagattctggatattagccctttgtcagatgagtaggttgcaaaaattttctcccattctgtaggttgcctgttcattctgatggtggtttcttttgctatgcagaagctctttagttcaattagatcccatttgtcaattttggcttttgttgccattgtttttggtgttttagacatgaagtcttgcccatgcctatgtcctgaatggtattgcctaggttttcttctagggtttttatggttttaggtctgacatgtaagtctttaatccatcttgaattaatttttgtataaggtgtaaggaagggatccagtttcagctttctacatatggctagccagttttcccagcaccatttattaaatagggaatcctttccccatttcttctttttgtgaggtttgtcaaagatgagatagttgtagatatgcagcattatttctgagggctctgttctgttccattggtctatctctctgttttggtaccagtaccatgctgttttggttactgtagccttgtagtatagtttgaagtcaggtagcctgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatagcttttttcatgatattgattcttcctacccatgagcatggaatgttcttccatttctttgtatcctcttttatttcattgagcagtggtttatagttctccttgaagaggtccttcacgtcccttgtaagttggattcctaggtattttattctctttgaagcaattgtgaatgggagttcactcatgatttggctctctgtttgtctgttattggtatatatgcttgtgatttttgcatgttgattttgtatcctgagactgctgaagttgcttatcagcttaaggagattttgggctgagatgatcgggttttctagatatacaatcatgtcatctgcaaacagggacaatttgacttcctcttttcctaattgaatgccctttattcccttctcctgcctgactgccctggccagaatttccaacactatattgaataggagtggtgagagagggcatccctctcttttgcccattttcaaaaggaatgcttccagtttttgtccattcagtatgatattggctgtgggtttgtcatagatagctcttattgttttgagatacgtcccatcaatacctaatttattgagagtttttagcatgaagtgttgctgaattttgtcaaaggccttttctgcatctattgagataatcatgtggtttttgtctttggttctgtttatatgctggactacatttattgattttcgtatgttgaaccagccttgcatcccagggatgaagcccacttgatcatggtagataagctttttgatgtattgctggattcagtttgccagtattttattgaggatttttgcatcgatgttcatcaaggatattgggtaaaattctctttttttgttgtgtctctgccaggctttggtatcacgatgatgatggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttcagagcctgttattggtctattcagagattcaacttcttcctggtttagtcttgggagagtgtatgtgtcgagcaatttatccatttcttctagattttctagtttatctgcgtagaggtgtttatagtattctctgatggtagtttgtatttctgtgggatcggtggtgatatcccctttattttttattgcatctatttgattcttctctcttttcttctttattagtcttgctagcagtctatcaattttgttgatcttttcaaaaaaccagctcctggattcattgattttttgaagggttttttgtgtctccatttccttcagttctgctcttctcaaaagaagacatttatgcacccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaagtaggaacacttgtacactgttggtgggactgtaaactagttcaaccattgtggaagtcagtgtggcgattcctcagggatctagaactagaaataccatttgacccagccatcccattactgggtatatacccaaaggattataaatcatgctgctataaagacacacgcacacatatgtttattgtggcactattcacaatagcaaagacttggaacgaagccaaatgtccaacaatgatagactggattaagaaaatgtggcacatatacaccatggaatactatgcagccataaaaaaggatgagttcatgccctttgtagggacatggatgaagctggaaaccatcattctcagcaatctatcccaaggacaaaaaaccaaacaccgcatgttctcgctcataggtgggaattgaacaatgagaacgcatggacacaggaaggggaacatcacacaccagggactgttgtggggttgggggaggggggagggatagcattaggatatatacctaatgctaaatgacgagttaatgggtgcagcacactaacatggcacatgtatacatatgtaacaaacctgcacgttgtgcacacgtaccctaaaacttaaagtataataaaaaaaaaaaaaaaaaacttaaggtacagcagccactatcctgtctcttccccttgtcacctctccctggctgagccaacttgctttgcgttaactacctttctcacacatccccaagagcctacagaaaaggtctatgatcttggcttgttactaccaaatcatctcaaacctctcagcatctttacctactcagttaagtaaggaaactcacaattccttgagtagttcctgtagccctctcccagcctgaatggctcttcctggtgttgccgatgctaatcaatgactgaacacaggactgctgtctctctcatttctctgaactagctggcatatctttactttcttccctcttggcttctaatgaagacaaaactgcattgcctaattatcctttagaaagaaaaccttaacattctttaatacttgatctcttttcaatgccttctatttgtttctgtaattcagctaaaaatagttcagccattgaaaaaaatagattccaataaaacatattgaatgacaactatttaatgtgttaaaaagaatactacctgatttttttttttcagtaaactaaaaagcttcctgaatttgcagcattcttaaattgaagtaagaagtggagagacactttgggcagccgaggcaggcggatcatgaggtcaggagttcaagaccagcctggccaacattgtgaaactccatctctactaaaagtacaaaaaattagctgggtgtggtggccggtgcctgtaatcccagctacttgggaggctgatgcaggagaatggcttgaactcgggaggcggaggttgctgtgagccgagatcgcaccattgcactccagcctcagcaacaagagtgagactccgtctcaaaaaaaaaaaaaaaaagaagtgggaagaaagggagaagagattaatatagtagcagtttttaaatgttggtatgtaccagatcttcctaattacctgataaggaaggttacccataatttataggttgaagaaatcaaggcagagaggttaaacagtttgctcaaggtcatgtatagacacctccaccctcaccctcaaccagtgctaggattacaacccaatttgtctaattctattacatcatgctaccactctacagtaattataattagtgctaacttcataccaagaactgtgctaagtatctcatttagtctttataataaccctatgacgtaggtaccaaatttagcttcattttacaaatgagaaaattgggcacagaaagaaagtcaggttgcccaaagtcacacagtaaatagtccagcttatattcaaatccaggaacctgactccagaacctatgcccttaatcattaggcggcactctcggatagaattaaaatccaccaggcaaaaaatgagtaaatagctaatttttatcagtaaagattactgaggaaatcacaacagcgctattcccaacagaatgatttaacaatagctatgttcatgaggatgcatgatatagtttgaatatacgtccccaccaaatctcacgctgaattgtaatccccagggttggaggtggggcctgcagggaggtgtctgggtcatgggggaggatctctcgtggcccagtgctgtgctcatgataagatacgctcatttcaaagtgtatgatgccccacccccacacactagctcctgcttcctccatgtgacgggccagctccgctttgccttctaccatgattgtaagctcccagaggcctcatcagaaaccaagcagatgccaggtgccacacatgcttcctacacaggctgcagaagtgtgagccaaggaaacctcttatctttataaattgcccagcctcaggtacttctttatagcaacacaacagcagcctaatacaatgcactagcaaatcaaagtgggatttttgtttagtccacaagtgattaaaactccgaaaaaacaaaaccattaaccttacgaattaaatatcttcttttgatgggctaatgtaatattgaatatgaagtgattagaaagtaattccccaaaatttctgtctgtgggtggaaagaggggtggtatataacagcacaacacagaaatgtatccctacatgtgcctggttgaaaattcattttctctttggaatccaggctcctcctacccctagagcagtcagagagacatagctaccaaatgcaaaacagaatgcagtctttagagagagaccaccagggctgagatatcacccactgttatttacaaataaagccagcagtgagagatgggacagacatattagaggaaatcaaaagagtcatttttaaatgttaaagatttttcttggaaaatatgaaaggaaaaactaagaacattatcttggtaagttagcaaagccctgaagcaagcattggacatcccaaatcagccacatgggacacagaggagggtccacatagaaccaaagcctgtctcttctctacaaggttaaggtttgagtttcctagaggaagaaacaagagatttagaatgcatggtgtcatgtaaatcactctcactgtcattatttttaaggcttttacgtatatattttaactgcatactatatgtgtaaaatatatatattcatatacacataaatgcacacacacacacaaatacatatgtaaaaataaatgtacagctgattcaggtaaatcataccaggaaactgaagccagttttggtttttttgctggttttttttttttttttttgagatagagtcttgctctgtcgcccagaccagagtgcagtggcatgctatcggctcacagcaacctctgcctcctgagttcaagtgattctcctgcctcagcctctgagtagctggaattacaggcacacaccaccaggcccagctaatttttgtatttttagtagagacgacgtttcaccatgttggccaggccagtctcgaactcctgacctcaggtgatccacctgcctcggcctcccaaagtcctgggattacaggtgtgagccaccgcgcccggctggagccaggtttttgacatccacattgggtaaatcctggtgagcagaacagcacccatcacaaaatactgccttaatttaaagctattccagctaggtctgtttcatattactgtaatgaagataatagccaaaacatgataataaaactaacaaacccctggaattgttaacacagatacactgtcaacaatttttctacaaaaactgccatgtcagcttaagtgatcttttcttctctgaacagttacagcatttaccttctctaggcttaggacccagagatgcaaagggaaaggcaagtgttgtgggctcaccccccacttctaatataacagcaataataatagataaaatgtatatcgtacttaccacgtcccagactgtttttaaatgctttaactactccattatttttaatcctcacaacaatcccattattagtccatgtactaacaaggaaattgacccagagttgaggtaaatagtcccaggtcataaagctagttcatagaactagatctagaaccctggcctccagcactaaaaattacataaataaataaataatctttgctcacttatttttttaaagaccagtgaactatgctcagcccaggctagactcaaactattgggctcaagtgatcctcctgcctcagcctcccaagtagccaggactacaggcacacaccatcatgcccggctttcaccattttttcactcttttggttcagtttaagatttcatttagagaaaaaaggttttataccatttaaaataaaaacattgagcaccactagtctatatagtttatttatctattgccactcaaactctgatgtcatttttatggtgttctggttgcactgtttaattctgttagttaactttccgtatgttatgccttgaactgcatacatgtacgtagaaactcccacacgtaagtacactagactggaagttcttagagaacttatattctttgtattaggttggtgcaaaaggaactgtgggttttgccattaaaagtaattaatatctcctatgttgcatacagtacaatgcattcacaaataaattttttgagaaataaacttgatttaactgttcaaataaatttttatcctggggtaaatagttttagtttaaactatgctactggtaataataaacaatccttaagaacatcatatgagacagcagttctgcccaacccactcccaatttcttacccatgcggtgtcactaatcaatttataggttggaacaagaaaaaagttttacattacagaactaataaagcatactttccctgcagagggaccactactgtgacttaaaggttctaattaagtttttttctttgaagcttagtattcaaatctgcattcttacttgattagtattcaccaccattatttttatgcagatcacatgaaaaatgaaccctatgtgccagaataacttgcaagaaattactattcatcagcatgaatcaacaagcccacaattagaacagtgtccactgggaaaagtaaaaaaaaaaaaaaaaaacttttactaaggtcatataaaatgaaagtaaagggggaaaataaagaattcatttttgcattgaaaatcatacaaacgttttcagcagaaaattactatgactattattggggctcagaaaatgatatcctgaagtatggtgctttcatatgctgggcacttccgaattttaaaaaaacagaagaccttagaagctgcctcagaaccaaggactctgtaaccttctcctgtatctctccaactcccaaagcacagagaggggctctctctggaatttccttatcagactaaggaaactttttccttaagaaatacaattctcttaaacctcctccccagaaatctcattaaattaccaggaaagattaacctgagaagaaaagaatctataataagtcattgccaagaccagacagactgttcgtctgttcttcagagggcagctttgagacattacccgagagacttcaactgcataatacaacaacctctgttcaccctacagttcctccctcaacttcccataacttgtgggtcccattcagtttccaaagagaaccatttacaaactactgtctgctccttggatccattaaactctcctaaaatcactatcccccaaaattgcctatattcccccatctccctgactgctagaaagagagtgccatttaagctgtggctatctggcctttctgttacagcccaacaggttcttcttacctgctgcccagaaaagccaatacacggagaacagtaggggtgttgcagcagagaaagagtttaattactgcaaggcagctgagcagaaggaggggaggtatctctcaaatccacctcctcgaaagcttggagcccagggtttttaaggataatttggcaagctgagggccagggaatgtatgctactgattggttggagatgaaatcactggagtgttggaactgtcttcacgtgctgagtcagtttctaggtgggggtcacaggacgagttgagtctgttccttggtatgagtcatggtccagatggcatcagtcagtttaccagaatgcaaaggtctgaaaaatatctcaaaaacccatcttagggtttacagtggtgatgttatctcaaatcttgtgacctccagcagtaaccaagctagggaacaatggctggttatctcttcttcactgtgcttattacttagcagaattcaggcccttatcataattctaatcttattgactttcattagttttacaaatgcagtttcagttcccaagcaagaaggggaccagtttcaggaagggactattatcatccttgctttaaagttaaactgtaaactaaactcctttttagttagcttgacctacacccaggaatgagcagatagtcagcttctggggtcagaagcaagataaagtcagctgtgttggatttctctaaccatcataaccttagcaaggtggtttcagttctctgagtctcatatactgtgtggcccctgtgcttctgcacattaatacatttatatgcctcttcccctgttaatcagtctaatgtcaggtcatttcagcactttcaaatttcagagccagagggggaggaaaaattatcttcacacctatactctctaagaccaaaaagcaacagacattctgccacatgctacaagacggataaaccgacaaatattatatggttccacttataagaaacatgaagagaaagtagagtaaaggttcccttgtccccctctgccacagagggagtggcttgcttcttcagcgccctgctgctcaaacctctagggggagcatacagatgggcacgttgtggggctcggaccccatggcagtgtctagaggtgtatgtttacagctcctgaagccccagtgggcatgtgttacaaggtgctcttttaatctagccgtctgtaggcagcttgtgttagtcagctcaattagacccccttccttatcacaaggacaaagggatttctatatcctggggtttcttgctttggtgaactggaagaatcagatcacatgtaggcttggagaataagtgcaaggttttattgagtaaagtagctctcagcagatgggggagccagaagggaaatggttttctcccggagtcgggcgctcggtgacctgggctctcctccaaccgtcccagccaaactccacgtcgttctgctggccgacggcctcccagcgtgctggcatctgttgctgtgctcttctgcctgcgtgctcccctttgtcaggcctctgagcccaaggtaagccatcatatcccccgtgacctgcacgtatacatccagatggcctgaagcaactgaagaactacaaaacaactgaaaatagccagttcctgccttaaccgatgacattgcaccattgtgatttgttccctccccaccctaagtgatcaattgactttgtgacaataccccctccccgcccttgcgataatggactttgtgatattcctccgcccttgagaatgtaatatcctttgtaatatcctccccacacttgagaatgtactttgtaagatccaccccccactagcaaaaattgctcctaactccaccgcctatctctataagaactatagataagttcttatagggataaacctataagataaacctataagaactaatgataatcccaccaccctttgctgactctcttttcagacttagcccgcctgcacccaggtgattaaaaagctttattgctcacacaaagcctgtttggtggtctcttcacatggacacgtgtgacaccctccacgtcctcccgatgtccggccacttgtcttcttccaccaatgtgttcctctcaccctccagctgcttctgtctgtgccttgctagggtcttgggtttttataggcccaggatgggggcgtggtagaccagggtagtcttggaaaatgcaacatttgggcgcaaaggcagaagtgcttgtcctcacctaggtcgatgggggtagcgccctagccagggaccatgccctcctctacccagcacttcccttacccccttcctcatcatttaaagggaccacactcttcccttcccagcactcccgtatcacagtcagtggtggcactggattctcataggaccactaaccctattgtgaactgcacatggcagggatctaagttgcatgctccttatgagaatctaatacctgatgatccaaggtggaatagtttcatctagaaaccatccgcccccctcactctatatccctggaaaaactatcttccgcaaaaccagtccctggtgccaaaaaggttggggaccactgttttcagctaaaaagtctgtcacgacttgagctgtggctcatgcctgtaatcccagaatttcgggaggccgaggcagggggatcacgaggtcaggagatcgagacttctccatcctggctaacacggtgaaaccccgtctctattaaaaatataaaaattagccaggtgtggtcgcacatgcctgtagtcccagctactcgggagggtgaggcagaagaatcacttgaacccaggaggtggaggttgcagtgagctgagattgtgccactgcaccccagcctgggcgacagagcaagactgtctcaaaaaaaaaaaaaaagtctgtcatgacttgatatagcatcaataagaagctaatacataaaccactcgatgaggagtttagaagatgaagttgaactgaaagtacagcaaaaagaaaactgactccatcatgcaagagactgctcctacagcttggggttggaagtaaataaaataattaaaggcacagtgacttcacagcacgcaataaacatgtattaagcacctacttcctaaagcccactgcagtcaatgataattcagtcaagctgaaatcatcatcatccaaggttcgtttgtaaataatttaacagtttggagagaatatgtgaagaacaacagttttatttccaagaattcatgaccttatctagagaaagtttatgaatggacagagaagatagtcttatatttggcatgatttcctacgcaggtgaaagattcaactgcccaaaaatatctgatctttggcttgttctaatatagcaaatgcccactaataaaaacctttcaagataaatcttcaaaaaagtattaaaatggaaatgttaacaagaaaggtagtgcccactaaaattatagcataggttagggaagagaaattgccgtggagcagggcaaaaaatcattagctggaaagataaccaacccagtttggagggattaatgcagtaattgatgaactttacctttttctttgtctgggtgctgaagtatgactatttttataagacagatctttctaggcagtccagttactatatgtcaacacatagccttgtaaaagtataatatcctataaagaaataaactctaaactcctcaaatagctattcttctctaatgtttacactgtatatttttatctgataggtaagggtcaacactgtttgcatcattaactggcaaggaataatcgaaattactaattacatttagcatgtctcatattgatgaaacaacagatgtttaaggaagaagcttctttaatatctactaacattatattatgtttcattgtattacacaaaactaccaataaggctaaagcagttgtaccacttttatttaccttacaacaaagaataaatagcttgacaagatccttttaaaaaaaaaataaagtgccattactaattctgtaaaccagtaaaagttaccaaaagaattttaataaaaagatctcaagacccccactgtattttgtaaaatattaaaggcagtaaaatgtaacaaaataaaatagaaaaggtgaccttcaaatccatgaaagaaataagcaaaaaaacaagatgaccttaaaatgaaagttctaatgtcatttcattattttattgtaagtcacagagcccccaggtctatattaaaggcaatatttataagacttaaaatactaaaaaaagaaaaaacagaaaaagactaaaaaccatctacaataattcagaggtatttgaaaataatacaaagcaattaaaaacagtaaaatagaagagatgattaagtctaaaagcagctcagaaaggcctacagctgagctactgctcagggagagggaagctgagctcaaagccccaaacatcaagtgcaatgtgaggaacagaacacactcgaaagctgggggactgaatctgagtcagaagcccctgaaccaagagcgccaagagcagaagatggatgtgccagctcaaaagggagagagcaaattcacctttcctctgcctttttggtctactcatgccctcaatagactgatgagggtgatctttaccagtttgcacattcaagtgctcatctcttcccggaccactctcacagatacaaccaaaagtaatattataccagctatctagacatcccttagcccagttaaccatcacaagtaaggaatggtgacatggaataccggagacagaatagcatgacactgtgaaggccctttgatgataagccacagatcaaagaatactagggcaaagatttttgcataggaaaatgacataatctctctactacatatttaacctgattaaaatggatttttgcacagacaactaaggaagaggccttgttaggatcttgtttagaataaatagataaatatatatattatagttggataggactttaaatattgcctgatcccattccttcatttatcagactcagaaagtataatctcctcggggtcagctggaaaattagtgacaaaggctacaatgtttgcctttttttttaatttatttttttgagacagagtctcattctgtcacccaggctggagtgcagtggcatgatctcagctcactgcaacttccacctcctgcgttcaagggattctcctgcctcagcctcctgagcagctgggactaccagagcccaccacgcccagctaatttttgtatttttagtagagacggggtttcgccacgttagccaggctggtctcgaactcctgacctcaagtgatccacccgcctgagcctcccaaagtgctgggattacaggcgtgagccactgcacctggtttacaatgttttcaaacaatgaactcataagtactcttatatttattatgatttttttttaagatagctctatctcccagaatttctacaaccacctctttaatgaactgaagtctttctttctttctggccacaaatatttactgaacccctactatgtgccaggcactgttctagaggataataacaaaattaattctctggttagatctaaaattcaaaagaagaaaaaaaacaataaacaaacacatacatcacacagtggtaagtgttaggaaggaaaatggagtgagatgacccggcgcagtggctcaggcatataattccaatcactttgggaggccaaggcaggcggatcatgaggtcaggagttcgagaccagtctgaccaacatggtgaaaccctgtctcttctaaaaatacaaaaattagccgggcatggtggcgcatgcctataatcccagctactcaggaggctgaggcaggagaatcacttgaacccgggaaacgaaggttgcagtgagccgagatcgcgccactgcactccagcctgggcaatagagtgagactccaactcaaaaaaaaaaaaagaaaaagaaaagaaaaatagagtcagaaggaaaacaagtgcagaacagaaggtattataagtacacagagagcagccacagactaccatctcataagatggtctgcatgaaccaggagcagtggcttgtgcctgtaatcccacctcctagaggggatgagatggtgggatcacttgagtccaggagttcaagacaagcctgggaagcataacaagaccctacctctaaaaaaatgttttaaagtagtcagatgtggagacgcacacctgcagccccagctacccaggagcctgaggcaggaggattgcttgaggccaggagtttaaaactaagctgggcaatatattttatctcaaaaaaataaaaaaaaagatagcctgcactataagaaatccagtagaagagtggtccccaaagactagacaataaatgagaaaatagggagcaggtaagcagcctgtttaaaagagggagggagaagaaaatgaggttgaagtctaagtttcagaacaagtagaatcttatagaccactgtagaaactttgccacagaagtttcccccagaaacagtgcaaaccaggagacaatggaacatctttaaagtgatgaaagacagaacaaaaagtcaagccagaattctatatctagcagaaaaatcattaaaaataaaggcaaaacaaaaattccagacaaatgcaagaagaattgggtaccagcagacctaaagctagaaatttttaaggaagttcttcaggttaaagagaaaggataccagctggaaacagatgaatacaaagaaatgaagagtgctagaaatgttgtaacaatgtaccgtggggtttataacacgtacaagtaaaatgcatgataaaatagcacagaaaataggaggggagaatagaagtaaactattgtaaggttcttacattatatattaaatttatattattttacagtagattatgatgagttagagatagatgttttaaaccaaaagcaacaacaaacaaacaagtatagctaacaagtcaacagaagagataaaatggaatattaataaatactcaaaggaagacagaaaaagagaggacaaaaacaacaaaaataaattaaaaaaataaataaataagtaaacttactaaaacatggcaagaaaaatgcctaccaagcaacatatttaagctggtctgtgttagtgcatctgttgggaataaagctgaaaaccaacatctttactaattgatataaatgtctgcctgaagttttcacagatgatttactgtaatatggtcattctacattgctttcctttccatctgtcataaaatagctgtgtatgattttcaaaattaaaaaattaactttaattagccaactagtttactgataatatcttctcactcaaataagtttttgaactactagacatcgccaaataaaaatagcagttgaggatttgtaaaaagaaaattaagtcaaatagttatttgcaaaatcgttttatcatctttggttcatggaaccattatgtttatcttatatatgctacagcttttttatcaacatgcaaaaagttgtcacatcaacatacccacttgcaaaaatgtaattatactttatataatttcttatatactttacatagcgataatagtaatcaagtactaactatgatagaattcatattggcggagataaatggagcaaaataatattgcttactttgtaaaaataaataattatcttattgatgttgccatttatcctacttgattctatttaatcggcaaaaaccccaggctcaatgtaaaactggtcacagcaagactaggtcagatctctttccaaagtgccagtccagacttctgagtgaccatgggcaaagcacatgcggtgagtggtagaggaaccccaaaactttttcaacacacaccagaaaccgcaaagttacccccacccacatatggttccattcagaaacgaccacagctctcctggtaccggagatacaacaccaacctagataacaaagaccacagagtacatccatctcctcagtttggtctgtaactggagtatcttctacatctccacagcacagatccttggaacgccactgtaacataagctcagcactcaccattctcttacatgcctaaggctttctacagtaagccacagccactctctgcctgagagtgttcactggctgggagcttgctgagacaggccagaaaccagagctggacaagagtgaatgaataaatactcccgcttctttgccctcaggtaagataactatgaggtagattccatgtagcttcacaaaagtacccaatgggattgagcttcagttgccaatagttgcggcctgttcattagcataccctgtagtggcttcattctgtcttacttactcagctctttacaggtgcttcctgggatcatctccctaataaactacttgcactcaaatccttgattactttaatgccatccttcagaatgatgccatttcgtccaagaacaagggatgcctttagttttgttcagttctactttcgggcctttcaggagtgctttaaagttttcttcctgtaagttttgtacatttttaaagtttaattgctgagtattttatctttttttcttgctattgtaaatggggttttctcttcgattatatctctttttttttaagactagtcaagcgcagtagtaacaagtggagaaagactagaacaaggagtttaatctataactgactgaaaagtcaattgagataactcagttggacctttggaccagccttccttataccttctaactcattattgtttacatttatgaaggcttttgatttttccatgttaattttatcatacctattaccctattgagttattttactgagttgggattttttaacgactttattgagaaatcatttacatgccataaaattcactgattttaaatgtactattcaatgggttgaagtatatttagagagctgtacagccatcaccacaatgtaattttagaacagtttcatcaccccaaaaagaaacctttaggcccattaggagttactccctatccctaccccatctcgacctcccagccctacacagccactaatctactttctgtctatatagatttgcctgttgtggatattttacataacgaatcatatgacatgcggtcttttatgtccggcttctttcacttagcataatgttttctgaggttcattgagtaaggttttatcattgatttactagggtttttttaagtaaaatgtcatatgagctgcagatagaaatcattttccaattacaatgcctccaactgtttcctcctgtcaagtgcttttgttaatactgccagtacaatggtcccaacctttgtgggaatattcttagtgtcttcctaataaagtaaagtgctgattatttgatactttaactctgagaggaaaatcatatgtttctatatatgtcaccaccatattacattaactagaagccattatttgttcatctacaacaggataaaataatgtctgccctctctactttacagaaatcctaaaaagaaaatatatataaaatattttataaacaataaaactctatgtaaatttgagagcctatttactataccataaaaataattttagaaaccactgaactcctttgaaagtgtgtgtttttaactactaccaaggagagagaagttagtagacaagaagcaaggcgactagatcattcagccatccaggtatgtaaacaaagaaggaaagaagctagctacagaaagcaaatgtcatattggaacacactgagttttctaagttcctctgacatatttctggtcacagaactatcaccaaacttaaagacctaaaggacttctaatattaaacattaaaatagtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaataaaaaaaaataaatgtgagcatacatacatttaagaaagattaagcaggccaggtgtcgtggctcatgcctgtattcgcaacactttgggaggccaaggtgggaggatcacttgagcccaggagttcaagactagcctgggcaacacagggagactccatctctacaaaaattttaaaaatcagccaggcatgcctatagtcccagctgctcaggaagctgaggtgggaggatggcttgagcccaggaggttgaggctgcgatgagccatgactgtgtcactgcactccagcgtaggtgatacagtgagatcttgtctcaagagaaaaaaaaagtaaagcagaagaagaatttagaatttagaggtatgcttaaaaggttaaaagattcttaaatccttaacttattacagaggaattccaaatacagacatgaaaatgggggatatctacatgactgaaagtaactgaaaatatctgcttatctactcaatgaaatgttcaaatataaaaaaattttagacctcttgacaatgtaggaattgacagccagtaccattattagtgcttatttgttaaagtaagggggaaggaaggtagttcagttagctcttgtaaacaccctcggattgatttgttcaatcctggaaaaaattggtctatgcaatagtaattttcacatttttagagttcctttaacctactgtgtaaagtatgcagtgggaaggaagtcaaactagttacttaatacttatctttaagttgaattcaaattagtctcagagttaactaaccagtgtaagagttagggtgtttttcagttgcaaataacaaaaaaacagatttgcattaaaaagaaaagaaaacccagatagtgggcaggtttcagagttggttagaaataataatgacaacagtaacaacagcaaatactatctgtcaggtactgctctctccattttgtgtgtattaatctatttaatccttgccacaactttctgagagttgttatcctcattttacagataaggaaattatctaaaggtacagagagcatctattacatttgcccagcatgccacagttagtgagtagcagagctggcattcaaacccgtgcaatctagaccagagcccatgctcttaactgctgattcaaacccgtgcaatctagaccacagcccatgctcttaactgctgattcaaacccgcgcaatctagaccacagcccatgctcttaactgctgattcaaacccatgcaatctacaccacagcccatgctcttaaccgccgatgctctgctgcctcgtgatggcttctcaggctgtgactcctttctctccagttccctctgctctgccctcttccagagctagcttgcagctcagtctggctccccgtcaggaatattatagatgccaatgggtcctggaactaccctgtactcatataaaaggggagagcacaagcattccttcctaccaaacaaaagctctgagtctcactttaataggacagatcaggtattgttcccaccacagaaccaaccaccgtagacagggaataaggttgcccagagttatctatgccaatgggaacccaccacaggtacagtaataagggaagtctaccccaccaaacctgcaaaactgccatgtaatgagctggattggaaagaatgttgagtagaagccacactgtccactgcaaccagtgatactcttgggtgatacaactctaagaaagggaatcaagatataaccttatggtataacttactaaaattcatcaaatgtaagatgctatggattgtaagacatgccattattaaagataccattaaaaacagtatagcactgccaagtatcatcttaagaggccttcaaatgtaggacgcatcctaatttcagttatgtcaaaaatgtaggaggaaacgtccatcttacaataaaacaaaaatatgaagtgccatcagctggagttgtaaaaatccataactgctttcccacatatatctacataagtctaggctatgactctatacacaggctgagaaatgaaacagcaatcaaccctgctgtgttcccagaacttaagatgaaagatattaactaaaagagtcgtcagaggcctcactcctcaacccctcaatcaaacaccatgtcagacaagcaatatccaccatatgccaggcacagtgtctgggtcctacaagggaaaatgtcttaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaatggtaactcctgcctcaaggatatgactggcaagtactaaataatcatacaagaaacggaatgaagtaatgctgttaaatggatatcaataaaatacaggggctcagaaaaaggaaagattaatatagactaactggaacagagacagttccagcatcaagataacatcagagctgcctgggcatctgtaagaaatgaggatctatttaagagaggaaggcaagaagcaagagtaaataacatggaggtatttcagatcacagtagtagaaatcaagtacttgagttgaactagagcgaaggccgtatgtggcagagtggactaaaaagctagaaatatagtttggagccagcacatttggtaggcaagaagagacactgaacattcttgggcagagaaatgacattatcagagaggttggagaagaatccctaacgagttgtttgcagacactgggcttacggggcttgtgggacatctagggagttttcactgaaactgcccagaagccacccagatataagtatggaatccacagaaagatctaagctaagagtttttatctgggggtcatcaggactagatgataactgaagttatgaaataaatgacattttcttaggaggatctgacatgccagaaaaacaaaggagcccagagaaattacctgaggaacgtcaacattagtggaatgagcagaagagaaggagcttatgtagaaaaagcagcagaaactacacaacaagaggaaggaaaaccaggaacgtgggaaaagagtatgtaagaaaagagagaagttaatactgaccagtttcacagcaagatagaataagaactgaaacataacccctgagatttagattattgatgagctggctgaaagcagtacacatggactagcaaggatggggtagtccacacagggaggtcagaaaaggatgcttagaaaagattgcttttgagctaagaagttaaccagataaacaggaaaaatcaccaaatgtaagggaagaaaaatagtatctacaaagaataggctggatccaatacaaaaatatgtatcttaatcaaaaaaaagaaaaaaacaataaacgcacacataggatttttacattcaacaagcataactaatttgttacctcacacaaattgatcttttgctttaattacaatgctaactttttaagaaaaagaacccaattaaaaatccagcaaatacacagctcagcaaaatttgatgaaaaggtatgcaaataagccacaccttttgtatgacctcttgctaaaaggagcaactttaggccaggtgaggtggctcacacctgtagtcccagcactttgggaggccaaggtgggtggatggcttgaagccaggagttcgagaccagcctggccaacatggtgaaaccctatctctactaaaaatacaaaaatcagccaggcatgctggtgtgcgcctgcagtcccagctactcgggggaggctgaggcagcagaatcgcttgaacccaggaggcagaagttgcagtgagctgagatgccaccaatgcactccagcctgggcaacacagtgagatcccatctcaaaaaacaaataaataaataaaaggagcaactttacatatatctgctatacaaattactctccatttctgcaacaatctgtttaactctaggcaacaagttcaatctcaaatttcattttgactcaattcttttcttaaaaaggattccatattttataatagaaagagccatgaaaaaactctaacttttatttattttaggaattgggaaaatcattccattcctaaaatccgacatatctgactatactctggaaaaaagtatatagtctggcaactcaatagacatgtattttttaaaaatctcactgaataattgcagataagacaaacaagagtaatctaacaattatgccaaacttagattggactacatgtgtgaaagtactacctctctagcactttctccaaggaaactatcagaaccatttattttccactgcataatagcagaactatcagttatgtgacatcctataaaaagacaaacacaatttctaattatatccattctttcattttaattactctagagagtgattacatatttaacttggctatctttaaaaaattaagttgctttaatgaaagtattttagatagctacaccaccatacatcaattagaaagttaatcattccacttgttctcacaaaaagattttaaaggaggtggagaggtggtgtttggtgctttataaaagttaattagagggcacccagaaagagagatcatccaggaaataaagtttatcaaaaatccaaaatatgtaatctgcacagtgtcaagaaacagcaggagattctctttaatgagtttactcatgttcactttaaaagaaaatcttcagttcacgatgtgaggttgagttttaaatatactggaagacttctctgtgtaacagactgtaagactccactcgctcgcttggtcttgactgcctaactgatggcagactattatctaaagcatattcctactctaaaggcagccttctattttacagtgatcttgctgtatacttcacagtcacactcatcattacaaaacattccgaaagctttttttaataagttttcagtgtttgaattatcatgatcactccctcaaattaattactaatatgataagaaataatcaaggttaagttgatacttaatttttggccaaagcaggttcaatggatctatcctagatcaatagataagcttaagaatgcatttctggaagtcctagccagagcaatcaggcaagaggaagaaataaaaggcatccaaacaggaaaagaagtcaaactctctctctttgcagacaatatgattctatacctataaaaccctaaagactctgccaaaagactcctggaactgataaatgacttcagtaaagtttcaggatacaaaattggtatacaaaaatcagcatttctatacccctataacattcaagctgagggtcaaattaagatcacaatctcacttacaatagacacacacaccaatatctaggaatacatctaatcaaagaggtaaaagatctctacaaggaaaactacaaaacactgctgaaagaaatcagagatgtcacaaacaagtggaaaaacattccatgctcatgaattagaagaatcaatatcactaaaatggccacactcgcggtggctcacgcctgtaatcccagcactttgggaggccaaggtgggaggatcacttgaggtcaggagtttgagaccagcctggacaacatggtaaaaccccatctctactaaaaatacaaaaattagccaggcatgctggcacgcgcctgtaatcccagctactcaagaggttgaggcgggagaattgcttgaattcaggaggcagagatggcagtaagccaagatcgtgccactgtactccagcctgggtgacacagcaaggctggctccgtctcgaaaaaataaataaaataaaatagccatactgcccaaagcaatctacagattcaacgctatgcctatcaaactaccaacatcatttttcacagaattagaaaaaattattctaaaatatagaactcaaaaagagcccaaaggattgcccaagcgattctaagcaaaaggaacaaagccagaggcatcacattacccaacttcaaagtatactataaggccaaacagtaaccaaaacagcatagaactggtacaaaaccaaacacatagaccaatggagtacagagaacccagaaataaagctgcacacccacaggcatctgatctttaacaaagtcaccaaaaataagcaatggggaaaggaccctctagtcaataaatggtgctgggataggctacctatatgcagaagaatacaactggacctctacctttcatcatgtacagaaattaagtcaagatggataagatttaaatataagaccacattctacaagaatcctagaagaaaaccattcttctaaaggattggtttaggaaacaccattctggacatcagctttagaaaagaatgtgtgactaagtcctcaaaagcaattgcaacaaaaacaaaaattgacaagtggaacctaattaaaataaagagcatctgcacagcaaaagaaattatcaacagagtaaacagacaacatatagaatgggagaaaatattcacaaactgtgaatttgtctatttgtcatccgacaaaggtctaatatccaaaatctataatgaacttaattcaacaagcaaaaaacaaatgaccccaatacaaaatgggcaaatatatgaatagacacttctcaaatgaagacacacaagcggcagacaaacatgaaaaaatgttccacatcactaatcatcagagaaatgcaaatcaaaaccacaatgagataccatctcacacctgtcagaatggcttttattaaaaagtcaaaacagaacagatgctggcgaggctgcagagaaaagggaacgtttatccactgttagtgggaatgtaacctagttcggccactgtggaaagcagtttggagatttctcaaagaacttgaaacagagctaccatttgacccagcaatgccattagtaggtatctatccaaaagaaaagaaattgttctaccaaagagacacatgtacgtatatgtttgttgcagcactactcacaatagcaaaaaacacggaactaacctaggtgtacatcaatagtggtttagataaagaaaacatggggtgtgtgtggaatagtattctgctccccatggaatacttagccataaaaaaagaacaaaatcatgtcctttgcggcaacatggaaacagctggaggctattctcctaagcaaattaatgcaaaacaataaaaccaaataacatgtagttcacacttataagtgggagctaatcactggtactgctggacataaagacggcaacaatagacactggtgactattaaaggagaagaggaaaggaggaggcaaggattgaaaaattattgggtactatgctcactacctgggtgacaggatcatccctatttcaaatctcagcattacacaatatacccatgccacaaacttgcacatgtattccttgaatctaaaataaaagttgaaattatttttttttaaagaatgtgtttgtgattatctgaaattattgcaaaatgtatatacatttttttccaaagaggtttcacggatttcataagttaactgttttattctatgaagagaccatggaataaacaaaacaaagcagcaaaatgttaagtgaaaactttatattcagactctgaagcttctttggtaagggtagtgtgttacgcaaagaggtattctgagtaactgtaatactagataaggaacagtcaggacaaagccactgcttttctctaagttaggaaaacatcaggaactcctgagaattccaaaatagcttgaatgaggaagggggaataagggaagagtaatagcgttgagactctaaatgatagaagaattccaaggagaagatacaagaattccaagaattccaaggagaagatacaagaattccaagaattccaaggagaagatacaagaattccaagaattccaaggagaagatacaaggaaactggacaaaacacgctaaatgaagctacattaattagaatgtcccacgtggcatttgaatttccctctattagagtttttgctacatttccctgaaggtttatcgagggcagacactgaccttaatagtctttgtatcacgggttccagcacagtacttctcacatagttgttactcaacatttcctgggtcagtaatgaaaacatgggttggaaataggtggcaagtttttttaaaattattaaaccagaagctttcagtgggtagtagttacatattcaaatttccttcacccacttgagagagaaaatataaaggctatgaaatgtgtcgggagaaaaactatgaaccattctttcttatttgaaaaaaaaaaaaactatacaacaatagaagaaagttgaaaaagaacctaatcttccttcatggaaacatggacttaaacaaaaaaagaacctaattttcctaaagtgaactaaaagttacaaatttcaatctccaataattgaaggcaagaactttgttcttatagactatctcaggcagcagtttaaaaggggggcctacaatgttttcccctttgattttaaaataattttacacttacataaaagtcacaataatagcacagaggattcccatctaccccttcactcagcttcccttaacattgacatcaccacagtaatacatagaaagtatctaggttcctgcctccctagtctcctccgatctgtcataattcctaagtctttccttgtctttgacacttgatacttttgaagagtaatgatcagttatttaggcaggtgtcttgcctaaatcatgttctttttctgttccacaaggtaaagatgtatttagatgtcctgcttcgttagtctcctccaatctgtgacccaacatgctcccgcccccaagggcaggtttacttctattacttctattttccccaggtgtaaagggttttcaccagagccccaaaggtaatggtcattgttttgtcctttctctgctttcattcagtagaagggaaaaggacgatagggaataagggtcctgccagagtttctttcttttttttttttttttttgagacagagttttcactctcgcccagactgaagtgcagtgacacaatctcggctcactgcaacctccacctcccgggttcaagcgattctcctgcctcagcttcccaagtagctgggattacaggcacccgccaccacacccagctaattttttgtatttattagagacaaggtttcaccacgttggtcaggctggtctcgaactcctgacctcgggtgatccactcacctcagcctcccacagtgctgggatttcagagtttcttactgtatctgcagcagctgctcttctcctagagacaaagaatgctttctcaggaatctcacctgtctttttgggagcacctggtagagtttttggagaaaaagcctacaggtgggtatgaactcccctcatccacagttcccagggtcttcacactttcttgccagcccacatgcagcatccatcaatttggttaactattctagctgaatgcttaccagtgtccagctgtgggtgccccaggtaagcaagtgctgatgtctttccctacatctgtctcttcttagacgtcaagctagccgattgccctataacctcagcaatctgatgggttaaaaaacaaaagtcatgaacttgtcattgtccagatgtttctgtgtttagtcttgcttttaagattagaagccatgctttttctgtacacaattttgtttttattaatgcgtgaatttgtttgctaaaagataacgctatgaaacaaatttaaagtttattgaaaaatcaacttaaaagcagcattccaaaatattctaatataatttttaatcttaaaacttagagttttgactgttgatcactgtcattttttccagctgttgttatatcaagaaaactctcattatttccataacaataaaattcaaaactgaaatgcaataatgcatgtggacataaattatactgagaattcaacctaataaaaaacacataacagctgacaatgatttcttaaaagcatttgcttaaagtttgtcagaatgctgggagaataccaattacgtattcatagtcctcataattttgttttacaaaatattttctcaaatctcttgggagattactatagggttaaaagctgttttaagatcaaagatcaaatagaggggggaaaaaccctgtaattctctactgcagctcattgatctttcccatctgctatgcaaaaaaggagatgcatgttaagtttgaaaaaagaaaatctttttaactaggaatgacagcatactgattctggcaaacgttcagagggaatttttatatatgagatccaactcccttttgccaaaatataaatgatgttaacaataggaaaacaaaatctagtcagtagtctcttatttatatatttcttcctgcaaatatatcgtatgatcagatttctaatataaaacacacatagtaaaataaattttcaaccatcaagagcacaggcttaggggtgaatgataagagacaagtggagtaagacactgaaaaacgaagtcaactcaggaccagaggaactactttcctggtactcttccctcccttgtatcctccagggattgattccaggacaccaaccccctccctggcccccagcacggataccaaaatccatggatgctcaagtcccttctataaaatggcatagtatttgcatataaactatgcatatcctcttgtatactttatatcatccctagaatacgtataacagtggtccccaaccgttttagcaccagggaccagtttcgtggaagacaacttttccacagatgctggggcggggggcggagtggggatggttttgggatgaaaccatcagatcatccaatcatccgatcatcaggcattactttgattctcatactgtgagatctagtgtgcaacctagatccctcacatgcacagttcacaatagggttcacgctcccgtgagaatctaatgccgctgctgatctgacaggagacagggctcaggcaataatgctcgttcacccgccactcactccctactgtgcggcctggttcctgacaggccatgggagtggtaccggtcctcggcccgggctctggggacccctgactatgctatgtaaatagttgttatgctgtattggttttatttgtactatttttattgccacattgttattttcgggggggggggttcccaattttttatttttatttttttaagagacaaggtcttgctatgttgcccaggctggccccaaactcctgggctcaagcaatcctcccatttgagcctccctaggaaatgagactacaggcaaacaccaccacacccagtccaaatattttgaatccaagcctggctgcatccacagatgtgaaaaccatggattcaaaggattcactgtatagtccaacaattcaagtttccgtggactttatgtaaaagcctagaagccttctcatgtatcttcaccttggaaacaataaaaaatacttcccaggaggccaatgacatggcccattttttagaacagaagcagcacattttatctcctgagacaaacgctcataggcacaccaacaattatcacctttggtaaccctcaaagtattttagcatggggcctgtttctttccttagtgtgcctttagcttctctcctctcacagtcactgaattctacacttaaaatgggtgagactgactcttaagaaaaaaaagacagttgtatattctcacactagaagcacaataaatgtgctagaagtactaagtactctggtaggcgggggtgggcggattacttgagcccaggagttgaagaccagcccgtgcaacgtggcgagaccacatctctactaaaaaaacagaaaaattagctgggagtggtggcgtgcccctatagtcccagctaccagggaggatgggatgggaggatcacttaagcttgggaggtcaaggctgcagtgagccatgatcgcaccactgcactccagcctgggtaacagagtgagaccttgtctcaaaaaaaagtgttttagttctttataagtttgatgatatttctatgatcagaagtatgtcataggaacttaactcttgtttatatccattagcctgtggtaaaatcggtttcgttagaagtcattttgcttgaagtttacaacaatctattgatgatgttgagtgaggacttactctacatgagaaataaaaagaagaaaataatcccatcacctagaaagacaaccactattaaaccaatatacacaaaaaatatatagatagagaaaattttatttttcaagacctcagatgccattttggaatctatttttaccacttaatgtgattatttgccccatgtcactaaatatcattaaaaattaacattagcaaaagatacctcccacaaattgagtacttaccgtttgccaagcacgacattagcactttgcagaagttatttcatcctcacaaacagcctgtgaggaagatatcgtcacacccactacactgatatgcaaactacctatcaatatctaatgatattttggatcacaaactaaataatcatgacagtatatttttttaattatgaagtcaaatttataaaagtattttcaggcagaaactagtgatgtaggaactctctctccaaatctagaagtatatatctatgaaaaaaaatatttgggggcataaaaactacgttaaaataaatgtagaaacatgttgaagatcttcgatgtgactaaaaaggaaagcctcattttttactatgatataggagtagcaaagggtaattaaaacaaccagcagcagcactgtgagctttcacagaaagatacaagttcacaaaatccctttcctaatgaccaagctccatggattggggctttcgcatctgtgaccatctttctgaatgtcctggcataccccgtcttttgtattttcctaagaggaagaaatccctctgtgaatggaacaataacctcagtgccatgtgtgtaagactatatatgcctactgcttggttgaaggccactgggaattacacacacctgttagtggggagcaacatggtcctccaatctggttacattacgtagaagtaaattataggtgacccttaatctctgttttgtgcgtccccacttaccctgccgttcgtaagtacacgcacattccagacacatgaagaggagctttttatccaagactttgaaagaaccgactaggagtttacaggaagatctctaatgagtaatagtggtaggtaaaattcacgctgagccagttctttcttggtcgtcatttgtgtacgtttccttactaaagtaccaaaatgtctttgtttcaaggtcatttcacctatggagtaaatgcataatttgtaactacgctgcaaaatttgtggttacactgactccaagttatcttatttcatactgaaaagaaccctgaaatgaaagtaccaccattcactatattgaggaggcaaatttaaaaccaggaagctgatattacctgttactgccaggtcactccttttcggattatcactggagctttcaaatcttcaagagatcagaaagcattccagtggctcaacaaaggcactgaaacaaggacaaaaaatgcctcactgacattttaggggctaatgcctatatttctttctttctttgttttttcccccttgagatagagtctcactctgtcgtccagcctggagtgcagtggcgccatctcagctcaccacaacctccacctcctgggttcaaacggttctcctgcctctgcctcccaagtagccgagaccacaggcacatgccagcatgtccagctaatttttatgtttttagtagagatgaggtttcaccatgctggccaggctggtctgcaactcctggcctcaagtgatcctcccgcctcgggcccccagggtgctgggactacaggcgtgaacttacgcgccccaccttctttctctttactatctttgatgttcatgtatctattcattcagtcaacaagcagaaaatgcctatcatgtgcaaggcactatggaaggcactgaagaatcacacataatagagacacactctcaaggcttttataacttagctgaggaacccaatttattcaccaccatgaactatatcatataataagtgctacaatgtgtaagcgctgtgggagcaccatggaggtgttacttgagtcataccatgaagtaccttttcttcagggaaggaaggaatgatgtgataatccattagaggtatggcacaggcacaaaaacaataaacccttatggaaaagtcttcactaaaagactattgaggccaggcatggtggctcacgcctgtaatcccagcactttgggaggccgaggcaggctgaggtcacgagttcaagaccagcctggccaacccggtgaaaccccgcctctactaaaaatacaaaaatcagctgggcgtggtgacgcacacctgtaatcccagctactcgggaggctgaggcaggaaattgcttgaacctgggaggcagaggtcgcaatgagccaagatcccaccactgcactccaggctgggctataagagcgaaaccccttctcaaaaaaaaataaaataataaaaaaagactactgaaaagagaaaacaaagtaaaagtagttacacagaaaataagaaaatgaaagaatctaatgataaagaaatatactgatgtgaaattggagaccagttggaggttaagtttaaaaatatatatatattttgaacacagtattgaaataggccagaggtttatgaataagtgaagcagacccattaacgcaaacactggtactgcttcctcaaagcttttgtgaaatgaaggaaggcaaaaagggaatggatagatgatcttgggagccagactctggtaagaatctgtgccctgggaaggacggttagttcttccacactgtgcactccacctcagggcatcttatctcccttccagaattcttgcctagcaacttcccttacagtgcaccaggctcccaacttcagattttatgctctactgtatttaaattcttcttatttaaatttaaaaatgtatggtagctcttcctattttggattttgtatattccttccagttgtttttgttttgttttactctcttatgtatttgcattaagtaacattttggttcacatatatacatgcctaagaaattttcctcaacctcctcttaccaatcagtaacactggtttcaccaaggagtaagattctaatgtgttaaaccctatttaatatctttcagtttgatcctcaaactgtacatttctccatctgcaagtacagcgttacattcaccaacttacctaatggaatttgatacatggttggacattactataaattagctgaatctcaatttatttaggaagctctacaatgtaactcctcaaaaggcaacagtctcctatagaatcaatatacatgtaacaccattaagaagcagcctctcagaaaagcgattcagcaattgagattaatgtaatgaaagttattcaggtagataacaatctaattttaaaacacttgaaagaaataagtcctaactcctttcccatacaaatagagatgctagccagtctggggcaagggagggttgggctggtgtagtggcagggaagatgggcacaggaacctaacaccaattttttcacttgtacatttcctaaaagaattttgaaaaaccttgtgctcttctgacattttaggttgacatgttaatttaatgatggcatggatatagtttccagtatggtatatacgtatcttaaatattattgttgcaaccctgcagctgtagatttcactcttttacttaatgaaatatgtccaccaaacaatctaattgttaagcctgttctgtcaaatcaataaatcaaataaaacttactttctgtcaaaaaattcatatttcatttcaaataaaagtgctaatctgccttccctataaaccctccctcaccacccatcaccaccacagacagacaacaatcaacttgattctaaaagaaagaaataaggtatggagtcctgccatgggtttgttacctggaggaaacatctatgattttgaccaaagcagtcatcactttgctatcttcaaattcacacccagaacctaagaattttttttttttttttggagacagagtctcgttctgtcacccaggctagagtgcaggtgcttgatctccgctcactgaaacctccgcctcccaggttcaagcaattttctgcctcagcctcccaagtagttgggattacaggcatgtgccaccacgcctggctaatttttgtatttttggtagagacggggtttcaccatgttggccagactggtctcaaactcctgaccttgtgatccacccgcctcggcctcccaaagtgctgggattacaggcatgagccatcgcgcccagccccagaacctaagaattcttaaatggtccctttagtgggtgaaccagaggatttacactccctgaagcaatcaaatattgtaagatttgtgctgggtcagaagcatgactgactgcctttgtcaagtgggaggaaagcaatttgtgaatggagaggtaggaaggaagactcactctgccacaggtgctctcaggcaaccatattagaaattatcaaatgcagacattgagcatctaaataccattaaaactatttttgcatgcaaaattcctgaaaagtctccatgaatcccgaagtgtatatatacacccactttaaagacaactaatctaaaaaacagctccagagtgcttaactcaacattggaagccaggcacacaaaacgcaaaagctgtcagtcataatgttctaagaatagaagcagaataaagataacaaggcaatgtggtaaaagctttaggatacgcaaatttgacataggggtgcagagcttggattctggaatcagaaagtctggggtttggattccacctgtactacttactagccatgtgactttaaataaatttctttatctccttggggctttgttccctcctctttaagacaggagcactattgatgttgatgatggcagtgatgatgttttaagtatctgtacttcactgaattgttgtgaggattaaatgaaataacacaaggcacttagcacaaaacgtagcatgtagtaaacattcaataaatgctaacacaacattaggagggagagttttacttaataaaatatgtccaccaaacaatctaattgctaagcctgtccttactgtcaaattaataaatcaaataaaaccctctcctgagtgtaaatcactgcccatttttgccagcagtttagactatgagtgaaaagaaggtttttaggaacaccaagccaactcaggcaaaatggagacatattttcaactacaggcctgtcctatgtccctaaaattgccttccatgaatgtaaccccaatcagagtatagtttaaggtagaacataagaatttgtccttcttactattgacccaagggataaacagcactagtaaaattctgcttttttatagatactctcaaatctgtatctgaatttctaaatgcatttaagatgcccggggtctaaaaacatacaacacagttaacaacaaagaaaacgaacttaggagggctgagttagaaaacccctacagctgttaagacagtcttttgcaaaccaagagattaggaatttaatttgtacaagtatggaggggacttccagccacttgtctgagagagcttagtacagataagaaattaatgtgcctgaatgacttagacttaattcttataaacactctcacttctgaaatgggaccggagctttgcctttgagtggacatccaaaaaggaaaaaaaaaacaaaaaaaaaacctgggaataagagaattaacttaaaaactcataaaaagcaaggcattactgtacatctgataagactgaaaaccatatgaatgcataactaatgaatttcccacacaccaagttcatgcaaaatcacacagttaattccatttcatacttttaaaccttcactagaattggttgtttttttaatctttactttcccatctactaaggtaagtcagaagaccctggatgtaaacatatcaattgcctctaaaataaagaccaagtattgaaatagtgaagaggatactgcattgtctcctagtgcttttgaggaagcagagcccaaaatcatggctcattttactactggccaaactgtgaagcagaatatatcactacatgtagcaaataacaagtaagcagagaatcaaagacatcacaatgatatatccataaaaaaagtattatcatatttgtcctaaagacaactctagaaataattctatttatctagtaagaaaaggcatgaccatttactatatataaaaacataatctttcaaagaatgtcaaaaatgaaaccactatattatccaataaattctgtgaccggggagagaaaacctactaatctctaataaatggaacctccacatcagagatattagaggtgctgtttttctaaacccatttaatgtagctctttgagcttgcaacaggatctccatgacaggtttcatttctaaaattcaattaaaacttatctacgatttaaataggtaccatatggggatgaattttaggaacctatgtaacttgaggcatctgatgacactgttaaaaggagttgtctattactgcaggaacacggtaatttagaaatggcatcctaggccgggcgctgtggctcacgcctgtaatcccagcactttgggaggctgaggtgggcagatcacaaggtcgggagatcgacaccatcctggctaacatgatgaaaccccgtctctactaaagatacaaaaaattagccagtcatgctagcacatgcctgtaatcccagctagtcaggaggctgaggcaggagaatcgcttgaacccgggaggcgaaggttgcagtgagccgagatcgtgccactgcactccagcctcggtgacagagccagactccgtctccaaaaaaaaaaaaaaaaaatggcatcctatctaatttaatcacaccataacttagagcaagttttatattttaaactatatagctttcaagtagcaatctcaaatcctataaatgaagactgcattaaaatgttaaatgtattgttataacatttccttcggaaaccagatttaattataggatcatctataatgtcttgcctttatcagaggaattggggaggtaattaagtaagtagagtgtatcactttacatttctggtcccaataactttcggaacactgtgtaacaaaatgtgctatgagaaaagagtacttgtaaaattattaccgtaatacaaataatcaacttcttcaagacagaaaaattcttggctataaaattcagaggaaaattccaaacttatgacaagatgaaaatactgaaatatatttgacatttgaaaacaaaatttccagaagtttctctcacaaatacacgagacagaaactgactgattcagaggccacgcacctgaagttgtctcaccagtcttaaaagattatctcaatacaagaaatgattgtctttccaatatttctttttcagtcttatagtctacagaagtatccacataaggagagctagcaggacacacacaccataaatcacagtaggcaggtcagctctatgcttagtcagttcttcattctacaccttctcccagttagaagcagccccatctcctctggggaattaattgccatgtaatcatcacttggattactgagctctactgtttcacttccagctttttaagagaattgctttcctcccacttttttcaaatagaagaggtgaggagatcaaaatacaacaagcactaatatacccttccccagattcaacatttgttaacaactttccacgtctgcttcctctctacatatgtgtatctgtacgttcttttgctcatccatttgaaaataagttgcatacattttaactcatccctaagacctttggcatatgattcctattaagaataacataatcaaattagccaggcgtggtggcgcatgcctgtaatgccaactactcgggaggctgaggcaggagaattgcttgaacccggaaggcagaggcggcattgagccaagatcgcgccattgcactccagctagggaaacagagcgagactccgtctcaaaaaaaaataataacataatctcttacatgatcacaatacatgatgctgaagccactattctggagaccacgctttgagaaccaacgcacagagactaagataaaactgctgttcaataaatgctcttctcctcatcctctactcttccctttccaaaagtcaactgtcattatcctatgaaaacagaactttgaatatgttatacaatcaatttgttggcagggaatacccatccccaacatatctactgagagactaaataaacaaatggtcaaaggccagatcgtaggtaactacgacccacgacctgcagctacaagcccaggcaaccaacctattatctacaataaccagtctaggaagtcagactggttactgtctagcaactagcccaggaagcccaacaatgcccttaagaatttgtacaaagccacactatctgtgatcatgcctggggaacacagcaagatctcatctcttttttttaaaaaaaaaaaaaaaaaaaaaaaaggacaaaatggccaggaaatgattagtaactgtcagcttccctaatttttgctcctgcttccaatgtaggaccaaccagagaaagccaaaaatgtacccttaactaatcacacaggttgctatgcttttagttggctcacctacagcttcccacaggaacagcctacaaacagggcatacctgaaaccttcccttttttccactctaaagtttaccctgctgggcacagtggctcacacttgtaatcccaacactttgggaagacaaggcaggaagatcacttgagcccaggacttcaagatgagcctgggaaacatagtgagacccagtgtctacaaaaaataaaaataaattagctggacatggtagcacatgcctgtagttccagctactcaggggggactgagatgggagagtcacttgagcctgggaggtcgagactgcaatgagccatgatcacgcccctgcactccacgtggtcaacagagcaagagcctatctccagaaaaaaaataaaataaacaaaagttttcccattcctctgtcttccttgaatctccaccaaattgaatagatggtggtggattcccttactatataaagaaagctctgaataagtagcctttgattgtactcatttgggtagacctcatttatttccacaaccagaataaaatcaattagttatttttgtgatgtttttgctctttaacttagaattccttcttctgagacagtgtgatatggggcaggagggacctgctttggagccaggaagacctgggtttggaaatctgacttctccagcgattaccttatgcaagttctataatctctttgaacgtgagacctgtgtttggaaatctgacttctccagcgattacctgatgcaagttctagaatctctttgaacgcccatttcctcactgatgttctccatgaagggaacaataagcacccactgcttagggctgccctaagaagagaaaataaacacaaaaggacaccgtgcctgacacagagaagtgtcaatgaagtcaggtgctctgactgggctatgttcttcagctttgaaacctttaatcctgtgagtatgaacctgctgacgttaggtgtggaaaggttttttttgtttgtttttaagtaatgttattgggagtatagagccaagtccctcactttagaaactaaaagatgagtgttgcagcttcggcataccgttttgactactgtgacagaaaatgacccaaactagttcatgtaaaatctcatcaacaggccgggcatggtggctcacacctattatcccagcactttgggaggccgaggtgggcagatcacctgaggtcgggagttcgagaccagcctgaccaacatggagcaaccccatctctgctaaaaatacaaaattagccgggcgtggcggcacatgcctgtaatcccagctactcaggaggctgaggcaggagaatggcttgaacgcctccgggaggcggaggttgaggtgagccgacatcgcaccattgcactccagcctgggcaacaaaagcgaaactctatctcaaaaaaaaaaaactcatcaacagaactatagggacatcccagactcccaaagactgagtttcaactgataaataactcaataaatcaggctgctctctcaggaaatgcttgatttgatcacctccgttgttcttctctcaacctgcttcttttgcttactcagctgcacacggccctgaaaaatgcccaccccaagatggcagtgatctataatttcataaagatttgggttacacaggtgtatgcatttgtcggaattcatcgaatggtatacttaagacataggcattccactgcacttaatggatctagtctcatttctgtctccctcactaaactgtgacatctcaaggacaaaaaggaatcatattcgacactgaatcctccacgctggcacaatgcctagcatgtaactgaatctcagtaaatgcgtgattattaaacaaaggaagcaaactgaagaatttgagaaagtctacttattgggatttattctgaaagatgtactacaagttcacattttaattaatgattacattccagtgaattaatataaacgtatttaaattttaatcattatgaagtgaactatatttataagcaaacaattagtgacttaattaaggtgccaactgttcagtgtacatgactctaccaccacctagtgtaaataaatgcatattaccacatttggaaattccctaaagacaaagaatctcccaatggtgggtcacaaactaacatacttcaaccacaaacattcagcaggtgcctgccggtcctggaaattatgccaggctccagaaggacagacacagctcttgtctgtgttgatcactgctgtctcctcagggtttaggagaatggcaaagcactttgctggccttcaataaatatctgttagctgactgacaagattctgggattaaaaggtgactaagttatcttcgggaaagacattcagccattcaaaaccaacagcattttataaacaatgaaatattattctgcactaaaaataaatgagctatcaagctctgaaaagacacggaggaaacttaagtgaatattactaagcgaaagaagccaatgtgaaaaggctacacactatacgattccaactgtatgacatttaggaaaaggcaaaactatagagacagtaaaaggatcagtgatgaccaggagctggggagggaagggatgaatatgtagggcacaggggattcagggggcagggaaattactctatgatatgatgatggtggatacatgtcattacacatatgtcaaaacccataggatttacaacaccaagggtgaacgctaatgtaaactattcactttgggtgataatgtcatgagtagaaggtgatcggttgcaacaaacgtgccattctggcggggggtgtccattgtaggggaggctgtgcatgtgtagaggaagagggtctatgcgaactctctgtgctacgcactcaattttgctatgtagttaaaactactctaaaaagtagttttttttagtcaataaaatttttttactttaactttagatatcaaataagcaaaacccaaatctaacaagtacatcaaaaatatactgtttttttaaatgcctacataaatgctcaataaatgttatttcctcacctccgtagcacaaccgcaactgcttaccccaagtagctgacatgaagtggctgtaaagaagccactgtttcttcatctgtgaaattaagacagcaggactaaatctctcacttcctattctaatttaacattcttttaaattttaaaagaatagatcactaaacctaaacttttctaaaatatagaaaaaggaaggaaactgtcaaatacttacagcatcacacagtgacaccaaaacctgacaacgaacacattaaaaattactgtcaaatctcacttgcgggccaggggcggtggctcacacctgtaattctagcactttgggaggccaagatgggtggatgacttgaggctaggagttcgagaccagcttggccaacatggcagaaccttgtctctcctaaaaatacaaaaattatgggtggtgttgtgcacctgtactaccagctactggggaggctgaggcacgagaatcgtttgaactcgtttgggaggtggaagttgcagtggacagagttcgcacctccagcctgggccacaaaccaagactccgtttcaaaaaagaaacggaaaaaaaagactcatttataaatattggtgcaaaaactttaaaagtaatagcaatgagaactcataaatgcactaaatgaaggataggctataggcacaactgtttactccagtgattccaggagagttcactattaggaactctactcatacaagcaaccatataagtaggtcaaaaaagaaaagttatatgaccatctaagtagatgccaaatagacatgatgaaatttttaaaccgttcctgattttaacgcttagcaaaatagcaatagatgactatttccttaacataatggaaaaatacatttcatatcagtctataactttctaatgttttactggaaacattactgaaacactaaaacaatgacacacacaagcatttctgttgaagtctgggaggaataaagaaagcccaccattgggcttctagattaatattcatctagaagtaccatactagccaatgcaagggaaaaaaaatcttatgtgagttttatttatttaccacacatttttacagtgcttactatatgtcagatactgttctgaacactttacaaatactaaatcatttaattcatataatcgtcataataataaggcagtactattattatctcattttacagagggagagagcaaggcacagagaacataagtagcttgcgcaaagtcacatagctagcaagttagtagaaacaggcttaacacacaagcagtcatagttccagagccggtgcttctcaccactatgctatatgaaacacgatatcggactgaaggaggcggaagtatccatatatgcagatgatatgacacatttgcaaaattcaagggagaaaaaagttgaaacattgttataagtgagaatttagtacagtggtggattacaaaatcacataaaactacgatgcttctatatgtaaacaataaaaacttagaaaatatactataaaaagatgctatttacactactgacaaaaaaggtaaaataactagaaataaaaataagtagatagttcctatttgaataaaaaattacaaccctgctggtttatcagtgaacataaactccaaatttaccaaaagcgaggtattcaaaaggtatgaactgacttaaaatgctcctcaggcacctaagtaaaagccacagggttgaaagcaaaccagccttaaaaaggcccaccgtttcgccacctacctggatcaggtgtatgcaatacacttgagctttgtcagctaacccaattatgcccaatcttttaggccaacccttaacaaatttaataccttctattaccagcccaagagcacggtcatgatacagaaacacttttctgcaaactgttagtaaatctctactacaccttacaacagtccacattttaactactaataaagcactgaagttgggtgaggatctgatggaacaagtggatcttctagtcggctcctattccactttaaggcctaaggttggcagttaatgcccagtcaaatcagattaggtaatacgtgaagaaattgttcacaatgcaaaaaagagaaatcctgaataaacattcagagaagtgtcccctaaaaagtaaggatcattcaactatgaaatgagttaacatgggaaaccaagattctctgtaggaaatagtttaatgggataggtgtgcatccataaagaaactgctatgcattgaggtggggaaaaatgctttaaccgtcaccattagcaccataatcagtcagtcagtcaagcaaccaggcaaccattacttatggagttgctactatgggcacaactctgcagcagtcaaaataaaatgtgaggtatgattccatcaagagaaatatttattatatgcttggagaaacaaacatgaagagaatacaaagcaatacatgaaaagaaatacataaggcaaactaataatgggagaatttctctctgagttcccatatatattacaggaataaaaatctaaggagcaatcaatcagaatagaattttatttcttccaacttttagaagctgaaaagatttggaggactataaaatgtacacaggcaaataatccacggcagtagtaataactgatgagggattattaaaaacacactaaagcctcaaacgtcagcaatgtttatcatcctatttcattaaaacatattcactaattaatttcagtaaccagagttaatttaacaagtcactgtgctaggcttttactgaatgagtcaaaaggaaacacataaaaatactcaaagatttcttatataaagcaacaggactggatgcaagctctaagggcagctgtttaacaatgaaaaaactgggactgaaatcaagtttgtgactgaaaataggcacattgagctctgtagtcacctctatttatagtactgtaataaaagccacatattgggttaaatcaatgtcctcccatcccttagataacccactctacaatacaacaaatttataactgaagatgtagggtgataattcacattaattcagcaaatatttactgagttatgatgctgtgctcagtgcctgaaatgctaaatttaataagacatagacccagcattttttgtttgtttttttaaataaagacacagtcaagtccaagtccctgatctgaaagagctcatgttatagagaatttctcactttgtagggagagaaaaagtattcctttaaaaataaagttccttgaaacagtcctgttttccaatcattaactacctaaccaggaagatagagaattggaaaaccaccacatttgcttataagaactgaatggaatatgaattggaaataaaaatgaaatatctctaaaaccgtcatgctatactggattgaatgtacatcaagaaattgtatttccagtcctacattgagaaattttatttacacaaaatctattacacaaagcaagatataaccagctaatatttcattgagctattaccaaatgttaagaggtttcctagaaagaaatgagttctattaaaagctttagggacactgagcctccaaatgctatagaaaagccagatactatagaaaagccagatactgccttgaggcaaaaatgctagaaagtgatagaatgcgttctttacaatttgcagctaggttattacccatgataaattgataaccattcattaactttgagagcaatagacaactggcaggctatttcatgcctcaaagaatttatggcaaaaatgacaggtgactttgaattctgaaaaggattcttggaaattattactttcatgcattcctttaaataaacttggaggcagatataggtatttgctgctgatatgaattaaaggtcatgattttctacatcaatgataaaagaattaatgtttatcggttgcatcagtctgtcaatcaacaacagatacgtgaatcaggcacttaaagtatatcctgatagctgatatccactctgagtcatagcagggaaaaactatgcaaaaatacatcaataacctatattaaaacagtacaattaagagtaggaattatgtttgcaggttctttgctggccacctccttggtacctaccacaatgttggtaatcccaaaggaatttgtctctggcccaattttcttctcattctccctgtttctaagctgatatatatctaagccttcagctatcacctatctctaccttctccaggaatatctctctcttgagttgctccgattgtcaaccctggcttcacattagcattacctcagtcgattttaagacataccaaactgtgtccctgtgtcatataaattaaatcagtatctctacgaataggaccaaggcatgaatttgttgtttagtttccctaataggcacacaaggtcgagacccactgcttttctagatccatcactccagccatctcctggactggtcagctccacctgaatatctcacaggcacctcaaatttcccatgtaacatacctactcatccaccaacaccaagctaaagcattttctcctctgccctaactgaccccaggagcattaggcagtccttccacctagcttccacagtattctgtctatgcctctgttgaagcatttagcaccatttattataacttatattttccccataagactgtttctttgtcctgctttgttttaatatgcgaagaacccacaaatgagtgggaccagaaggtgagtgatagccaaaatccaaagagaaatcaaatatctataatcaggtctaaggagtcattgcaaggttggaaaactggagacatggctaaggtatcattaagcaggcagacacaagatcaaagttatgaaggaggacacaaggggatgggaatggtgtacccagggcttagctttattaaattccacctagtacaccgaatggaccagactaatccaaatctggctctaggttaaagaaaatggtcctgtaaagtctacttccccaaagaatatcgaatttaagttctcctttgtgctttcacttctacagccttatatggagccttccatctcttgagtagactttttttccttttcttgtatagacttttaaaacagcatcttaattcatgtccatactgatcatctctggccacttcaggctaacactgaccacagagttatatttcagaagaataaatctttcgagaggtgaatgttcaagggtaagaatagagaaaaaataaaaacataaaataaaataataaatcttctccctcatcactcctctattggaaactctcaggtgactcttagaaaataaggtccatgaggtcaggagttccagaccagcctggccaacatggtgaaaccccgtctctattaaaaatacaaaaaattagccagccatgatggcaggcacctgtaatcccagctaatcgggaggctgaggcaggagaatcacttgcacctgggatgcggagggtgcagtgagctgagatcgtgccactgcactccagcctgagcaacagagcgagactctgcctcaaaaaaaaaaaaaaaagaaaagaaaagaaaagaaaagaaaagaaaaagaaaaagaaaagaaggtccaaattctctaccatggcctatacagcctttctcaacttggctgtaaccaatacctccaaccattctcccacataatcaatactacattcacaatcaatattctccatctgttcacaacttagtgcttttatacaagctgtgcgtacagcagaagtacccaatccactgcctacctactatccaaaatttacagatcctgcagaaatagctcaaatgctacctcttcagtaaggctatttataactacaccagaataaatggacatcctcattcactactgattctttccaaaagtttttctggaggccctactatgtgacagtcactagcataaactttcctatagtattttgttcaaacttgagttatgacagttatgatgttatatttaaaacgtatgtgattttatcacctgcatctgtctgttcatttcctgaagataacaagcattattttctggtccaactttcctgtttttctgacttgggtccaagaggggctcaggactccatgttgtgcctaataaagacttccctgatggcaggtcacagctgtgggcacccgagggtcaggctacaaggacagatattaaaataatgactgagcccacatgtagaatataaatagtgagccaagaaagtgaagaaaggtcaaaaggcaaagtattcaggtcttccatctcagatgagaaaaggagagttaaaagtgagaaacaagacaagcagagttggaaaaactgaagactaattctgaagtgatatcatcaacatagctcatctgtgcatgacttgatatactttgctggaacaaggccataaccttcaagtagaaaagtcattcttttttttttttttttttttttttttgagacagagtctcgctctgttgcccaggctggagtgcagtggtgcgatctcggctcactgcaacctccgcctcccaggttcacaccattctcctgcctcagtctcccaagtagctgggactacaggcgcccaccaccgcgcctggctgattttttttttttttttttttttttttgtatttttagtagagacggggtttcattatgttagccaggatggtctggatctcctgacctcgtgatccgcccgcctcagcctcccaaagtgctgggattacaggcgtgagccaccgcgcccggccggaaaagtcattctaaatacagtacattatatccatctttgtaactattctgcagcctaacctagtgccaggaacatgtgatgtgaaaatgtgctgaattaacacttttgcaagtaatgattataacatacacgcatatattctatgtgtattcatctgacccagtaggcaaaacaaagctactggaaatactgaactgtagaataggatgttgatatggttcagctctgtgtccccacccaaatctcatatccaattgtaatccccgtgtgttgaaggaggggcctgatgggggggtgactgaatcatgggggcagacttccccgtgctgttctccttacagagttctcgcaagatattgttgtttgaaaatgtgtagcacgtcccccttcactctctcctgctctgctgttctcgtgatagttctcgcgagatcttgttatttgaaagtgtgtgacacgtcccccttcactctctcctgctctgctgttctcgtgatagagtcctcaagagatcttgttatttgaaagtggctcctgctctgctgttctcatgatagagttctcgcgagatcttatttaaaagtgtgtagcacgtccccattcactctctcctgctctgctgttctcctgacagagttctcgcgagatcttgttacttgagagtttgtggcacgtcccccttcactctcttgttctgctattctcgcaataagagttctcgtgagatcttgttatttgaaagtgcgtggcacgtcccccttcactctctcctgctctgtcatggtaagatttcccttctccttcgcttccagtttcctgagacctcccagccatgcttcctgtacagcctgcggaactgtgagtcaattaaactgcttttcttcataaattacccagtctcaggtagttttttacagcagtgtgagaacagactaatacaggtatcttatctgaaaccagtgacttgaaactactaactcatggcatacagtaaatatcaaaagactaatttattctaccacctataagtcacatacagtattaaagcctggaaccaaaatgtaaaacaatcaggagctttggaaataaactgtcacgtgaactgaagattcttctgtcatttggctgcagaggaaaccattccgccacccaaaaaaaaaaaaaaaaaaaaagccacaaagaaagaagcagggatgaaaaaacacaagataacacacttaggctcttgaagtcattccactttctagtttcattcccttcccaaatcacaagacacacccctacgcttgatttctgtgagataccctgaatccttttaatatattcttctttgcttcagctaacactggtttctatttcctgcaaacaaacaaatttcataccaaccataagtaccacagtgctttacctcgactgcctttattatatccaagaacttcattgtcaaaaacatctattccttttacaactctgatttcacttcttactcctcttctcaattaccaatttattcaaatatctactgagcacctgctctagcacttagtaacagaaagatgaatatgtcatggtctctgcactcaagcacagtctagtccagttttttcaagctgtggatcttgatcaatttgtaaaatcaatttacttgtcctgagaggaactttttaatatttgaaatataagaaaattaaaatactgcatcacaagaaattaaatattattttctacagcttttgtttcagttacatgtgtgtttttactgaatagcaatatagtatgtatatctcactgtgggtcatgaacaaaggatttgaaaaataccagtaggcccctatttcctaataatgtgaacaaatgccaaggaagaagtcagtcaaaagctgtgccttagaaaatcctttagtgttttaataaaaaataatttcaattggtgttttcctagtttatgttgatttcataagtacttgaaaacagttgttggtttgcctcaagtagattaaacattccgtcttgtttatagttttaattagctaaacaaatccttttctctttgccttgaacattacaaagaaacttcaattcagcatgtcagaattattataaactcctaattagctaagtacaaatttagtacatttttaccacacttacaatgaatgctgtctgggctaaataaaccccaatcatcataagagtatctatcagctacaaggctacaagccatgacaagttagcctgaagaaaagaccatgaggcagaagacagctgtgctcaaatattattaaaggcataaaatgactctaaattgtttaaggtaacttctgaaaaatgtaagttaaagagaatgtagcaatacatcaaataagcgttgggcatcttgtaggatttcttgtattaataatctgattttgtttcaaggaaaattaattcaagcatgtttattctctagtttaaaggctgtccatctttatcagatagtggaaattatctgaaattagtggaaattagtgggaaaaaaagtggaaattagtcaacaagaatatttcctaaatacctagtacatgtagctccaggtattatgcagaacactacatatttctggaaaagtcataaaatacttccaaattatatacatgttattatgttaaaatccatagtaaaaacttagaacaattttagtgccaaaaataatcacatcataaacatgtttctatagaaaaatagaaatcatataaagcacagcaatctatttccatgtgttttcaaaaacatatacttgctacttatctatttgttttgctagagagaattaggtaactaaaggctaagaaaaaatatgtaaaaaaaaaattaaaattgagggggctgaggcaggagaatggcatgaacccgggaggctgagcttgcagtgagccaagattgcgccactgcactccagcctgggcaacagaactggactctgtctcaaaaaaaaaaaaaaaaaaattaaaattgagaaaatgtattcgcaaactttgttttctcagacacaggaaaagtaccactattagctggttttcacagagccacacacttttggcatacctgtgttcacgtattcattctcatttattctaaattaattgattgtctgcctaattctagagacataaagatgaaggtactcacagtttagaaaaggaacaaacgtataaaccaaatgtaatttaatttgcaaagtgcaacacagagtagagtacctaatccaggctagtgtggtagggagggcaaggaaggcttccacaaaagaggtgaaatctaaaacaaaggataggaggcatccaggtgaaggtttggtttctgaacacttttacgtgtgtggaggtgtggaaagcctagcattgtgagtacgggcatggcaagaagaattcgcctgctgggtacagtgcatcctcccgcggggcctgctgggtacagtgcatcctcccgcggggcctgctgggtacagtgcatcctcccgcggggcctgctgggtacagtgcatcctctcgcggggcctgctgggtatagtgaattctcccgtggatgctgcaggaccccatgcctagaggtctggagaactgtgctccacagtgatcagcggtacccccatccttggacctgcctctcccacgactccatgggggcctggcctcaagtcataggcccccgactgtgccactgtgtccactggtaattgtacacctgagcaatggaagggtcacacagaccccaccacccacaaaactgcatgtcagatcaccccatctctgggcgcatcccttgaccccgaggctcggagggcagaagaatcaccatcaggccatctggtatagctgaaacaaactcagcctggagctgagagaagggtcagaactggagggctacacaaacacactaaggattttggattttatgttgtaagaaatcaggattcagagaaatcttagatagctcactctatgagctaacaaaaaacagattagtaaataagaaatgagaattaagaaacattttaggtcgaaatgagatacatactatacaatttgctggtaaacaaagcaacaaaatacattttaattgagtagaaaaaaagaaagaaaaaaatggtaggggacagcaaaatcacatctaagaggctgtggcagggatgacatccaggtgagaaactgggggcctgaactgtgtagtaggcatggaaaggagaatgcaagaaaaacttggtgatataggaaggaaaatgaaatgaacttgctgaatgactgcaatgagattgagaaaaggaaaaagtcaaggagtggttcaagatgaggcagggagggacacataggcatgctaacaatctgaagccctgaaccgagaacagtagctaggagggtaggaggggaacaagaatgaataccaggtgacgaatcaggagactaagatagaaatttaggcaagaggttatggtatgatggtttcaactaggatgatgatagcagagatacagggatatatgtatatttgagaaacattctactgctgaaatcaacaggattgcagttattaggctaacaggtcagggagagggagagaggatgtcacaaggacaaaacagtggggtactagttactgaaataaggaaggtaggagagaagcaaatttaagaatgaagattgagaatactgttttaaacatgtggaatttccagctcctctgagatatctaagttgaaatatcaactagacagttaaatacaagagtgtggggccaggcacggtggctcacgcctgtaatcccaacactttgggaggccgaggcgggcggatcacgaggtcaggagatggagaccatcgtggctaacacggtgaaaccccatctctactaaaaatacaaaaaaaaaaaaaaaaaaaaaaacattagctgggtgttgtggcgggcgcctgtagtcccagctactcgggaagctgaggcaggagaatggcgtgaacccaggaggcggagtttgcagtgagccgagatcgcaccactgcactccagcctgggagacggcgagaccccgtctcaaaaaaaaaaaaaaaaaaaaaagagtgtggaattaaaagaaaggtctgtttagactgaaatataatttcaagaataacaattatataagtaattgcaactctgtaagacaacagaggaggcatatggacggaaaagatggcccagaaacaggtctaaaatctacactttagatgccaggcgaggatgagcctgcaaaggaagctggagtctctgtttattaacaaaggttttgagaaatttggttatgaagaagagatggtacagtagccttaagaagtgtaaggcaaacggagagggtgctctttgttttctttttgaggaaagacaatatagcatgtttaagagctgatgggaatgtgtcagtagagagagaaaaaggtttaaagatacacaagaaaaggcctggtgcagtggctcactcctgtagacccagcactttgggaggccgaggtgggcaaatcacttgagctcaggagttcaagaccaacctaggcaccatggcaaaaccccatctctactaaaaatttaaaaacttagccaggagtggtggcatgtgcctatgatcccagctactcgggaggctgaggtgggaggctcacttcagcccaggaggcggaggttgcagtgagccatgactgctccactgcactccagcctgggtgacagagacagaccctgtctcaaaaaaaggtatacaagaaagacagaaaatattcaatagcataagtttccaagaaggccaaaatacacgggatccaggacccatgtgaagggtttagcccctcctctccacgatggtgtctaggtaaactgtttgtgtgtctgtaggacagtggttgaggaaacactcttggagccacacagcatcctctaaattctcagttttctggctcactgtgttaagattagtctggacttatcaataaattgttagccactaaagtacaactggttctgtgtagtctttttttcccccatggatctgttaatgtttatttattagtactagcatcttcctttgttctctgtgttaaagcaaagaaagaagagggttttgtcatataatctgattttagcttgacttgggaaacttgagattgtcatttaatatatcttcttgctttaagaaataaattccttgtgtttacaattaattgatcacaaccagctatggatttctttgttccttcgccactcccactgctttacttgacaagaaaaaaagaaacaaagaaattccttgaaaatgaggaatacaaactgcagggataaaatataaatcaaacaaaagcatctcagctaaacctctttttttgttttccagatgctactatccttcaagatggtaattaataaaagagagaaaaatgcctaaacaccaactgatgttttcttgtcaaatctgtttcatcagacccaagggatatggcaggagatggtattctacaaaataattcggattctctttctaaagacttgaattgtttcaggaaaaataaacgaattcacaaatcagtaataatgcacttgtaggactaactatgagctgccatcactctgtaaatgaataaaacatagcggcatctacttctaaaactagtgccaaatacaccactaataactcctcgatgatgcagggaatcagtgctggtaattaacataaattaatgaaggaagttgaaaagttcagaagaagtattaaaagaacacctatcggggcggggcacggtggctcatgcctgtaatcccaacactttgggaggctgaggcaggaattgcttgtgcccaggagtaccagaccagcaccagcctggggaatatagtgagaccatatgtctacaaaaaaattaaaaatcatctggattattaaaaaataaataaataaaaaacagatgctggtaaggctgtggagaaaagagaacacttaaacacttgttttttgtttttcatttttttgaaacagagtctcactttgttgcccaagctggagtgcagtggcacaatctcagctcactgcaaccttgcctcctgggttcaagcaattctcgtgcgcctgcctactgagtagctgggattacaggcaagcaccacaacacctggctaatttttgtatttttagtagagatggggttttgccactttagccaggttggtctcaaactcctggcctcgtgtgatccacctgccttggcctcccaaagtgctgggattagaggcgtgagccactgctcctggccacttatacactgttggtgggaatgtaaattagttcaaccattgtggaaaacagtgtggtgattcctcaaagacctaaaaacagaactatcatttgaccagcaatcccattacttggtatatgcccaagagaatataaatcattctaacctaaagacacatgcacatgtatatttactgcagcactattcacaatagcaaaagctgaaatgcccatcaatggtagaatgcataaagaaaatgtacctatacaccatggaatactatgcatgcggccataaaaagaacaaaatcatgtcctcagcaggaacatggatggagctggaggccatcatccttagcaaactaacacaggaaaagaaaaccaaatactgcaggttcttgcttaaagggggagctaaatgatgagaacacatggacacataaagagggacaacagacactggggcctccttgagggtggaggttggaaggagggagaggatcaggaaatataactgttggatactagacttaatatgtggatgacaaaataatctatacaacaaacccacatcacatgagtttacctatataaaaaacctgcacacgtatccctgaacctaaaataaaaattttaaaactaaaaatgagctgggcatggtggcacatgcctatagccccagctactcaggaggctgatgggggaggatcacttgagcccgggaaatcaaggctccagtgagccatgatcatgccactgcactccagcctgggcaacagagtgaggccctgtctcaaaaagaataataatttttaaaattttttttttaaaaatgctgggcgcagtggctcacgcctgtaatcccagcactttgggaggccaaggcaggtggatcacttgaggtcaggagttcaaaatcagtctggccatcatggcaaaacctcatctctactaaaaagacaaaaaaattagccgggaatgggggcgtgtgcctgtaatcgcagctacttaggaggctgaggtaggagaatcacttgagcccaggaggtggaggttggagtgggctgagatcacatcactgcactccagccttggcgacagagtgagactccatctcaaaaaaaataaataaataaaatttaaaaataaaatacacttaccaataaaacaatggcaagttgctgtgactctattacttaggacaggagagacacatcatttgacagaattagatttcacatactttaggatgctacctgttttgcttgaactacccaacataaatataagggaaataataaaaatataagagcagaaataaatgaaatggaggctagaaaaacaatacaaaagatcaatgaaacaaagagctggttttttaaaaaacacaaaattgacaaacctttagctagacaaaaagagggaagactcgaataaagaaaatcagagatggaaaaggagctattacaatggaaatactaaggatcgtaatattatgaacaactataggtcaaccaactcaataacataaaaaaagagataaattcctaacacatacaatccaagataaaagtctcccatcaaagcaaagcccaggacctgacagcttcactgctgaactctaaaaagcaattaaagaactagtactaattcttctcaaactattccaaaaaatggaagaggagggaatacttccaaactcattcaaaaaagccagcattattctgacagcaaaaccagacagacacaataaaagaagaaaattacagacaaatatccctgattaacatagaggcaaaaatcctcaacaaaatatttgtaaaccaaattcagcagcacatcaaaaagagcactcaccagtacttgcagaggccaaggtgggcagatcgcttgagcccaggagttcacgaccagcctgggcaacatggcgaaaccccgtttctactaaaattacaaaaattaggcgggcgtggtggcacatgcctgtagtcccaactactcagaaggctgggttgggaggatcacttaagcccaggaggtggaagttgcagtgagccatgatctcaccactgcactccagcctgggcaacagaacaagactctgtcttaaaaaaaaaaaaaaaagataattcaccatgatggagtgggattcatcccagggacgcaaagatggtttaacataagtaaatcagtaaacatgatacatcacattaacagaatgaaaaacaaaaaatatatgatcatttctatagatgcagaaaaaggcatttgacaaaattcaatatgcctttttaaaaacatttacagttcagacatggtagctcacatctgtaatcccagaactctgggaggttgaggcgggcaaatcgcttgggctcaggagttcaagaccagcctgggcaacatggtgaaaccccatctccacaaaatatacaaaaattagccaggtatggtggcacatgcctgtaatcccagctacttgacaggctgaggcaggagaatcacttgaacccaggaggcagaggttgcagtgggccaagatcacaccactgcactccagcctgggtgacagagtgagactctgtctccaaaaaaaggaaaaaaaattaataacaataataataacaaataaaaattaacagggctgggtgtggtggctcatgtctgtaattcaacattttgggaggctgaggtggaagggttgcttggggtcaggagtttaagaccagactagacaacaaagcaagacattaccactggaaaaactttaaaaattagccgggcatggtggtacatgcctggagtcctaggtacttaggaggctaaggcaggaggatcacctaagccaaggagttggaggctacagtgaactatgatcataccactgtactccagcctggccaacaagactgtgccttcagtcattaagcctctgtacatggtagccttttcacgctaaacccaggctactgcctacccactggcccattcagtacctccacattccatcactagagcaaaagagaacttctggatccccagcatgacaagcacatgccatgaagaactcagagttgccatatgtggccagtctccttggccactcactggagaggcctctctgctgttagccacctgctttccacaatcactctcatctatctgacacacctcccaaacagaggaggtctcaccaacgacttcttcaatcttggtcttcttccattccacaattccccttggccgaaaaaggcccaaacttattataaatcttactacctagcagtcaaggcatggtgttaatatgtcaacaaaagctaaagggattttttaaatggctgaaaccaggctgagaaggcaaagtacaacataagcctggaacattttgttggactggaacattttgtcattccagagagtaagaaagtgttcctaaaaattatggaggtagatcaaatacagaagccagcttgaaggggctcccatgagtcaaatcagtgacaatttcagcatcaaaataaataagaacaataatggaacaaataggaaccaatggaacaaataggaacccatgagtccatactaataataaatagatacataaataaatagaggagaaggtaaggctcctccttagaagaaaataaagacataaatgtggagggaaccataaataatgattcaggtaagaaccaatcaataatagatgttaactctatggaggaaaaaaaactgacgaggaatagacatttgcatggtctcaaagtgtctccccacagactggctcattagttacaaggggaaaaacagtaactactcacccaaggctgtatcttaaccaagtgattaaaacttcaccaactaggagcagatggacattgtgtgcttcctggtgtgatatcctcagaacaacacagtatcacacatacactacataaatactgtcttatgtaatactctggctggggttgaaaaattcaagtctaatcatgagaaaacatcagacaaatctaattcggtttttttattctataaaataactgacttgcattcttcaaaaatattaatatcataaaagatgagaaaaggctgaggaactactccagattaatggagactaaagagacatgacaactacatgtattaatatataatccagctggacacagtggctcatgcctgtaatcccagcactttgggaggtcgaggcgggaggatcacctgaggtcaggagttcgagactagcctggtcatcatggcaaaaccctgtctctgctaaaaatacaaaaaataattagctgggtgtagtggcacacacgtgtaatcccagctactcaggaggccgaggcaggagaatcgcttgaacgtggaaggcggaggttgcagtgcccaagatcacaccactgcattccagcctaggagacagagcaagaatctgtctaaaaataaaaaaaaattaaaaaaaaaaatatatatatatataatatatacacatacatacactatatatacacactatatatatacacacacactatacattgtgtatatatacacacactatatatatacacactatatatatagtgtatgtatgtgtatatatacagtgcatatgtgtgtatatatatagtgcatatgtatgtgcatatatatatacatacacacaaaaaaaatcctacactggatcttggactaaaggaaaaaaatgcaacaaaggacattattgcaacatcgacaaaattggaaaaatgaactagagatcaaaagtactgtgtgaatgttaagtattttggatttgactaagtgtagaatggttatataagagaatatccttgttcttaggaaatgtacactaaagtggtaaggaaagagacattaggtatgcagcctaccctcaaatagttaagaaaaataaataatatttatgtatgtgtgttgtgtgtggggggtggtgtgtatagagaggaaataaataaatatgataaagccaatagagcaaatgttaaaatttgtttacttagataaaaggcatgtaagggttgtctgtactattcttccaacttttctgtaattttaaaattattccaaaataaagctttttaaaagcagtttgaccaattttaaaagatgttttaatttttttaatttttatttatttttttagagatggggtcttgctgtcccccaggctgaagtgcggctgtatgatcatggctcactgcagcctccaactcctgggctcaagtgatcctcctgcctaagcctcctaagtagcagggactacaggcacatgccactactcccagttaattctgtttttttgtagagacagggtcttgccatgttgcccagcctggtctcaaaatcctggcctcaactgattccccatccttggcctcccaaagtgctgggattacaggtgtgagccaccatgcctggccccatattttaaaataagactgcattaacctgtcatctttaatttcaaccatataagcaaggtaacaaaataaactttccagtgaagaagatctaaaaattaatgtgatataaagcatagataaacattttatgagaggattaaaacttcaactagcacagcaattatgcactggcgctctgcttactgttccactcggatttcattttgggctcatcagggatcccctgagtaagattaaaacactttatatcttatctataaatagatcattacatttgcatagaaagaagtttgataaaaatgtagaaagactacttcttaagttaactaggctaaaaactatgcaggtaccaaatttggctcctaatctcagtggcttttaaaagctaattagcaggaagcacaacccaaatatagaaagtgaagacaatcagtccaatcttggggaacaaaaacctaaagtaggtgttacttgtgatgtattatgctctgaataagtccattaaaagcatgtaagcattcaaccaaaatatttgattttaatttttcaatgattccagatgttctttaagttgaaaaaaaacaaaaaaaaggaaaaatgaaaaccaaaggttaaataggcaacactccagcacaagccacaaggggcctcagaaaaacacacacaccacactcctacaaatccacccgcctagcacccatacagaacgtgccataggtaattatgatcatcagaggcttttgatcttgtggaagaagaaaaaaaagaaaacagaaaagtgacaggcagccctttttgcaatttaatgagtggaatatgcttctacaatagctggaagcaccttttactatgttgttttttgttgtcattgtttttcgctatacctgctagattagaattttattttgtttttaaatttttaatcaaagcaatatataccatatggttaaaatggcaaataggctgggcatagtggctcatgactgtagccccagcactttgggaggccaagacgggcagatcagttgggcacaggagtttgagaccagcctaggcaacagagtgagaccctgtccctacaaaaaacagaaaaacttagctgggcatgctggcatgcgcctgtagtcccagctactggggaggctgataggggaggatcgcttaatctcgggaggtcaaggctaccccgagccatgatcacactactgcactccagcctgggtgacagagcaagatcctgtctccaaaaaaaagtcaaacagaaaaaacaaaaagcttccttctcctgctccccaaggcaatcatatctaactatttcatttcagggagtctcccgcagttactctcaaatttcttttttttttttttttttttttgagacagagtctcactctgtcactgaagctggactgcagtggagcaatctcagctcactgcaacctgtgcctcccgggttcaagtgattctcctgctcagcctcccaagtagctgggattacaggcacatgccaccacacccagctgatttttgtatttttagtagagactgggtttcaccatgttggccaggctagtcttgaactcctgacctcaggtgatccacctgcctcggcctcccaaagtgctgggattacaggcatgagtcactgcacccggcctaatgaatctttttcattccctcatttggtaggtatcttaatgttttagtttatctttttacatggcttaggttctggcaatacgagaaactattaagttaactggttctacatcttggagataaatagcacttcagcagtttgagttcagaatatatttagagtaaacctgatttattatgttattattcattttatgttatatattttgaaattcaaaaaaaatgccttgattccttattacttttgctaagtattctgctcatctcagagaagaaagtgtttttggactagctctgtaaattaccactctaggcttgtttcagaaccatttttctaaaaacattattttataaggtcagttgcttctagctaggaatattactgattttctaataggccttgttgggtttcaaaaacactttttaatgtgctaaaattgccccccaccaccatagcagacagacaactacccagctatgcactggtgatctaaaagccatttatgacatattgttattattatgacttactgttattacagtataagagaagaggcggaacacatatgcctcaatcccttcagagtttgttttttggggcgagggggtaccactcctccatgacttaagttttaaagaggtatgctctgcccctcaggggaaagcctgcaggtgtacttgtccagcattcccatgagaccaaatgaggtttgtctttgttgccaaattttgcagcagccgattgttgccatctacccaagccacttttcaaatgctccatcactaataaagctgaaattgtaattttcaaaagataacaaaaaaatctgctaggccatttaaattcaccatacataatacctaccaaaagttattaacaatttatttttaatctaatcctataacatgcttactaatagttaacatctaaataaattaattggaacaggattcaaaatgttctaattctacatcggagtgttttcagcttttacctaaactttgaagtctgtagtcttatccctcacagataagacaggcattcagttttaaacagttcttatagaaatttagaagtgggccgggcgcggtggctcatgcctttaatgcaagcactttgcggggccaaggcgggtggatcatgagatcaggagatcgagaccatcctggctaacacggtgaaatcctgtctctaccaaaaatacaaaaaattagctgggcgtggtggcacgtgcctatagtcccagctactcaggaggctgaggcaggagaatcgcttgaacccgggaggcagaagttgcagtgggccaagattgagccactgcactccaacctggacaacagggcaagactcccctctcaaaaaaaaaaaaaaaaaaaaaagaaatgcaggagtaatgaggtttcactacttgtttttaaactgacactaaacaattattaacatcaaataaattctatgtatagaaatacaaaatataaggattgagtttttaatctctactatatataaaataggactctaacaattactgcagaggtcagcaactccaaggtttatggaaggaaaaggggagacaggagacagagggcgtggtattgtctgcaggtcattctctggctttctttccagtatctccctttctccttccctcccactttccaagaagttgctactgtatgaggaaattctgtcaagtagcaggaaggggaaggctttgagccttgtagctaggactggtaagaactaagaaaattggtcctatctgtgctatcagattaaggagggtgtcgcctctggtacttttggcaaagatggtcaaatccccaactacaacctcacagtgatttgtggcgcattaaaaagtttgtacttggtcgggcgcggtggctcacatctgtaatcccagcactttgagatgctgaggtaggtggatcacctgtggccaggagttcgtgaccaccctgaccaacatggcaaaaccccatccctatcaaacccctgtcgactaaaacacaaaaaattagccaggcatggtggcaggcgcctgtaatcccagctacttgggagactgagggagaactgcttgaacccggaagaggaggttgcagtgagccgagagcccaccactgcattccagcctgggcaacacagcgagagactgtctcagaaaaaaaaaaaaaaaaaagtttgtactttttggccggcagccatggctcacacctgtaatcacagcactttgggaggctgaggtaggtggatcatttgaggtcgggaattcgagaccagcctggccaacatggtgaaacaccacctctactaaaaatacaaaaaaaaatagccgggcatgatggcgcgtgcctgtagtcccagctactcgggaaactgaggcaagaggatcgcttgaaccagggaggcagaggttgcattgagtcgagatcacaccactgcactccagcctgagcgacagagcaagactctgtctcattgtattgcccagagtggagaccagtggcacaatctcggctcactgcaacctccacctcctaggctcaagcaatcctcccgcctcagcctcccgagtagctgagactacaggcatgcaccaacacaccaggctaatttttcatatttttggtagagacagggtttcaccattagctcaggctgatctcaaactcctgagctcaagcaattcacccaccctggccaccaaaagtgctagtattacaggcgtgagccaccacgtccagccaagtttttactttgaagcaatagctaaaatagattttattcacactcaaagcaaaggttataagctatctagattttgttattctatgacaggtaatatagaaatacagttcagaaagataatgacagtatatgatcctaaagctatttttctttcactttaccaacaaattgtaatgttcattctaatgaatatggacattttattctataattacacatcaaagtatacagtgtactctatattttaaaaatatctaggtaattctaatggagtacttcctacgaactcctctaaacattgcaaacgtaccatcatcgtcactgttttacagttaaggaaactgagatgcagaggttaaattacttgcccaatgtcacaaagttagtaagtctcagattcaggatttaaactggctccacgggccagtccaatccacgcctctatgcctctcgggctttaataggcatgcacatcacctggagatcttgttaaaatgtagattctgagttaagttggtctaagactgggcctgagattttacatttccaaaatcatttagttacactgatgctgctggtccacagactgtattttaagtaacaagactgtaaaccactttgccctgctacccaactaagcatcaagaaaggggtgatatttaactcagatcctaacaatctaagcaaagaggcaattatatctgcaattcaaatacagaaccaaggggctgctttcaacctatatgaagactttcaatttacaataaaattcaagacccaactaaaaagaacttgatttgttcaatgtccttatttttctagtctaaggacaaaagcctatttcttcctgtccccatacaaacacagagaagaaaacaactttttcttttttgcagacaagcttttccagttggcatttgactaaaaattacatgtaaaaacaaatacatcaagtaagacacaaaactcttgactattcaattatcaaatacgtcacaaaaacctgtaaaagacagcttgtctctggaacactctagctcagcaactttttaaaggagggattagagaaagaaattgttccaactagtcatgcttctctattgaaaacaacatgattcagacctgacatttaaagacatctctgatgtgaattgaaaccaattttcttctttcaatctagaccaaaattaaaatgtttaattcctattaaacttaaacctcatttctctttctcaaattcaagctatttctaaaaactttcttgcacactcccttttaaggactattcagagttttctttgtgtatgcatcctattttcccaccttataagatacttagataaatataatcaatgaatttgttaggttttaaaattaacatttagtcttactgatacctaattactataatagctttctccaacgggtaccatgatgtcagaaaaaaacacacatacatactaaaatcatctcttaacacgactatattctaacactgtttttgaaaacctagagaaactacctgagacaagtttagaagggaaatatcatttatagcacacctacctgaaagtaggtgcaggctttgcaattaggcagacctgggtttacattcacctttagtgactgtgtgacctacgggcagatttatctaaacttactatgtcatagttctttgttttacatgtagtaaattcaattacatagttacagcaatagatattatagaaccatttttataaaagggaaaattaaagctcatggaatttacacaacttattgaatcacctagtaactggaaaaatcagaatttgagtccagctctatcagactccaatgcccagggcttctcctgtgagccatatacggcctgtggagttactgactgcttaactgaggtaacaagtatttcccacactctcagaatgaatctgtaatttaaagaagcctataactctactgcagcacaaaagccacctgcgtctacactactggtactaagacaaccaactattaaatatcaactagctaggaaataaacataaaagtcagtctcagctaacccaagaaatattaatacatatgtagataagggcaaagatgactgagagaatttgcttctaaggtcctcccagtcttcatactaacaaacatctgttgaggacctactgagaacatatgtggctaggtacccagttacattttacctaacattatgacacgatcaagactaaagaccaaaacaatttaaaaaaattaactaacctaacctaaaccacaataagagtttctacaactgatgctttaaatgataggagatttcactgcatctttggacagtcacctaaaagtagaagtaaatactaaggatactctgtgtaacagagtcaggaggtgagaaagcactggtctatgcacacataagtgctcatatatgcacacctgtcctctgtcctggagctggtacataagtgctcatatatgcacacctgtcctctgtcctggagctggtacataagtgctcatatatgcacacctgtcctctgtcctggagctggtacataggtgctcatatatgcacacctgtcctctgtcctggagctggtacataagtgctcatatatgcacacctgtcctctgtcctggagctggtacataagtgctcatatatgcacacctgtcctctgtcctggagctggtacgtaagtgctcatatatgtacatctgtcctccgtcctggagctggtacgtaagtgctcatatatgcacacctgtcctccgtcctggagctggtacgtaagtgctcatatatgcacacctgtcctccatctggagctggtacgtaagtgctcatatatgtacacctgtcctccgtcctggagctggtacataagtgctcatatatgcacacctgtcctccgtcctggagctggtacataagtgctcatatatgcacacctgtcctccgtcctggagctggtacataagtgctcgtatatgtacacctgtcctccgtcctggagctggtacataagtgctcatatatgcacacctgtcctctgtcctggagctgatacataagtgctcatatatgtacacctgtcctctgtcctggagctgatacataagtgctcatatatgcacacctgtcctctgtcctggagctggtacataagtgctcatatatgtacacctgtcctctgtcctggagctggtacacaagtgctcatatatgtaaacctgtcctctgtcccggagctagtgcattaagtgctcatatagttacacctgtcctctgtcctggagctggtacaagatcatggttcatactccaggaatgagggctagaagacctggttccagatccagctctgtcactcacagctgtgtgacctgggtcaagtaacctctttaagcctcagtcactttaactgccaaatgagtataaaaatagcacttaatttacgaggttgttcatttaatacacttttgttgagattacatcttgccactggcatcctgctaggcattgtggattaggtgttaaaatgcacgtgatgtgtttggcatgtgtcaaaaagcgggatttttttttttttttttttttttgagacagggtcttgctctgccacccacgctggagtgcagtggcgcaatctcagctcattgcaacctctgcctcctagactcaagtgatcctcccacctcagcctcccaagtagctggaactacaggtgtgtgccaccacactcagctagtttttaaaatttttgtagagccaaggtctcaatatattgcccaggctggtcgtgaactcctgggctcaagcaatcctcccacctcagcctcccaaaatgctaggattacaggcttgagtcacggcacccagcccagagcagggatttttgtctgttgtggttctctgctgtatcttcagtaccaacaacagtggctggcacgtaaagtctcacattaaatatctgctgtatcttcagtaccaacaacagtggcatgtaaagtctcacattaaatatcgcaacaaatactgaaaaaattgtttagcatcaggtgggtcagaaactactcccccgacccttgtttggattcagcctgtgtatttttaggtatcactaaaagaagttcaaggatctttttttaatttctttttagtttttataacagcttcatagagctataatttgcaaacaataaaagtaacccacttaaagtgtacaatgcaaccattttacattcacagagttgtgtctgccttgttttaaagacagggtctcacaccatgttgaccatcctggcctcaagtgatcctcctgccttggcctcccaaagcgttgggattacaggagtgagccaacacacccaggctctttcattttaaaaagagaagtcgggctcctgagactccatgtgtgagtttctgtcacacgtatttaaagtacttttaattgaacattttctgtaacaaaacactaaaacatacaaagaagtaaagcataatgcactctcatgtactcatcaaccaatttccataattatcaacttttttttactatattaaaatgtttcaaataccttagaaggttagattaacaaacacctctctattcagacacatctagttcctattccgagagaaaggggaaaagatataactacattatctgacacaacggtggctcttacgtctgctcccttacaaaatgtcactgtacagcaaaaataatttttaccagcaatgagtatccatagaaaacatagtaatcaatcccccattcccttccactatgctattttgggtccttctgacaaaatgaaagtaaatctcaatgcaattatccaagttaccttttttcaaaagatcttttttttttcttttttgagacagagtcttgctctgtcacccaggctgaatggagtacagtggtgcaatctcggctcactgcaacctcagcctcccaggttcaagcgattctcctgcctcagcctctcaagcagctgggattacaggcgtgtgccaccacacccagctaattttttgtatttttagtagagacagggtatcacaatattggccaggctgatctcaaactcctggcctcaagtgatccgtccaccttggcttcccaaagtgctgggattacagccactgtgcccatccaaaagatctctttagatctcaagttctataataactaacagagaaagagcaatacacatagactatagatgtaattaatctgttccaaataccttcaatatgccatcttccttctgcagatctgtaatggttgatttcacatgtaaacatgactgggccacaagatgcccagatatgtggttaaacattattttttggtgtgtctatgagggtttttctggaaaaaaaaatagcatttgaattggtgaactgaggaaagcagattgcccttttaaatgttagtagatatcatccaacctgtgagggcccaattagaacaaaagaatggagaaagggtgaattctctctctctctctctgattacttgagctgagacatcagtcttctcttgctcttggactgagacctaaaccatcaatcctcctggttctcaggccattggactccactttcctgggtctctaacttgcagagaacggatcatgggacttctcaggctccatatatatatatatacacatacatatatacatacatacatacacatattcatatatgatcatatatataattatatatataaactcatatatgagtatatatgatcatatatgattatatatatatgaactgatatgagtatatatatgatcatatatgattatgtgtatccatagaagatatatatatatagagagagagagatcgatcgatcgatcaatactctactggtttctctggagaaccttaatacaggggttcaaaaaaattccataacttctggctgggtgtaatggctcacacttgcaatcccagcactttgggaggccaaagcaggaggatcactcgagtcctggagttcaagaccagcctgggcaacataatgagaccctttctctactaaaaataaacaaaattagccaggaatggtggtgtacacctgtagtcccagctactgggaaggctaaggtaggagggtcatttaagcccaggaggtcaagcctgcagtgagccatgatcatgccactgtacaccagcctgggcaacagagcgagaccctgtctcagaagcaaaaaaaaattccgtaacttctaacatcaaagtgatcctcagtttgccatgagaggtaaaatggtgggtcagcccagggcatataatctttacactaatggttatcacctaagggcaacatgcagaaagccacagcagtgctccttagtgataggatcctcaatgttatagatacatcctcaatgttacagatggtggtacttcttacccccatataaattgatttatcatgtgtctacatctatcacatacataagcatcatgtggcacaaagtggtattaccccagattttttttttccacagttacaatggttgacgaaagccactctgtcgcctttcctggcctacgtcagggccaagttcaaaccctctccctaactgcagattagcagtcatggtgggctctccacagctctcactcagaggtgccagtacacctccctgcacatacagcgggataaacagctaggcaatctcagtcaagtgctttcttctaaagaagggccagcccctgaactaaaagacatataattttggccaataaaactaaggtaacaagttccatatgttttataaacataagatacgataaaaaacacaaagtgctccagtttcagatacagggaaatcaaggccatatacttctcagtaggggaaacgtccaacaagatcctgggaaaccagcagttggggatagaaagaggcaaacactgctccacagacaagggcagaccaaggagcctctgattccccagagtctacagttatatgcagatctctcaaggggatgaaactagttaacccaaatttcaggtttcttctgacttagaccatatgtccttacagcaccaggttgagctcattgcccctctcttgaacctaaacaaagcccagctgcagacttagaaaggatttactgttcataacaacaaaactaattttctactgtacccagacgatctcctctaaaaatgttcctttttaagtgaccaagttaaaggtaaaggatgacttccccctcgatgatatgtatatttcaattgatgtgcctgaacattaagagttaagctgttgataagtccttgaaatcaggcattctcataaaacattcacattaattcaagcaaaacattaaagagcattacataatgagtcatactaaaatggcaatgaaaagaacaaccattaagacacccagagtatcagtttagctccagttatcatttatagcatgaaaacatgtcttgagactaacatcaaaacacttacctcagcccccagaagtatcctgttcttccccttaaatacacaacatttaccaaaagcactgttttacgcaaatacaaaaggctaatctaaaaatgaaactaaaaaaacttatttggaagaatattcactaagctatctctattgcagatgtaaagccttaaaggaccatttaagggaaagggaaggctgtataattatgtaataatgttctctgatacaattgtggctctcacataagctttcttaaaagagaagagctatgaacaattaagatggcatagcacaggaaaaaaaaatgaccagcaatgagcattcacattctttctcctctctcatcctctctgctttttgggacctttccaataaaaggagagcaaatctaaatacaatccaagtcattttgtggttaattccaaataatgttccatattttaataaatctaccattgctttttcacaattgtaacagatgccactcccaactccttagatgtgaaacctaaaaacatatcacttcaaccaaaatacctaaactattgtactagttacacctaaaaacacatcacttcaaccaaaatacctaaaccattgcactagttacacctaaaaacacatcacttcaaccaaaatacctaaaccattgtactagttacacctaaaaacacatcacttcaaccaaaatacctaaaccattgcactagttacacctaaaaacacatcacttcaaccaaaatacctaaaccattgcactagttacacctaaaaacacatcacttcaaccaaaatacctaaaccactgcactagttacacctaaaaacacatcacttcaaccaaaatacctaaaccactgcactagttacacctaaaaacacatcacttcaaccaaaatacctaaaccactgcactagttacacctgaaaacacatcacttcaaccaaaatacctaaaccactgcactagttacacctgaaaacacatcacttcaaccaaaatacctaaaccattgcactagttacacctgaaaacacatcacttcaaccaaaatacctaaaccattgcactagttacacctgaaaacacatcacttcaaccaaaatacctaaaccattgcactagttacacctgaaaacacatcacttcaaccaaaatacctaaaccattgcactagttacacctgaaaacacatcacttcaaccaaaatacctaaaccattgcactagttacacctaaaaacacatcacttcaaccaaaatacctaaaccattgcactagttacacctaaaaacacatcacttcaaccaaaatacctaaaccattgcactagttacacctgaaaacacatcacttcaaccaaaatacctaaaccattgtactagttacacctgaaaacacatcacttcaaccaaaatacctaaactactgcactagttacacctgaaaacacatcacttcaaccaaaatacctaaactactgcactagttacacctgaaaacacatcgcctcaaccaaaatacctaaactactgcactagttacacctgaaaacacatcgcctcaaccaaaatacctaaactactgcactagttacacctgaaaacacatcgcctcaaccaaaatacctaaactactgcactagttacacctgaaaacacatcgcctcaaccaaaatacctaaactactgcactagttacacctgaaaacacatgacttcaaccaaaatacctaaactattgcactagttacacctgaaaagacatcacctcaaccaaaatacctaaactattgcactagttacacctgaaaacacatcacttcaaccaaaatacctaaactactgcactagttacacctgaaaacatatcacttcaaccaaaatacctaaactattgcactagttacacactaccagagttttatagataaaatcctgtctgtacatttttccaatttccaagataaatatcattttattatgaactcacagcatcacagaatgtataattactgttgacatgtgaaaagtttccaacaggaatgaaaagcttcattaataataaagatctagccagatgcggcggctcacacttataattccaacactttgggaggctgatgcaagaggatcacttgaggccaggtgttcaagcccagcctgggcaatacagtgagacccccccccacatctctacaaaaaaaattttttttaaatagctgggggtggtggttcgtgcctgtagtcccagctatttgggctgaggtggaaagattgcttgagcccaggagtccaaagctgtagtgggctaggatcacaccactgcagtccagcctgggcaacagagcaacactctgtctcaaaataataataaaaataataataaagatcatgggctctgagtgcagacagaattagctacataatttgagcaagatataacttctctgaacttcacttttcttatctgtaaaacaggaataatataaagagagacctcagaagattttgcaagactaaatgagataatgcacactaaagcccatggactcattcctgacagaaagcaagtattccttaagtgttgaccatcatcctcctctatactgagtaaaatgtatcattactgcttacttatcagtcacatataatatcccaggctttacgctggatgctgaacactttatcatagattatctcatttgttcttttaactaatcttataaggttgtttttattattgttgttaaccccattttaccaatgggaaaactaaggtttagctagtcagtttgcaggttcatgaaattagtaaacggcatcatcagaacctggaccagaatctatctgacaacaaagctccttaacagatatgacataagtattaacaggttcaaattcctctagaatgggtaataatagaagattccatacccaagtataggtgatattcatctaataactacctgaacttctgaccttttaggccaaaagtgaaaaattgaaaccccactccaattcttgaattgatatttaatctctaaaatatttatttcagggataagtgtgaagattataatacctcacatttatataatgctctggattaagtcatttgctcttcactaaaatcctatgacacagataggaattataaccccatttcattcattctgtagatgaagaaaatgaaaatcaaagagattaagtgatttgcccaaggtcacaaatctagcaaatggaagcagcgctcaaacctaagacttacttctccaagtacagtcctatttttcagtataccatgtagacaaacagatgaataatactaattaaaaagtgatcttcaaaaaaagtaatctcaccacccccaaaaaaactaattcactcatcatactcattctcattgatgatcaaagcaatggtatagttctccaatatacaacatttaaagaaaggagataagacttagaggagcataacactgttcaaaaaggtaggcccatggacatataaggaaagcaaaagatccactggtctccaagacaacaaaataaataaaattacccacctatactaatagaaaatatggtctagaactatactgaagaattttgtttaaataagaacagtcagaatgggtagacattgacggtacaagacacaatacctgcatccaagagcttccagaggaggtaaaaaaagtatttaataattactggttcaaatagttgaaatatggttgggcatggtagctcacgcctgtaatcccagcactctgggaggccaagcgagtggatcacttgaagccaggagtttgaaaccagcctggccaatatagccaaaccccatctctacttaaaatacaaaaattagccaggcatggtggtgcgcacctgtaatcccagctactcgtcccagctactcaggaggctaaggcaagagaatcacttgaacccaggaggtggaggttgcagtgagccgagattgcaccactgcactccagcctgggcaacagagcaagactctgtctggaaaaaaaaaaagttaaaatacaaggtggtaaatgtgataaaagatacaatgttctgagtacctgaaagagtgagcaccaccctaaacaaccaggagacaatcaaagaatgtgttcatctatagaaagaaaatgtaaaaaaacagaagtctcaaaatacaagaaaaatagttacaagcaatttcaccctactgcagaaaaccatgcccagtgtctaacttaggctccactcagatcttttttttttttttttgagatggagtttcactcttgttgcccaggctggagtgcaatgacgcgacctcagctcaccacaacctctgcctcctgggttcaagtgattctcctgcttcagcctccccagtagctgggattacaggcatgcaccaccaagcccggctaattttgtatttttagtagagacagggttcctccatgtttgtcaggctggtctcgaactcccaacctcaggtgatctgcatgcctcagcctcccaaagtgctgggattacaggtgtgagccaccacgcctggccctcccttttagcatttcctatgcatggtggccacatgaatcatgtgacctcgtaataaactgatcttccacaagtgcctcattcattaaatcctgctcattaaaagttgggctccaaactacaattaaatccatgtatttgatctgtgaccgaaaaattattatattaaaggtagttattacacaggtaatttcattaaaaagaagtctgggcattttaaaatagacttctagaatcatctgccagcttgacttgtacatcttgactgaaactaacagaagaaaggtattactatagatctctgatacagaaaggtcaagttcaagaaattcagtcaaaaagcaaaaacagaagaaagtgaagggtgctcagaaaaagtccaagctaagcacagaaaaaaataacagagatttaggctgggcgtggtggctcatgcctgtaatcccactttgggaggccgaggcgggcagatcacctgaggtctggagttcaagaccagccctgacaacctggtgaaaccctgtctccactaaaaatacaaaattagccaggtgtggtggtgcatgcctatagtctcaggtactggggaatctgaggcaggagaatagcttgaacccaggaggcagaggttgcagtgtgccgagatcgcaccactgcactccagcttgggtgacacagtgagactccgtctcaaaagaaaaaataaaaatagagattttaagcaggctgttatttacaactgctgcaaatattcatataaaactactatggatttagccctagtgtcctcaaactttagtgccaataagaccaataaagtagacagaagacagattgcaaaaggaatgcgtctccatcctgtaggtaaacaggtatcaaaattttatgagtaccagcgtcacccagggagcttggcaagaatgtagattctgtgccttaaaacactagatattctccggagaggcactgagagccagatttttaacaagtcctctctctctctctccacctcccactccccagtcattctgagggaggtgaatggtaggtcacttctgaagaagcaatgcaggccgggcgcggtggttcacacctgtaatcccagcactgtgggaggccgaggcgggcggatcacgaggtcaagagattgagatcatcctggctaacatggtgacaccccgtctctactaaaaatacaaaaaattagccgggcgtggtggcgggcgcctgtagtcccagctactcaggaggctgaggcaggagaatggcgtgaacccgggaggcggaggctgaggttgcagtgagccgagatcatgccactgcactccagcctgggcgacagagcgagactccatctcaaaaaaaataataaaagaaaaagaagcaatgcaatatttcaggtactatcctagtacttttgtgtgtgttgtctcatttactcctcatgaagatcacgaggtagctatttccctattttatgaatgagaaaacagaagcccagggtttaagaggcagaaggttaaacaactaaggagaaagaaaaaggacagaaaggaaatttgctctattcgacagcgatttcaaagtattctaaataaagaagctgacattctaaaacatcattaaaaacaaaagtatcaatagatcagaaagcttcaatatcttgtgtcattcagagagagagagagatgtggaaggccaatattgaaagttataaataactgtttaaatatttaaaatgcaactcagctgtttgtagtaggctgtacgtaagccaaggtagaggctgaaagtacactgtatgaagttatttatgcttaaaatttgcattatttgagcttgaagtctttattttttttgagacagagtctcgctctgtcacccagtggagtgacaaaatcacagctcatagcagcctcaaccccccaggctcaagtgatcctcctgcctcagcctcccaactacctgggactagaagtacgaccaccgcaccttgctaattttttcctttttttttttttttttttttgtcaggacagggtcccgctgtgttgcctaagctggtctggagcttctgggctcaagtgatctcaccttgacctcccaaagtgctggcagtataggcgtgagccactgtgcctgacttaagtcattttcatagatgaattaaataaccacctataaacattcgctgtgacatactatttctggtgactacacagaattatagatttgatactaataattcagccagtgaccctaatcttactagcttccataatcagtagtaccaactaagagtggtaataataatcaagagaaggagtcagtttcaaaaaatactcagaaaatgtctcagatgttatctgcagacagagtgctctgataatcctgcaaatttcagtcactgagacatttattgaacatccttgtgtacttagcaatgaactagggtcttgggattcacagaaaaataagacaaggtctccgtcctcaagaaggctaagaccacagggcaaataactaataaaacctaataaccaaattaagacctaaattatataataatacctaaattccaccgaccaatcgctgagggctggactcaatggctcacacctatactcccagcactttgggaggccaaggggagaggactgcttgagcccaggagatcagtctgggcaacacagtgagactctgtttctacaaacaattaaaaaattagccaggtatagtggcaggcacctgtgttcccagctattctggaggctgaggtgggaggatcgtttgagtctgggaagtcaaggctgcagtgagccatgatcatgccactgcaccccagcctgggcaacagagtgagaccctgtctcaaattaaataaataaatggtcttttaaaaagatcaatcaatgagaactaagtagagcaaggaaagaacacgtattaagtatgagtacctgttatacacaaaatacttccacatgttttatctcttttaattctgaggataatctgaagaggcagggttcaagattaagaaaacaaagttcagagctgttaagtagtttgccccaactcacataactcataaagaggataagacaagggaaagcaccaaagtgagagtaagtatgaccggttcacaaggcactgagaccagtcagactaaaacacaggatacactgggaaataaagctggccagagttgggccagattagaaaggaccactagttatgcttgatgaaataagaatctgtcagccgggcgcggtggatcacgcctgtaatcccagcactctgggaggccgaggcaggcatattacctaaggtcaggagttcaagaccagcctggccaacatggcaaaactccgtctgtactaaaaatacaaaaaaattagctaagcatggtagcggacaccggtaattccagctagcggggaggctgaagcaggagaatcgcttgaacccaggaggtggaggtggcagtgagccgagatcgcaccattgcactccagcctcggcaacaagagcgaaacttcgtctcaaataaaaaaaaaaaaaaaagagagagaaataagaatcagtcattaaaggcatatttaaggaagactactaatatggcaacacttcatagaacagattgcagtagggaggatctgcaaacagatataatcaactaagacacagctctagagaggagctgcccctggctgataccatcggtcctctagagaggagctgcaggaactgaccgatactatcaggtaggcaggtgttgctccaagctggccaggccctcacagggaggcactggtgtccttctgttgaacatacacaatttcacagaacatggacctcagacaaggccactctgtgaccgtgatggatcaaaacgaaaacaagaccactctgtaatcatgtctgaacgcaactctgttcaactaccgatgtgctccctggctggacggcaggaactaaagctagagcctgttctaggatggtggcagtaggaatagaagaaagaaagcaatataagtgacatttccaagtaagaataaaaaaaactgttagtaggcaattcaagagaaaaagttgagactcatacatcgcttgagtggatagcatccaactgaaatattataaatctaatctataatatttaaaatctatatttttatttaatctagttaaattagtccatgtttttcagactgaataaaagatgatgacagaaaaatatttagtaggtaattagagattaaaaaataatgatgcctgcgtcccacctccaaaggctctgattcgatcagtactgagtgtagcctaggcatcaggatttttccaagctccccaggtgattccagtgtgcagctaaagctaagaaccggtatctcagagaacgccgatggctcctgactaggaggaaaaaggacaaacgatggatagggtagaaagggacccaagaaagtactggggcaaaaaggtaagcgagaaacaaaaaatggctgaaagactagacagacgattcccagacacagcaagagtcatttaaatgatgaaagagtcactatttaacaaacgatagaaaccaggcaagaaggttaacacaggtttagatgactaggaaacatgaccaacaagtaaggccactactctgcattagcaaaatcttcagctaggagactttcaatctatgatcctctgaggatgcctggataacaactacatgtaccactacaaatagatgttaactgtgtacagcctgtttctaaatatagaggtggattcctccagcccttttccttcctagtgttcccacactgccacctcgtgggtcagcactgcaaggagccggtttgaactggaagggatttctaactggccctgtaaattcacaaggcaggtacatggtaaagcctcaattcaagggtttaatccttatgttttcctctgtttaattacagtggaagacagccttaaggtacattgtttcttttgtgggtgataagaattttctaaagttgattatggtgatattagtatgtacttaatgccaccgaagggtacacttaaataaataaaagggtaaagttaatgttactttatatcactttaaataggcaaatggtatggtatatgagttatatctcaataaagctgttacaaaaaaaggaggaggtggccaggcacattggtctgtagtcctagctactgggggggaggagaggggggctgaggtaggaggatcacttgaggccaggagtttgaggccagcctggacaacatagtgagaccttgtctctctgaaaaaataaataaataaaaagaaagaggagtaggaggaggcagctgtagcaaatacataaatggtttctaaaactgcagaaaacttaaaaaggatgtcagaaatcactcaataccttcatttcaaaaaggcaaaactgagactcagattaacttacttaccctacttacccaggcagtaaaaactaggccaaaaaggggcactattaacccatttatggaggtcttctatggtctcccaatcctgagaagctttttctcttaagcttgatcctcagcaatgctatcttttgctgcctaacttactactgggagatcacactcacaccaatgacttcacagagcagtagtatcaccactattccaatagttcaaaacccagcactcacccttcaccacagagcactactgtcaccactattccaatagttccagctcaaaacccagcactcacccttcaccacagagcagtactgtcaccactattccaatagttccagctcaaaacccagcactcacccttcaccacagagcagtactgtcaccactattccaatagttctagctcaaaacccagcactcacccttcactgcttccttgccctttaatcggtcaacaacgtgggtgaactcctcaacatgtttggttccaggccctctaccagtcccctagctcaggccttcatcacttcacatctagaataacgcacattttctcctaactggaatcctcatctccagtctttccacttctctccctcatcacaaaattcacccaaatcaggactcctacacaaatcttccatgtgcacctcatactgcagcccaaaaatctctatgggctcctcaagagttgtacctagaaaataaagttcaaaatctcttaacctcagcaaggccttctgtatcacagacgctatcccaacttataatctatcatctatacaaacagcacttcgctgcagtcataatggtctactaaacaatgtatgcacatttcccaattagttattcctccatagttgttatctctaccacttatttcactggtatcatgactttttttttattcctttcccaaaggttctcaactctggctatgcattagcattacctgtgaagctttaaacaattatgggacccttaaggatgttgctcagacatctggatatttttaaattccacaggtaaatgtgtaaaataccaatgattcatagattttaagtaagtctttttgtaagatgcttaagttttcaccactaaaactgagcatccaatattagagtcaaaaactcaaaaattaaactgcccagagaaactgttacctactacccaaggtttcttgatcattggtacaacataaatctttccaattaacatctactttctaacaagacgtaaacacagcagctaaaaaatgctaacaaggattaaatttttatatactcaaattcatttgtgagaaacatctatcataaccatgccaattaaaaattcaacataattcctgtttgtcctacctatgacaattatttaaatgtaaacagaacatgctaatgtcaatgtccagtttaaaactgaacatgcagaattatttatagatattataagcagttggactaatcccagctgtggcaattttaccttagcccttggatataaaggcacagagaagcagggagtcagtgaagatggaaaagaaagataggagctgtcaacccagactgctctataataatctggggagtattaaaaatgtctatgctctgccgggcgcggtggctcacgcctgtaatcccagcactttgggaggccaaggcgggtggatcacgaggtcaggagatcgagaccatcctggctaacacggtgaaaccccatctctactaaaaatacaaaaaattagccaggcgtggtggcgggcgcctgtagtcccagctactcgggaggctgaggcaggagaatggcatgaacccgggaggcggagcttgctgtgagccgagatcatgccactgcactccagcctgggtgacagagcaagactccgtctcaaaaaaaaaaaaaaaaaaaaaaaaggtctatgctccagccacactccagacaaattaaatgagaatctctgagggcaggacccatgcaccagcatttcttaaatctccccgagtgctttcaatgtgtagccaatgtcgagaaccaacgagttacaagggaatttctcaaaggaaatctaaagatgagagctgttcaaagacaaacacaaagagggaaaaagtcccaagaactagttagttacttcagaagtaagttgctttctcttatcagtttatgaacaatttttacatattacaaatatacactttttggccatgcgagtgactcacacctgtaatcccagcactttgggaggccaaggcagggggatcacttgagctcaggagatcaagaccagcctgagtaaatggcaaaaccccatctctaccaaaaataccaaataaaaaaaaaaaattagccaggggtggtggcacgcatctgtggtcccagctactcagagggcggaggtaggcggcttaggtggcagaattgcttgaacctgggaggcgaaggctgcagtgagctcagatcatgccactgtactccagcctgggtgacagtgagacttcacctcaaaaaataataataataataataatattcctttttatgttgaaatattttcgtcagtttcttgattttttgttgttgttgttgttattgttttgatatggagtctcactctgtcgccaggctggagtgcagtggcatgatctcaactccccgtaacctctgcctcccgggttcaagcgattctcctgcctcagcctcccaagtggttgggattacaggcgcacaccaccacgcccggctaattttgtatttttagtagagatgggatttcaccatgttggccaggatggtctctatctcttgacctcgtgatctgcccgtctcagcctcccaaggtgctgggattacaggcgtgagccaccacgcctggccagtttcttgatttttttcattataagatggttcattaacataaggatgtttttaacttttatatattcaaatctgcccagtctatcaatctatcttatccccttgtggttgctcttatttatttttgctgcaaatgctataagaacaacaaaaagaggacttgcttacattataattctcaacccaagtaatgaattttaaaaatcagtattggccagatgcggtagctcatgcctgtagtcccagcactttgggaggccgatgcaggtgaattgcttgagcccaggagttcaagaccaggctgggcaacatggtgaaaccccatctctacaaaaaatataaaaattagccgggcatggtggtgcatgcctgtggtcccagctactcaaggctgaggtaggaggatgacttcagccaggaggttgaggctgcagtgagccaggagcacaccactgcactccagcctgggtgacagagtgagactctgtctcaaacaaacaaacaaaaagatcaatattagcctactgttataaatgcttttaaatgtttaaaactaaacatgaataggccgtgtataaaacagtaaactggcaacaagtaaactttaaaaaggaaacattcttgattgtactatatttaaacaactagtaatggctctgtccattttcacttttcaaatagtagaatgagatataaaacacaaggttatcccacaagtggcctttattttttctatactaacaagtaattattatgtcaaaaactaggggaaaaactcatttacacagaatcttcttgtagtaataaactgtaaggagatcaacaagcacaattttccctccagatcataccaactccaagtaaaactactagtttcaaacataggtttcgactcttattgtgaaaaacatggtcatcatcaataagccactataccatgtaaatttcattagtgagttttatatagatatttatgacaaaatttaacttgtttgcccttttttggtctaattcaaaataagagttaatggcaaatgtcagaggctaagaacagtttggaaagggggttcatgaaggagaccactcagagacagtgttttagtggctaaaaaataagttgcctttctgaaaaatatttgtatgctttttactccattgtccaccagagggagcatcacatctgattaagagataatggggaactcccagatagaaatggaaaatcatctgaaacttgatctacgaggtgctacagatggtagcatatacagttaaatgtaaaatcaaatcagagaacccccaaaagaatctcaaagtgagtgggaggacagcctcctagggagatctcatctctaaaaaaaaattttcttttaattagctgggtatgatgttgcacgcctgtggtctcagctgctcagaaaattctggaggctgaggagggaggatcacttgagcccaggaattcaaggctgcagtgacctatgatcaaaccactgcattacagcctgggtaacacagggagaccccagtctctagaggaaaaaaaaaaagaaaaggaaaaaacaagaaaaatgagcaaaagataaatacagacaaatcacaaaaagatataaatatggcctttaaacacatgaaaagatgtttaacttcacccataatgcaatttaaatgcaaattaaaactatactaagatcccacttctcacccataagcttagcaaaaattcaaaagttcaggctgcaaagctaagggaaacaagtactcacatacatcattagtgggaatgcaaaatggtacaaccccacataggtatttacaccttgacccagaaatcccattttgaggaatctaccctgaagatacaccagcaacaatataaaaatacacacatgcaaggttattcattagagcaatatgcacaattgcaaaatactggaaattgcctaaatatccacacataggaaattagaaagtacagtggatacataaaattgagcattatggagctataacgaataaggaagatctccatgaactgatagtagagtgatttccagtagacacaaagataatgaagcaagtgcaaaactaagaatggaaaataagaacacacatataggccgggcacagtggctcacgcctgtaatcccagcactttgggaggccgaggcgggtggatcacgaggtcaggagatcgagaccatcctggctaatggtgaaaccctgtctctactaaaaatacaaaaaattagccaggcgtgatggcgggtgcctgtagtcccagctactcgggaggctgaggcaggagaatagtgtgaacctgggagacggagctggcagtgagccgagatcgcaccactgcactttagcctgggcaacagagcaagactccgtctcaaaaaaaaaaaaaaaaaagaacacacatatatacttgcttatcttaaaaagaaaaaatataagatgaaccagacgctacggtctgaatgcttataccccccaggctggagtccagtggcacgatcatggctcactgcagccttgacctcctaggctcaagtgatcctcccacctcagcctcccaagtaactgtgattacaagggtgcacaccatcccacccagataattttttgtttttttttttaacaagatgaagtttccctatgttgcccaaggtggttgtgagctcctggcctcaaatgatcctcccacctcgtcctaacaaagcactgggattacaggtgtaagccaccacttgattaagccagactttagagagacatgaaaaaaatgtaaagcaatgcaattctcattaaattttcgttgttttaaaaaatacacacgggcctatagtcccagctattcgggggactgaggcaggacaatcgcttgaacccaggaggcagaggttgcagtgagccgagattgtaccactgcactccagcctgggcaacaaagcgagactctatctcaaaaaaagaaaatatagtttgattccttaaaaaattgttacaacataataaatttacatatatgtaacaattttttaagtaaccaaaccatcaaatatacacacacacacacacacacacacatatatatatttttgttattgttgttttgttgttgttgggtattttttggaggcagggtctcactgtgtcacccaggctggagtgcagtggcgcagtctcagctcactgcagcctccacctcccaggtgcaagcgattctcctgcctcagcctccaaagtagcttgattacaggcatgcaccaccacatctggctaatttttgtatttttagtagagacggggtttcgctacgttggccaggctggtctcaaactcctgggctcatgtgatctgcccacctcggcctcccaaagtgctggaattacaggtgtgagccaccacgccctgccttaaatttatgtttaaataggtattttcaaaacttagttttaatttttatgcaataaatataaatagataaaacccacataaacaaaacatcatcagcactctcaataacgttttttaaatccctatcaaatccattttgataatttgtaaaaggataaaggggtcctgagactaaaaggtctgagaaccactggtctataacaccagctgccttaaatgccagagtatgttaagagcaggggctggggctggggactgtatcgcttctgttgcctgataatgctggattctgcactaccatcaccacagacactgggccctgctgctgctgctgctccttgggaaactggttgttgctggagagtgattctctcaaccattcttctttgtgatactggcttttattcaaagtcctcagagagcatcttagattgaccgaacttaggtcactgcccgcaccctagctgcaagggaggttgagaaggtatttagcctttttggctttttcgatagaaggcagacttggtctacatcccaccaatagtcttccaatgaggaaatcggcaaacataaacagtcaaaaccacaagcattagcccattgctctaattctttctgggaaggtcagaggcaaccttgtggggaatatcacagctctatcaaagattctcagtggatcttagagatggtggtattacacacagggaagacaaatccaagtacaggaaaaaaattgatattccaactgactcctccatgacaaaaagttctaccataataacccgacacaaggtggctggctggtcctgaagatgtgttgccatttggggaatcaggaccagttactactggcagcaaactgggcactctgtaccagcagaagccacatggctatcatgaggggaagtctgtattgttgagttccaggcaccagcctctatccccgtccccatggttgctctgttcttgagccttttgagcaagcaccaggctgtctgaagaacaacttactgctatccacaaagcaggtcatcctgtctgattaagaacgccctctgctgtggcattcacatggaccaaatgttttcaccagggctcagccataaagccctttcccaaacctcgttacagaagaaaaggaagcagtagaagaaacaggaattatgactcccacttaaaaagaaaaatgtagtcacatccataaagtcctttcccaaaccacattattatcaattcttccaccttatttcaaatcctagacccattagccactgcccaggaagttgcaaatcctacttcaagccatcgttcaaggttctgctctttgaaatgattttgctagttgcttgaccttcagggcctccaaggaagagtctgtaacactgcagcaattcacttacgcctggtgctaaccatattttacaaaatcagccgtaaacccagtaacgtctttttacattattttcacagaggtaagtgcttccttgtctccactagcctcttctactctactgacccttaaaccttgggttattttagccaatgtgagaattctgcctttgctgaaactattcatgccaatgtctaacattcttagtaacttcattatttagataattcaactaacctcagcctttgggtttcctgaccaaaaatcttttcttactccctaccttggccacattctgccacaccccgtacctgttgtatcaagacacacactacttctaagcatgtacatatcaagtcaacccattatctgaccactcaccatttctctgaccacatgaggacctctaatccattgattcggccacatttcactggccatcaccttccttacgacctcattccctacctgagaaaccatgatccacaattacaccctcccttgcctacaacttcaacttcccgtcccctctctccgtccatcatgctaacctagcaatcctaggtaaatccagttctcatagccaagcagctggcaattgggagagaaaggaaacatgacccaactaactgttcccactttaaataaacaaacacaagttttaagtagaccctcagcacttttcaacaatcctacatttcacgaggcaatttatgcttctctcctagaagactatttccaatctctcctaaggctgagtcacttagcaaccacttccctagcggtccttaaacttttcaatcaccactgctgttgccttttctggcacctcttcttcttaccctcatatatgaagatgttcccttccatctccaccccaggttcagtccttggccaagagacattccatcatctcaccaaacacagtgagttattaccctttattgcctggtcacatttactcacactgcaactcaaatgcagctgcctttttttttttctttttttttgagacagggtctcactctgtcacccaggctggagtgcagtggcgtgatcaccactcactgcaacctccacctcctgggctcaattgattctcccacctcagccttctgagtagctgggactacaggcatgcacccaggtaattatttgtatttttagtagagacagggttttgccatgtcgcacaggctcatcttgaacttatgggctcaagcgatccacctgcctcgacctcccaaagtgctgggactacaggcatgagccaccatgcccagcctgctttatcttctataactcatctaatctgtctcctgaatatgcgccattttttctataattaatctaatattcctcatgaatatctactctaataaatatccaggaaatttaaaacttgtcaaacaatatctcaatctcttccagttaatactcagactttgtttaactccttacccgggctggtttaaatggctgctttcgggtagatttccctccaaggtcttatcggacatcctagaagaaatagtggcaagaagaccttggatctgtgttgtttctctggatcctcactggtctctgctgcaaggaggtaatcaggtcctatggctgaactggtcccatctcatcttttaggatgtcatgctggctctcatccctggagtctgtgatcctgacattcagtctatagtcacacagtcttttgtcatgacgccagctgttccaccaggccaataagctcctccacctccttcacagtggtatgagagcatttcagaatcccctggtaccacaaactcaactatctagccacttccttctaccactgctgtgctataggcccgtgttggcctatcactaacctgcataacatctcctctcaagattccacataaggagcagagcaaaaggccttctactgctgaccgtcccctcaacccatttaacatccccaccctaaccctagaactttagccagccaagaaagatcagaacacatatttctcacaatctgttttccctacctctgtccccccgctgcccacaatccaccaggactgaaagggatgacacgtctacttccaagtcatcctccttcctcctgggaggcactaagcctcattctcagccttaatgccagatgagctattctctttaccctacagaagaaactatcattagagtttgccagaagtaactcttgatatggaagctgcaggcaacttggaacttgagaaaaccaaagacaaacatacagcgacttcaagttccccaaaatattaatccttgaatgattaacatctcccatgtggtaggccctggggatataaaaaagattagacttagagcactacactagggagtgagaaggtttacaaatacaatcataacaatggaattttatgtgctgcactcaccaaagcaaacgggaaatacacataactcatacccaattgtcaaccaacctgttctacctccatcaaattaaaaatgcatgcaacggcagaaggacaatataagtgatttcaggccggggacagcggctcacgcctgtaatcccagcacttaaggaggctgaggcgggtagatcacctgaggtcaggagtttgagaccagcctgactaacatggtgaaaccccatctctactaaaaatacaaaaattagccaggcgtggtctgtaatccaagctattaaggaggctgaggcaggagaatcgcttgcacctgggaggcggaggttgtggtgagccaagatcacaccattgcactccagcctgggcaacaagagcaaaactccatcttaaaaaaaaaaaaaaaaaaaaaaaagtgatttcaggttataatttcattgccatttactctttctacaacttacatacttcattttcttttccaggcacaacacggaaaaaccagaagccattccttaatgagaggaaaaaggtaagataagccatgaagcaggttcacctttctccattaacaaaaacaagtatacagaactaaagctactaatcaaaacagctctagagcaaaggaaatcatgtaaaacttggtaaccattgtttctggagcctaaggaagtagagatgtgcatcccttaaggacatcatgaggtgatttcattgttgtaggaacatcatggtgtatcctcacacaaacccagactgtacatacagcctgctacacacctaggctagcaggtattgtctgtactgcctactgctctgaggctataaacctgcaccgcgtgttactgtactgaatactgtaggtaactgtaaaacaatggtaagtatttgtgtatctaaatgtacctaaacacagaaaaagtacagttaaaaaatgatataatcatacagggccactgtcatgtatctggtctttcgctgaccaaaatgtcgttatgcagtgcatgactgtaattatcatcaatatctgtttttttaattctattttgatttttcctttcccatgtaactgttaattgctacaaactaacattttcattccatacttaattcagatggaaggcagcagaaggacaggggcagttaggaggaaaattctgccagacattcatactaaaactaagggcttactatgtgttagacactggggctacaaaaactgaaagatgcactattcttaaagacttcacaatggacagtgaataaagagaaacaaattttacttacaagatgacaagtaatacagaaacttatccctcaaggacaggcattcaacagtggcagaaaactgcatcaaacaatgcgctaacatttccctaacactattttcaggttgcagtgattcccaaccaggctctttggaacactataaccactaaaatgggagtgttcaaacagagcaactactaccacaacacaagtgaactgtgtatcctggcaatccaaagtaagtgcaaatattttgtgtctgtgtaaaatactagtaagtatttgtcagtcattatgaagaatctgtttagcttgttttgtttagatgcttagcatttacttatatccctttttctatgtttatgtttgctgatttccccactggataactatcggtgggaagtagagtgagcctgccttctatcttaaaagccaaaaaggctaaataccgtctcaacctccctcgcgctaggggtgcaggcagtgacctaagtttagccaatccaagacactcactgaggactttgaataaaagccagtatcacaaagaagaatggttgagagaatcactctccagcaacagtgagtttcccaaggagcagcagcagcagcagcaccagggtccagtgtctatggtgttcgtggtacctactgcagaatccaatattatcaggcgacagaagtgatatacaccccagatcccagccccagctacttttgcagtgcaatcctaacttggttcagccgatgcccagtcaagtcttggcagactttaaagcaacactgagaactcccccaaaactctttcattaaattccttttttgcttaaatccccagttactgcaaacaggaaaaatgaatgagactaatgaaatagtatggtaaatcaacaagcatcccacccacaaagggtttgtgtagcttattttggaaatgcacaattccgtgtgtcacaagactcaacttcagctctaatgattcaattgccaatttgtcaccatttattcattccaaaacttttctgttccaagaactatcttgaaaggaacgaattgttttcaaccacacagtttacaaaaacttcaagatgctgctctctcccgaacagatgttttcgctgttatcattacttcagaaagcaacagacaaaattattatttggtagctctaaaatgcaaagtcatattcctgaattatgaatcaaatgagaacaaagtaagaacaatggtcaaattacagatacgagttttgcacttaccgtcccacctccacccacctaaatctcagactggcaggtctgaaaagcggccatgcacaaaatcatcgcactcatctcaaaatagaactcttcttcctcgcacacagaagctcaataatatttgttgactgaatgcagttcctattattcatgtatgttacacatttccataaattgctttcacatagcactttacaccggcacagcgcgtccaggcttccaaaacaccttcacgtgaatccctgcatctagaatggtggttaagagttagacatgcctgcacagccattaaatggcacagcacacgggggacccgtgtctgatgctcccacagcacattaattgcccctctatttcagcccttctggtacactgtaattctctctctcacttgatcagctctttgaggaggtcccgttcctcttcgtatccccaggccacacacaacccagaccacagaggtgcaccgtagacatcaagattcttccacctgctgcaagcctgatgctttaccggcggggcctctgcaggggagcctgatttatactcatcccagctcccacccagccccacgcccgccacgtgtgatttccacagccgcaccaaggaagactgtccagcacacagacttttcgtctcccagcaaaattatccccggcacaacgcttccccctcaagtctgcccaatggctttcccatttccaccgcagcccaggttggggggcagtggctgagcctgggccccctcccagccccgctgcggcaacctaggggggtgtccgggcggggcctgtcagcagcgacccgcccccgggcacacgcgcgtcaggggcagcaccgccaagctgcctgtgcagccccatccagcaggagtcccgcggctgccggccgcccgacgcccccccctccccagcaccccacacagctcgcgactcaggtaggcgagggcgctccttacgcacccgagaaggcagcggtcgcagacgacgccacgactccccttgcacaccgtgtacgccaagggatccgagcggaagagtagctctccggggcgcagcggggtcacggcgcgcagcccgtttcccctcttggcggttgcgaacttttccaccttcagcggctccatcctcccgcagctccggcacctcagacggctacccgcgtccagcagcgggcgtctcacgggctgccgggacccgcgcgcctgcgccctgcgcgcacacgtacgcccgaggggcggggcgggcgcggtggggcaagagcatgcgcagatggagtctggagggacggctggagtggagtgtgtgggacctgaaggtggtcgtaaggctccgcgtgcggctcgtgcccatggcgactgcgcagaagacaggcggggttttttttctccctctaacattgtattacgatcattttaacgcatacggaacagttgaaaacagtgcagtgaacacctatatacctccgcctaaatcagacaacctagcactttgccatttctgctcgtcactctctccccacctgtagctatgtatacacgtattgtcgttaaactatttcaaagttgcaggcatcatgacatcacaactagtactttgcactgtaacttttttttgttttaggacggagtcttgctctgtcgcccaggctggagtgcagtggcgagatctcggctcactgcaacctctgacctccgggttcaagcgattctcctgcctcagcctccatagtagctgggactacaggcatgtgcaatcctcccgcctgggcctcctgactagatgggactataggctcacgccaccatgcctggctaatgctttttactttcctccagagacagtctacctatgtcgcccaggctagtcgcaaactcctggcctcaagtgaacctgaacctcctgcctcgacctctcgaattgctggaattacaggtgtgagccaccacacccagcttaattttcttttttgtttttggggtttgttttgttttgttttgttttttgagacggagtctcattctcgcccaggctggaatgcagtggtacgatattggctcactgcaacctctgcctcccgggttcaagcgattctcctgcctcagcctcttgagtagctgggactacaggcgcctgccaccacgcccggctaatttttgtatttttagtagagacgaggtttcaccgtgttagccaggatggtctcgatctaaccttgtgatccgcccgcctcggcctctcaaagtgctgggattacaggcgtgagccaccgcgcccagcccacccggcctaaatttcttagtttggacaaacgtgccatggtaatgcaaaatgtcattattaagggcagctggatggaaggtgtaggagtacactatagtgcctttcaatttttctgtgtatctaaagtcatttcaaaagtaaacatttattttaaaacatgaaggtggttatgcttccatgagtgtaaagtacaaaaggcaggctcgtggtgctgtcagaagtcagaacactggtttcagggctgggggtgttgggaggggctgggcatggttggctttgtgatctgggggctggtgtgttccatctgtgaatatcttttaagctgtgcacttaccagggatgtaagtcatatcttaataaattttcataagtttgacaaaaaataaaatgaggatgggaagcttgtttgggttgtggggcctcgggtgcttatccagccatgagctgtgtcccagatgcttctagaagcctggagggagctgagaacattccaagtcgaggtggcagagccaaggccctgaggtgggagcgcaatgctgcacatccccagctgtgaatggggtgtcctggtcagaagcagtgctgtgtgcactgcagggccggcaaatccacgtccacattgtggcttggtgcagtgaaagccaatctcagccccctccacagtgtgattagcctgccagcaggtggccagctggtcctcctgggaaatggtgccaacccagagactgggtgcaagtgtctcatccacggaggggcgctcagcagtggtgtcagcctggtgagcctcggtaagggcacgtgcaggatgctgagcctcttccgttcccatgcccgtctcaaggccacttgctccgtgggcccatccagcaagcatggtggccaggaaagaagccggctccattcacagggcgtgctgttttgctcacctcaggaccaagagcatcctccatagtgattctctttggtgggagcactagaaacatgaaccacagataccttcagcgtctgagccgctgaggcgagggctgcaggacaccctgctgtcgggaaaccctgcactggcggctggaaggcatgtggtggtggcgcctgctgtggctgcagcagttgctgcgaggcttcgggatctcgccggcccctgcgaggtgaattgtgacagtgcagagctccgtggtaccagggccccctgcatggccatgctgactgcagctgggagcccaccacacctctggttccccgctcttcccagggctggggtctaggccaggcccctcttggcctgcgaattgtgccctgggagggggacactgttccacaggttgggaccaaggacccagggcatgctactggctggctgggctgcagggatgccatgctcacctttctctctcatggccttgacgggaccggcttcctcattgaacagcattttccaaggtgtctgggattgctggtggggtgccaccctggctccttctaggcatgcccgtcattggccaccaagggggccagatgcaggtgcccatgctgctgtgggggcatctcccaacttccctcttagtcctgatgggcctaggcagggcctgatatgggggtccccatgggcttccggggctaagcctgccccatggtcccagggctgtccaggacacattcagaagggacatgagctcagcagctctgtttgaaattattatggaaccaagggccccccacatccaagtccactgggagtcgggacatggagttccgctgcaggtacctccaggaaccccgaggtcctccttgagccaaggccaggctgggcacaccataagtcctgggtcccccagagaatggcctgctgccctgggctccccagaagccccctcacgcccctgggccttggccacatggaagccccaccaggacaggtgtgagaggacaaggaacccatggtggggaagcagaccaaatgggccgctggaaccaggctggtgggccagggggcacctgcccatcccccttgcagagggccttcctgccacgtgaagccagcacagccctggctgctgaggacccttgcctgggtttggctgaaagaaaaacagacgtgatcaggcagcacctccagtgggcccaaagagtcctttctgggccgggccccacctgcctgggtctccggagtcctcagggtctctcggtggcccctggggtctgacactgaggacacacctgcaggctgctgatcccagagggaggggtgtgtgtcacctggggtagggaagctgtcggggcacagcaggtggctcctgggactgccccccaggattcaggctggctgggggcttcctgccccatgccctcatcccagggctgttgggcctggtatatgatccccagtcagaactcaggtgggaggggccttggctgtcacccagcccccttgctacctcacttggggacctgtctctaccatgagtaagagggcccagatacggggccccctctgccctcctgggctgcccggtccatgccaggactgaccattcccacacctggctgaactcttggctctggctctgggccaggggtcccacctgtgcccttgccctgaaagctctgggggtcagggacaccgactcccttgtctccctggctcaaggctcgttgtcctggcacccttggagggatgttcaggagtgaggggcctctgctgctctctgaggctgtcagtgcttgcagggaggggtggggggggtcccacaaatgggtctggctcctccagtgccgtcaagggccctgttgggggggggcgggacaccgtggaaagtgggagggggcttgttggagaggtcttgcccacatccccctcctgcgtgcacagcatgtgcagtgcacatgcactgagcacctgccctgaggaccgggggcctattgtctttcttagagtccaggaggaaaaggaggaagaaaaggcacaagaggaaggcccaggtagtaggcttgggggtcccgggcgctcccccactattgactgccccagagggtgactcaggagggggcctggtatggaagcccatctgggggtggcaggtccccattcttccttgttagcttcctcgtagaggcccaagggtgcccgagagctgcgtcttcatccagggcctaggtatgggagaaccagcccccaaaactgcccatgggccagacctggatgtcttcatgaggccctctagggatagggtgggcatcaggccaggagagttccctgggagggtcagagcccatacctcattgccacctcaaccgtctcccactgggaggtgccagatccttttgtggccaccccaggggtccagatgtgcataggaggctgtggctgggggtggcctgggcagggaagtgctcaccacactccagactttcatctggaacatgtcgggggtgggcttggtgtcactgtgccctgcccagcccacccagccagacctccccctgggccagagcagaggatcatggggacagtgtgaggaagctgccctcaggccagtccgagtctgaccccagtgctccccagtgccattgggcacacgtggacttactccattaaaccttaaaggcagtgcatgccatcggcatcaacacctgttccccttctaccaaatacacatcccacaggtgcaggttgagcctgagagagatctatggggacagcagacactggaggacctggcccttcaaggctgggggctggtggctcgagctgggcccactgggacttcagtccccagagtcagtgaccctccccatgagggtcatctgacccttccaggaggctgggtcagacagggtcttgcagctcctcatgaggggcactcatttcagtgggatatggcttctggagagagggacctccccagggcttgaggcttctgagctctcccaagttgggttctgccccagtcttcccatgaggctgggcctgagccccaacctctgccgtgggatgacccttcttgggcacggggccttgcttgtgtgtcctacagggccccgtctgtgcctcctgtgggctgggggtgagccggacccctgggcacggggagcagggcactgcagggcaaagagggtccctgagccagggtctccctgggcctccttgccccatccatcaagctctggagcagccagcctaatgaggaaccctgcgcacatggcccttccttgtcgtgatgggaggaacagaagtgctcagggccccctgggctactctaaaaaccaaacctccctcttccagggtcctctgaagacccttccccaagtgcagaacacaggatggtgtccagggctccacacgacaccttccccttcccgcactcccagcggacacactgcccttagccttgctctgcaggaggtgggccccagtgcctgtgcctctgtctcctccagggcgggaaaggaaacccaactccaaacgcatggagaaccccacatcccaggtcaggccctggctgggactcagcctctcatcagtcccatgggggtctctagccagccctacgggatgcagggcctctgggaaagagccgaggggaccataaacacacagggtgcctcgtggtcttgggttatgacgtgggtaccacgtgttcctggtggtcttgtagcccctggacccttgtgctatttgggctgtagaatcctgagacgcccccagcccatcatgaaaccagagccagctcccaagatgtggagctgtcagctggaagaactgggcagctgcagaggcccccgaaccccgaggcctcccaccctcccatctgtgaccccaccatgtggccttggccctggggagaaggggtgggaacatcccctggagcctggctggaggtgctccgggaggcctcctgggccagggtgccgggagggcaggcctgactttgaggccacaacagagagtagaaagaacaaggtgggtgctgggacccctggttgtctcttggaagtggggtcaggccaggggacatgggatggggaggtgctgccatctgggctttgtcagcccacctgtgggaaccaagggcagctgaagcccagccagctggaggccaggaggactctcagggaggggagagtcagctgcatagaattcgagctggagagcgtggctccaggacatagagggcggccacggcgaggatgagatgccctctgctgatggggatgaaaggcatctgactcagggtctgggggtccccattcatccatggtctcctgtgggaccttcagcagagacatcctaaaggctcccaacaagctggtgacacaaggaaggtacctttgctgaaagtcgagatcatctggctagggtggctgtccccgggtctggctgcatgaggtcggggggcagctgttcacctaccctgtggggagtgcctctcacaagccaacagctgggccagtgcccagaatgcatcctccccaggcccataaaggagaaacaaggcagcagcgtggctcaggtccctgcggtagcccacctcctgcaagatccagagtcaccatggaaggacatctcctggagggctgaggtcacctgggaggactcatgtcatcggagagggcagaggtgactggggaggcttcctctgaagaagaggcttcctcaggatgcaaatttattttctgacaagagccatgtccatcaggcacttcagcaacttgtccaaaatgtttcctgagagcactgtcctgcatgtgacactaccaagctcctgggctttggggcagccccaggaggagggtgtcatttcttgttatgaaaagtggtggtcaggcccaggtgacactagtagttggggccctgacttctttgtctcagtttgaccccttgagaccacctcccttgcttggagatttatgccaacggtgagctggagtcctatctactatatcctgatgggtcacaaatactgactttgaaagaaacaacgatgcccctaccagacacccacgcccacgaacgtgggaatatggcccagaaacgtcactgcctgggaatactcatggggttatatgccaaatataccaggaagatgtagaataattcctgctgcctaggaaagagataaaaggggctttcgtttgttttgtgcagacgcttttagtttcactttgcctacaaaccctaacaacaaatccagtttcaggttcagatgattcaccagataagtcacaagctcttcaggaccttggttgtttaagaaatgtttcaggccaggcgcggtggctcacacctgtaatcccagcactttgggaggccaaggcaggtggatcacgaggtcaggagatcgagaccatggtgaaaccccgtctctactaaaaatacaaaaaattagccaggtgcagtggtgggcgcctgtagtcccagctacacaggaggctgaggcaggagaatggtgtgaacctgggaggtggagcttatagtgagccaagatcgtgccactgcactccagcctgggtgacagaggaagactccatctcaaaacaaaacaaaaaaaaaaagtttcagtaaaatccacatctgtgaaatgcagatatcccagttgtatagtgagttgactgatcacactctgatttttattttttcagtttgcacacccaccagttcagtctttggggtgtacagtacctccatggttctaaaccaatgtgcagagtctcctggtcaccactccagcccctcctggagcgattccttcatcctccaagtctccagggtgtcccctatgtagccaacctcttcccggtccatcagcccttggccatcccaacgtgttttctgtccctgtgatttggccttttccagaatggcctattaattggaaccctacagaggtagcttgttgggtctggtttctttcccttagcaaaatgcaactaagatccactgacgttcatgtgggcatcactggctcattcacttttctcactgagtcttttttcctttgaagggagggccacccatcctctccccattcccatgttgaaggttgtccccatggcctctgtgtgtgagtgacgatgaatcaagcagtgaatgtggcatgcatgtttcatgtgtgttaagtaaaatgtttatttagaaacagaatgcttgatccttagtaccacaaagaaacatcagcatttagacaaaaagttttctcagcaaggcaattttaccttctgcagaaagggtgctcctcacagatggaacaatggtgagagcacacctgaataaaagagggaagcaatttttatcctttatgcagcttgtccctgctactgtgtcctgtctccattggctggagctgggccatacaatctaaactaaatctgactggctaataatttaaaatgtctctaaatagctgaaagcaatggagaacaaaggaaaagaggaagctgcttatgaaaagacttagaaaagtaataacattcccaaataaggaaggggcacaggcttcaagctgggacctgcctgtgagcacgtccagcacagataaccctgattgaagtacgaggacatagaatgtacttattcctttatatctaacagctgtgtagaatagggcttaacaaagagttattagcacaaagcaaggaggcttgaaggaaattagtctttaaaggaaactgttatttctaacacttatgatttattctttaacaagaagggaaactttgaaaaggaactttttactttctacagtgtggatgtcagttttcaaatcagttggttcaatgtctgtgacacttcggggatgtgtggtttgagtccactgagctttgcgagcgactgcccaactggcttccaaagtggctgtgtcatgtcacatttccaccagctgtggatgagagtctccggggccccgaatgcccccgcccccagcattgggtgctgtcggtgtcgccagaggagtctccggggccccaggtcccccccccccccagcattgggtgctgtcggtgttgccagaggaggttcaccagccctccatcctgctgccccccacccatgggtccataccatgggtcccatgggtcagggagagcacttttcaccattgtgcatgattttgtttgctgccttctgtctcctcaggatccttctgggttctggccccacatgttctagcctggcccagagcttggaacctgggaggtcctcagtgcatggtacgggctcctccctgggccaggagagcccttggcagctccgtcatccctcctgggtgaagctggtttttgctctggggaagtctccatccctctggttcacttcatctctgctgggaccctgtggcccccataggcttacctgatgccatatcatttcctaaatattatgtgattcctcagtgtccggctcacctccaggtcaatctggtggataggttcagaggacctcttgcccttttctttcatgacctgtagggcatggccaggaggaggaagcagcctcagaacagatggaaggacccctgccccagatggcagtcagcccacagtcagcactcgtggaaggagggaaaaaaggaaggtttccttctgcagaaagctgctttttggcttgtttctgaagccagggagggtcaccagagctgagctcatttggggtgcctatgtcaccgtctgcccaggatatgcttctgaccaccccagccccaccgataagctgggctcgatgttccctccatctggagacctgggctcctgacacagcctggcctgtttgttgtgctctggctgagtatacctcatatttcccagggttctcaggcttggtttcctcaatgtttagcaggactgaccacacccagccccagaccttcaggagaatgcctttgtacactctggcagacaactgatctggtgacacaggccacagggtgacctcagcaaggaccagaccccaaggattctggaagtctctggttttggccccatgattcctcaatacaggtgaggtcaagctgggacagggtctctcctcccagggctgaaagagtgggtcagcactcagagtctgaactctgatctacacctgttccttcaccaggaggcttccctagccctgatctacggtggccccagccctggcatcagattccctcccagcaaggtgacgagcgcacgaatgggcagcaaagctggcgaccaggcctgctgtcgtctgagtaaggacagggtgctacccgctctctaagaggcagatggtgccagcccacagccaagggtgcctgtccccctgactctgcagacagtggttctgcaggcctctccctccccacattaccttcttgctcatcctatatttctgccattctcccagcatcttcagccacttttccatgtgtctcatgtcctgtcacatttgctgtcaaatgaggaatgttggagttagtggagccgccatgcttcccggagtggcccacggatgctgggtcctgggttctggagctctagtgggacccagctggaaggagctagggaagggcagaccctgggggctgagaccctctgagcaaatgagcgccagtgggctggccttgtgaccctgggacgtgccatcctcaggccacagacacaccagtcttaggtcgggtcacagcctctaggtggtatcctgacacaagcgggcagccacccccaagccacgactgttgttctcactttgaaatttcggcaaactgccagagaaacagagacttggggtcaggtccagcagggacagctgcccctcccagtgacagtatgttgctccctcccacccaccaccacccaggcccgctgcctcctctgcctcaccgaacacccactgagtccccatccctggaccagctccccaagcatcagggacaggctcttaccttcacctccagggcattgacagggggcaactctgtctcactggaaggcacctgacagagctgaggacctgcgcagggcctggagccatcccggtccaggagtccacccccagaaaggactggctctgtccccttccatcccaggtctcagctcgggagaagccacagggaagggaggacaagggccctgtggggcagactcccaggaggggcccctggtgtgggggatggtcaggctgcacaatggggctgcccctcctggactggaggtggtgttttctgctggagctcagaaacgtcagctctgagatgggactgctgctgcccagggtgggtggccacgcccggacgggagtctctcagggagtgaccgcatcaccctgctggggtttgggtgcctggcctgagacctgcctggtgcacccggggcccatcccacctgacactcccaaggtcctcgcagagtctgaccacctggagcccacctgcctctccctgcacctgagccacacaccctgctttttccctgatttccgccatcctgtccaacccaaaaactgtgaacgtctctccagccaccctgggtctgctttgactctggtcctgtcagaacccctgagtgagactccccggatctgttctcatgcctgccttgcctgctcgagagatgccaggggtggcctgggtgaccgagggccccacaggcttccaggacagcctcctggccccacctcctgcctcacctggctttcggagccattggctgtcagccctcagcctcctcccagacactgcagcagatggaactcgggacacctggccgttctccccaactatcctgcctgccccaggtcagtcccccgatcaccctctgcccactgtgctgtccaagccaactggaagcagagtccctggaaagccacgtagaatcttggggatggactgactccctctgctgagaagtcccaggtgagctggtgttttcagccccaccccatctattgtcctccccagacaatcagctccattggggtgcatttccgacgtggcacagcccatgggcttattcccatcccacctcccccagggtcctctgtctttccatcctgtgacccctgagggattggctccaggctgggctctcttatctggccccagataccgtcccagtaccagacccagggcctttagccacaagctctgctgcccgcctggccagaatgcctagaatgggggaccctgcccatcttctcccccattcccctaggcccacagccctcactgtccccatggggaagggcatggtccttgggggaaccatggcatggtccatgcggaagggcatggggacagtgagggctttggccctaggggaatggggagaagaagggcaggtgggcccctcagagacctgctggacagctgccccaaggctggaccaggtgccccctcaccctgtggccacaacccttggatctcactaggatagtgtccaagtggacagggccagaccctcaagctgcctgcctcctcttctgctaacttggagacagaactgctgagagcccaggggcctgacctagtcccctctccattcccacctgctccctagatgagcaacactccctagatgaaccacactccctagatgggccacgctccctagatgggccacgctccctagattaaccacattccctagatgagccacactccctagatgaaccacattccctagatgggccacgctccctagatgaaccacactccctagatgggccacgctccttagatgaaccacactccctagatgagccacgctccctagatgaaccacattccctagatgggccacgctccctagatgggccatgctccctagatgaaccacgttccctagatgggccacgctccctagatgaaccatgctccctagatgagccacgctccctagatgggccatgctccctagattaaccacattccctagatgagccacactccctagatgaaccacgctccctagatgggccacgctccctagatgaaacacgctccctagatgggccacgctccctagatgggccacgctccctagatgaaccacgctccctagatgagccacgctccctagatgggccatgctccctagatgggccacgctccctagatgggccatgctccctagatgggccatgctccctagatgaaccacgcgccctagatgagccaccctccctagatgggccacgctccctagatgaaccacattccctagatgggccacgctccctagatgaaccacactccctagatgggccacgctccctagatgaaccacgctccctagatgggccacgctccctagatgggccacgctccctagatgaaccacgctccctagatgggccacgctccctagatgaaccacattccctagatgggccacactccctagatgaaccacactccctagatgggccacgctccctagatgggccacgctccctagctgaaccatgctcccttgatgggccacgctccctagctgaaccacgctccctagatgggccacgctccctagatgaaccacgctccctagatgggccacgctccctagatgaaccacgctccctagatgggccacgctccctagatgaaccacgctccctagatgggccacgctccctagatgaaccacattccctagatgggccacgctccctagatgaaccacgctccctagatgaaccacgctccctagatgagccacactccctagatgggccacactccctagattaaccacattccctagatgggccatgctccctagatgaaccatgctccctagatgggccacgctccctagatgaaccacgctccctagatgggccacgctccctagatgggccacgctccctagatgaaccactctccctagatgagccacgctccctagatgggccacactccccagatgggccacactccttagatgaaccacactgcctagatgagccacgctccctagatgagccacgctccctagatgaaccacgctccctagatgggccacgctccctagatgggccacgctccctagatgaaccactctccctagatgagccacgctccctagatgggccacgctccctagatgaaccactctccctagatgagccacgctccctagatgaaccacactgcctagatgagccacgctccctagatgagccacgctccctagatgaaccacgctccctagatgggccacgctccctagatgggccacgctccctagatgaaccactctccctagatgagccacgctccctagatgggccacgctccctagatgaaccacactgcctagatgagccacgctccctagatgagccacactccctagatgaaccacgctccctagatgagccacgctacctagatgaaccacattccctagatgggccacgctccctagatgggccatgctccctagatgaaccacgctccctagatgggccacgctccctagatgaaccacgctccctagatgggccacgctccctagatgggccatgctccctagatgaaccacgctccctagatgagccacactccctagatgggccacgctccctagattaaccacattccctagatgggccacgctccctagatgaaccatgctccctagatgggccacgctccctagatgggccacgctccctagatgaaccacgctccctagatgggccacgctccctagatgaaccacgctccctagatcaaccacgctccctagatgagccacgcacctctggcctaacaacaatcacaggctggacctgcaggggagcccgggaggagttctaccctagaaaagaggtaggcccaagccaaggagacacatcctgcctcagaaagacctttctaaaagcgaaacccatccctgagctgagatttgtgctttagagggtgagaggagcacagagaactcactgcagaatcccaaggcaatcagagatcttgtagatgttaacatgcccaggctatatgtccgctggcagcccagttccacatccctgaaacccagagggagccagggtgaggcatccaaggtaaaaggtgcaagggcctgggggtgttgtcaacttgtcaccacctgtgctcctggggagcccaggaccctttgagcagggcgcactgggagaggcctccgtccagggagcagactgactgtacctgctcatacttggtaatgatgtcccctcattcctgtgccagcagggtatccacattctctcccatgtccatcccatgagacaaatcgtccaaaggtgacactgtacccgagagcttcggagaacacctgagccactcctgccgggctcccagatgctggcggtgtgtgacccccattccatcaccacctccaggtgaaaaggggccagacacagtggcccacacctgcacgggtctctggagtctcaggccccaagcaggagtgcctccttcctaaggacttgagaatagtgggacctggacagagaatcccgttgtccccaaatgccatgaaatgggaacatatctatcccaacagaatgaaaggtgtccacctgccgggggtgaagagcctgtgattccagagatgaggaggcagactggggtcagggaccagaggtctctgtatgatcagcctcttgggatcgctcagaaaccacaaagttgcccagttttctatggacaacaagatatctcctgacttcccaattctactccactcatcacttgggctaccatggcccttcagtctgaccagtgaagccgctttaggaatcatgccagttgagcaggaaggtgtttgctttgggggaagaaaatgatctattgtctccaaagcagcctctgtgctggtggaaaccatgacgctgggggagggacggtggactccacaattctgagctatccatacagggtgtggggggcttcattttcccgggtcactgagaaagaacaggagaactctgggttcttggtcctggagaacaccgagatgaacgattcctcctgggaccactcggggcaaaagggaggcgaggcctctggaggaccaaactgagaaagaaatacttgaagagaatgccagtgcctgtacccctttgaacaggagggaagatagtctccatccaggcagccctccagggctccttcattttccacaactgcccaaaggcagaaggctccccatccactcccagacagggaactgtgtgtgtccagtgggtcccacagagaccatcaggacccagcttagggcacagaggtattctgaggcccctcccctccaccccacccacagtggatccatcccagcagctctgccagggccaagctctgccccattgggatctggaaccctggacacatttgggatttagggcagggaggtcacagggttcaggacttaagtccagcacggcacagggcaggggtgagagcacaacccagggtcacatctggattcttggggttacccagttaccgcctctctgaccccagatgtctcacctgtctaatgggcacatttgggagcagcacccaccctatggagccaccatgaggacgaaggaaacatatcattaaaagatcagaaatacaaaaagagataccattaagagttcctacagatactgaaacggtcattaggtaatagtattaacatttttattctgatattcaacagcagcagtcacttccctccacccatatgtgtatcgtctgcctgggcagcacagaacaggcacctggtgagtgcccagggatgaccctcctcggcagctgcccagaggccagcactacccaccccatagccactgtccccaagtcagcatgaagggaagggagaatgtcacactcacctgattctgatgaattggctgggctgagttatgcctctcatgtagcaaactctcatgaacacagaactgctcacagatagcactgtgcgtgtgcaactgctctggaacacagaggcaggctggagggcgagcgggtgctcagcaccagtgacattctgaggtcatggcacacatcacagtggggccttgcctgggtcatcagagcccagagtcagcgtcctccactgcctgaggcgtcaacatgcctgcatgcaatgtgtgcacttgtgtgcacatgtgtatgtgggtaaacacatctgtgcacctgtgtgttgcttctctggccaggcctggctgccccactcatgtctgcacccagttcctcatcactgttacccccgaggcccaggaccagcatcagagcatccatgggtgctccctaacttcagccctccccaaccagggtggtcctgggatacacataggggtggagggaagttactgttgctgttgaatatcagaataaaaatgttaatactattacctaataacctttcagtatctgtaggaactcttaatggtatccctttttgtatttctgatattttaatgatatgtttctctccatgacccttggttattctaggtagagggtcctgtggggaaagtgcctggcaccctgtaggggctcactcttctagaaatgtgatctgaaatctggctcacctgtccttccacccagggcctaggggatgccgagttccggagaccagaaagagcttgggataaaaagaaggtttaaggggaaggctttgacctgggctgggtttgcctgcgccatccaaacctgcaggctcgagtcctgagacacagggggtccagatgtcccaatgcagggccctcctcattaacacctgctcccctgtactcattagtaacctcacccatcctaccctcaaagcacagttggccctggtatccgtgggctctgcatgtgtggattcagccaacagtgggtggaaaatattcagaaaagggagtgtggatggctatgtctctgctgaacatgtacagacttttttcctgtcaccattccctaaacaatacagtataacaacccaatgacagccctagcaagtagagacaatgaaaaagaccggctcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaacacacatgagaaaatgctcacaatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcacccattgtggaagacagtttggccattcctcagggatctagaactagaaatatcatttgacccagccatcccattactgggtatatacccaaaggattataaatcgtgctgctataaagacacatgcacacgtatgtttattgtggcactattcacaatagcaaagacttggaaccaacccaaatgtccaacaatgatagactggattaagaaaatatggcacatatataccatggaatactatacagccataaaaatgatgagttcttgtcctttgtagggacatggatgaagctggaaaccatcattctcagcaaactatcacaaggacaaaaaccaaacaccgcatgttctcactcataggtgggaattgaacaatgagaacacttggacacaggaaggggaacatcacacaccggggactgtggtggggtggggggcggggggagggatagcattaggagatatacctaatgtaaatgacgagttaatgggtgcagcacaccaacatggcacatgtatacatatgtaacaaacctgcacgttgtgcacatgtaccctaaaacttaaagtataataataaaaaaaagaagaaaaagaaaaagaaacagacctgctcacattgtccagctttgaagtcttggaagaagttgccaccaggatgcaggtaggggtcaatctcctccaggatccagagagcatatcagccagcttcagggtcaggaaaggagcctgacaggtctgcagtaggacggggctggggctggccgtgtggatcacgtgggcctaatgagggggaaagtaagaccatggggcaaaggagggagcatgggggcagctggtggcctaagcagaaggaacttcagagaaggggtctgcattagttcattttcacactgctataaagaaataccagagactaggttatttataaaggaaagcagctaaattgactcgcagttcaggaaacttccaatcatggcggaaggcgaaggggaagcaggcaccttcttcacaaggcggcaggagggagtgagtggagaatgaggaagctccacattttaaaaccatcagctctcctgagaactcactcactatcaggagaacagcatgggagaaactgcccccaaatccaatcccctcccaccaggttcctcccttgacacatgaggattacagctcaagatgagatttgggtggggacacagagtcaaacctatcagaggctcactctgtctcgtggctcccccagggctcaggctgagtgcagatctgatctgctggccctgctctacagcacgctggggctctgcctgtgcatccccatctgtggcttcccggcgtggcggcctgttccctcaaaaggagggtggctctgctctcctgccagccccctgcagggcacgatggagccctggccacgtcctcccagggtgagggcatgaaactgggctccttgcccttcttgctgcttgggtgacaagctttgggtcatccctaggtcctgtcactgttcctgcttctaaatggagagcattttgccacatcttcctgggagaggctgggggttcgtccttgttatttgttctatcttggtaaaaccaggttaagttatctgggcaagcagacaatagagtggcacccaggaagggtggggtgtagggtgctggcctttgggcttgcctggaccatggttggaggggggaaggttaccaggaagcaggactgtcagggctaaagtcaggaggaagtggttatgctgaggggggaggtgtgtggctggcttggggcaggacgtaagtaagagccaagctctgtcagctcacagagagggccgctggcacctagtctagaggctgtggagcccaggggttgcccttagttcctggatccagggagacttctggagcctgtgcctatggctttcaggcacagggtgaagctggtgagggcagggggaagggtgagagaggaggccttgcatggcagggcaggacaggaagctggccagagaccagtttgcagtggctgctcccatcctcacccccacccccaagcacacccctaccccagctgggcctgggcacgtgtcctctgctttggtctcagcagatcacaagatggaagctggcagcctagtgggtgtgccactcaagccagtggtgacctgtgacttctgcttcctggatcgtggggtgcccacccaggagagcacaggtatgccccacacccctgaccttgagggcgctgggaggtgggggaccaatgtgctctatccctgtgtgtatgccctgaaaggtggcctaggagtcctgtgtgcgcccatccacgtggggtcccaggagcttcaacggtggcagggagggagacgaggagggagaaagaagtggagaagaaggagagagaaagagagttggggagaagagagtgagacagaaagagaggaagagagatgggggaagaaacagagaaagagagatagggagagagacagaggaggctgagaggaagaggagagagagagatagggagagagacataaaaagcaaagagagagacagggagagaggtgcatgagtaggaggtcgggtcattcttgatcacagttccagggcaacctgtaggttgccattaactaaccacacatataataaaggcttctgcctgctgcttacagccctcaagaacctctactcctggagactaaaacctttgacggctgcccttcctcactggatgtttgtcgtgtcttctgacgaaccgtgatgcctctttgtaggaatggtatcaataaagagccagatttgaggaggagagtaacgtgaggcattccaaaccattttcagctgaaaggtctttaattaaggtttcaaactctttagtagttggattgctggcgtcatcagtgctggtgccctccttttctttctttgattcattgtttaaatctgttgaggattgaacaactgtgaagttgacctgaatagcaccttcactcctgacagtcacatcttggtaactggattatacctataataaaggaggcagatcagaaccacagtccttcagctggagtaccccagccctgggaaaacaggtgtgcagagaatgtgtgaatccttgggataaatgtggtgcatcttcctaaagagacattttcatgttgagcaatttattatttttgatacattaattaataaataaaactcaggggacaggcttgcctgggaggacttagcgagtctcacagtgtcctcagggtgccgggaatgttggctttgtttcaaacccatttcctttcacagagaacctagccatcacatggggctggatgaggtccaggggcaactgagggttcctggccaaggccacaccctagtgttacctgtaggcttctgaactaaccccagcctctgacagcccaatgggtgatggcaaccgggtctccaagcttcttctatcgcaattttcctcttctccttttcatgaccaccatatctcctatccactctctgtatgcaatgctgcaggaatttttacagttcagggaagtaatcctgttaggcgagatcaggaaatgccataagggattgctgttttcttgattttctagaaacagagggcctccccaactgcccccaaacccccaccccactgcagtgagcatctctctctttacccttggtctggagagcacatggtatttcaaggtcaaaatcgccacctagcggagtaggaatcctctccatgaggcacattgtcagccctttgcagaaacattccagcttcccaattctccctttttgaacccctctactagacaccaggctttctgccccttcagtaaatgggaaaactcaacgatgagaaggaaaatgtcctccaaaaccaaattttaatcttgatactgtcccatcagcaggaaaaccaccattcagtcctacgttctttcaaggcaccagaatattctgcctccaattaaaatggtacttaggctgggtgtagtggctcacgcctataatcgcagcactttgggaggccaaagcaggcagataacctgaggtcaggagttcaagaccagcctggccaacgttgtggaacaccatctctactaaaaatacaataaatttgccaggtgttgtggcgtgtgcctatactcaggaagctgagacaggaaatttttttttttttttgagacagagtctcgctgtgtcacccaggctggagtgtagtggtgcgatctcggctcactgcaacctccaactccctggttcaagcaattctcctgcctcagcctcccgagtagctgggattacaggcacgtgccaccacgtccagctatttttttttgtatttttagtagagacggggtttcaccatgttggccagaatggtctcgaactcctgacctcatgatctgcacccccctcagcctcccaaagtgctgggattacaggcatgagccaccatggccagcgaggcaggaaaatttcttgagcctgacaggcagaggttgcagtgagccaagattgcaccactgcactccagcctgggcaacagagtgagactccatctcaaaaaaaaaaaaaaaaaaattaataagtagattttatgcccggaagttaactggagccactacctaagaataaatactttagtatagaccataataacaaactgtagagctcaaaccagcacactccctccattaaggggccttgcccaaatgcaactgttacatagtcctccccaagatctatctattggggaaccacacaggtcacacaagtctaagaagtcaaagggaaatcaccagcagaggactagagtcacatggatgaatgtgactaatccctttgcttagttcctccgattccatggctgagggtcatatctgcattactgggcagcacctttaacagatgccagggctcagggaaccaaggaaggaaaaacagttggggggtcgaccccactgtcttcccctccatcctgagccattgaaggagggagaccaaagggatgcctttttcttgcttctctttctagatgggtaaagaccaacttcagcctgtacttctctggaatgcattctgaatcactgggactcctttgaccccaagactttgaaggaaaagcagctcattttcttttgcgcaagggcatggccttcttatcatcttgaaccagcctggcctgtggaggggagctttgattttaatactatccaacaattagatcttttctgcagacaggagggcaaatggtccgagatcccctatgtacaagctttctttgccctgcaagacaacccagacctttgcaagtgttgcacaattgactcaacttttttagcagtcatatcagacgggccaaaagggaatgactccccaaaactagagaagcaacttccaggggaacaatctgaggcagctattgagtgtccaggcccttgttgtcccccttctctggggccccctccaaccatgccattagctccttcagccctaccacctctgaaactccccacatccccctacaggaaatgcccaatggaggtgatgccactaaggttcaagttcccttctaattgcagaaccttaggaaaataagggaagacttaggtcaattttctgatgacccttatagatatatagaagctttccaaaatttaactcaggtgtttagcttctcatggaggaatgttatgctgctcctaaaccaaacacttactacggctgaaaaacaagcagctctgaaggcagcagagaaattcggagatgagcaatatgtctcctatagtaggccaaaaagggaaagagaaaatagggaaagtgaagaaaggaagaacggagaaccatcattcccaataggaagaaaggcagtaactcctgacaaacctgattggaaccccagtgataccacagatgaatggaaaaggaaaactttttaatgtgcatattggagggcctacaaagaactagggccaaacaccttaattactctaaattgtccatgataggccaaaagccagatgagaatcctgcagcctttatggaaaggctgagagaggcactaataaaacacacctccttaacccctgattcagtcgagggacagctcatcctaaaggagaagtttattacacaagcagctcctgatattagaaggaaactgcagaagcaggctataggaccagatagtaccttggagaacctgttgagggtagccagcttagttttttataatagggatcaggaggaggcccaagagaaaggaaggaagcacaagagaaggacagagactctagtagctgctttgcaggcttgcaaagtccaggatccccgaggtgcatatgctagttgctactaatgtgacaagtcggggcactttaagaaggagcgcccaggcagcaagaaaaaaccattttgatcctgtccagcctgaggcagggaccactggagaacggactgcccccagagacagaggtcaccaggttcagaaccagtttcatagatggtccaacaggactgatgggtcttggggttcaaacccccagatccagtagcttaaactaccattacagcacaggagccctgagtgattctggaaattgaaggaaggaaggaaggtggacctccttctggacactggagccagattctctcttctcttctctgatctaggcttcccctcttcccatagcataactgtaagcatctcaggaaaggttctgacctgatatttttctcaacctcttagttgtagttggggggatctattatttatgcacaccttcttaatcatagctgaaagtcccacctctttactaggtagagacatttcagctcgcatggggatcaacatcctcatagccccaggacaaacacttttctccccctggtggaaggtaatatgaatccaggattgtgggcaactcaaggaagaatagattgagctgtaactgctaagccagttcagttccaccttaaggatcccacttcttttcctaaccagagacaatatctcctaaagccagaggctagcaaagggctagaagcccttattaataacctgaagatgaggggcttcctcaagccctctaacagcccttgcaataccccaatattaggagtgcaaaaacccaatggggaatggagactggttctagacctctgcctcattaatgaggccatagtcccaattcatccagtggtccctaatccctatatcttgctgactcaaatacctgaaggaactaaatggttctcagtcctagatttaaaggatgcctttttctgtataccattacatcctgactcacaatacctatttaccttcaaagatccctccagccaaactgcccagttaacatggatggtggtgcctcagggatttcgagacagtcctcacttgtttggacaggcattgtcaaaggacctttctgagttttcccatcctcaggttaggatcttgcaatatgtagataacatattgctctgtaccccaattgaggaagcttctcaggaaggcactgaagctcttctgaatttcttagccaagagagggcataaggtttcaaactccaaggcccagctttgccaaacctcagtgaagtacctgggtttagtgtgtctgaagggaccagagcattaggggaagaaaggattaatcccatttcctccttccccctcccccaaccctcaggcaactaagaggatttcagggcattagaggattttgcagaccatggatacctgggtacactgagatagctcgccctttatatcacctcataaaagaaacttaagtggctaaagctcatctcctgacctgggaacctgaagctcaaaaggcatttagccagctaaatcaagccttacgtaaggcacctgccctcagccttcccacagggagggccttcaatctttatgtatcagaaaggagggaatggccctgggagttttaatgcaagcctaaggaccagctcaatagccagtggactacctgagtaaggaacttgattttgtggctaaaggatggccagtatgcctctgagcagttgctgctgtggccctactggtatcagatgccaccaaatcaaccctggcaaattacttaactatttatacccccacataatgtagcagaattgctgtcttctaggggaagcctttagctaacagacagctggctctttaaatatcaagctctgctgttagaagggtctacaatccaattgaaaacttgtcctcacctaaacccaaccactttcctccccgaggaaactggggaacctgaacatgactgtgagcaagttgtggtacagacctatgcagccagggaggatctcagggacactcccctacaaaatccaggctggacccttttcatagatggaagttcctttgtagagcaaggagtctgtaaggcaggatatgcagtcatcactctgaatggtgtttttaaagtgcatccctctctccaggcacaagcactcaactagctgaactaatagctcttataagagcacttgaattaaggaagggaacagtagctaatatttacactgcctccaagaatgcttccttagttctctatgcttatgctgccatttggaaggaaaaacactttcttactgctaatggatctcctataaaatatcatcaggaaattaacaggttattatcatcggttttccttccacaaggggtagcagcgatgcattgtaagggacatcagaagggaacagatgaagtagctgaaggaaacatgttagctcatcagacagccaagtcagtggcaaggaagcctcagggcacaacacacttgaagccgcttgaatttgggaaggctccgtaagagaaatgaagcctcagtactcccctgcagagatagaatgggccacctctcgaaggtacactttccagccctcaggaccgttgaagtcagaggatggaaaactccccttgccagccttcagccattggaaagcccttaaaatccttcaccaagcttttcacttgggaaaggatataactgatctgtgtgcccagagatcgttttcaggagagaacttattaaaaacagtcaaataggttgttaatgcttgtgaagtctgtcttaaaaacaatcccctcaacaggcagctccttcctcctcaaacccaaaggatgggaagctatcaaggggaagactggcagatagacttcacccatataccaaagatgaagggcatccaatacctcctagtatgggtagatactttcactaactgggtagaggcatttccatgccgtacagaaaaggcctctgaagtaataaaagggtgagttaacgaaataactcctcactctggtgtgcctaagtacctcaaaagtgacaatggcccctcatttaaggcagccatcacacaggcgttctcaaaggcactaggcatatggtatcatctccattgtgcttggagaccccagtcctcaggaaaggtagagatgaccaacgatgttatcaagacacatcagaaaactgtctcaagaaactcaccttccttgggtcactcttctttccatggctttactgcgggtaggaaataccccttcaaagttaggtctgagcccttttgaaatgctgtatggatggcctttccttaccagtgatttcttattagaccaggagacctctgaattggttaaggatgtaacttctctagctcattttcttttttttttttttgagacagagtctcactctgtcacccaggctggagtgcagtggcgcgacctcggctcactgcaagctctgcctcccggcttcacgtcattctcctgcctcagcctcctgagtagctgagactacaggcgcccgccaccatgcctggctaatttttttttgtatttttagtacagacggggtttcactgcgttagccaggatggtctcgatctcctgacctcgagatccgcccgcctcggcctcccaaagtgctgggattataggcgtgagccaccacgcccggcctctagctcactttcaacagcaatgaacacaactggcaaaagcccagccctcaaaaacaggagcacctctatttaacccagaggatttcgtcttggtgaaagctctcccttctctccctcctcccccacgcccaagctgggaagggccctattctgttcttcttatatttatttttatttttatttttttttgagacagagtttctctttggttgcccaggctggagtgcagtggcgtgatattggctcatcgcaacctccacctcccgggttcaagcgattctcctgactcagtctctggagtagctgggattacaggcatgtaccaccatgcctggctaattttgtatttttagtagagacagggtttctccatgttgatcaggctggtctcaaactcctgacctcaggtgatccacgtgcctcagcctcccaaagtgctgcgattacaagcgtaagccaccgcgcccagcctctacactgttcttcttttaaccccctcagcagtacaagttataggtattgactcctggatacatcacactcaagtcaaagcatgtaaagctaagaggcaacccctgacagcccagaggaacgtcctggatataaatgtgaagaaatagaagatgttaagctgaaaatcataacagataagtaaatgagtgagggcttctctacctactcagtcacacccctaccttaccatataccttcagtcatttctacttttcctctcgagatttgccatcaaatattaaaacatctttttgaaatgtactttcagagagattttgattatccaggggattacatttgtaacttcacagacccccagagggaaagtctatatcttggtgagtaaaattttagatggaaattatctactatacctcccttgcaggaattgttgtgctcactctacttgtagtaggactgtatactgtcacacccccagaatggaatattggatgaagaatctcaatcactgaagtattttgcttaattattatccttacagcagggacaatagttactgacgacaggtaaacatgaaggttttactatcactgagtcagctaggactttttctttttcttttttactttttttttctgagatggagtctcgctgtgtcgccaggctggagtgcagtggcacacaatcttggctcactgcaacctccgcctcccgggttcaagcaagtctcctgcctcagcctcccaagtagctgggactacaggcatgccccaccacgcctggctaatttttgtgtttttagtagagatgaggtttcaccatgttggccaggatggtctagatctcttgacctcgtgatctggccgcctcgctctcccagagtgctgggattacaggcgtgagccaccgtgcccggcctacctgtgcacttttaaatgaaacatgctgcttctggatcagcatctctagtcaagtagaagagaacctacaggtgcttaaagaccaaattagaatcattgacaagttaagagaaaacgtggattccagtcttctttatggaattgattagttccttttttaagcccgctcttgctcgtgtgttttgtactaatatttggaccttgtatacgcaatacggtaacttgaattatttcctctcacctagaagctattaaactccaaatggcgccgcggatggaacctcgcatggacatgccattcttccaaggacccttagatcgactccaggaggagctctagctgctgtgccccactcaatgcccctctcttcagcaggaagtagccagaaagtcattgcccaataccccctaacaggagttagggttaccactcctgagaggggaaatatgatacaggagctagaaagaaattatttggcagacagtgagggtgaataagtcctcagcaaggtttcccttttaagaaaacgcagcccccaaatcatttcttttctaacaaagagcagcctgaaaaattgagctgcaaacataggtaagcaagttggaagcttgcacggggggatgccggcacctgtgctgatagaagaaagctaccgggggccaggcatgttcaacatggaggctccatcttcccttttgtcaccatgtgtacagtaaaaaaagcaggcaacatggcaccggccaggtagagaatccatctgaataataaaagattagggtggggcggccagcttctttgtgcactatgcaaacagcacacctagtcctaaccagttctttgaatgctatgtaaacggcacaccttgtccaaccaatctttcattccctatgtaaattagacaccacctcctcaagcacatctataaaacctcctgcacttcactgcagaccagaagacctgcttgggacctcctctctcttcaggagagagcttttctctttctttcacctattaaacctccatttttaacctctctccttgtgtgtctgtccttgatttccttggcatgggacaaggaaccttgggttttaccccagatgaacgatgccacttcaccactatgttgcccaggctggtctccaactcctgggctcaagcaatgttcccgccttggcttcctgaattgttgggattacaggcgtaaaccgctgttcccagtctgaaaaattttcttcagagagaacaggctttgtcagtggtctacttgaacagtatactaaattcatcaggtttggggatccaaaggaactgtccattatcctcatccatcagcaaaaagaataggccctttggtaaattatttttgtaagtgcttaatcctcaattacttgttgctgggccttgtcatcaccaggaatcattccgtgctttgtgtccttaatgccagcattcacgatttaaaactaagctttctagcacttgcttcactgtttcaaccactttcttcctgggactttcaaattctttgactcctgtgttagttcaagtctacagaaaagtagatgtcaaggactacatgtgaaagaggtttattagagaaggaacagaaggcaggacaaatcttcagactgattgcaggtctgactatggaaggagagagggaaggaaggagggttgggtaggactggactgtagcaaaattcagccaggccacagggagtctttgagccaaaattgcctgttggaggtctgtatgtcaacagaatgggcattcccttaacgcacctcttttattaatctaatcatccgcagtccccattactctagtcctactgttgaaaatcatacaatagtagagaatactgaagccactgttaaaggccctccatagtatcccttcttaattccgattgtccacagcagttaccacgactcctcgtccttctcagctcctcttctattctgtctcaagtaacactgcttgtgttttctgagagaatatggcacctgtaggtcattaatttatctaaaaagaacacgtgtagtcaatttctttcatctaagctaagagcaaaatgtgctttaccagtcttaggaccccatcccttttcctacaaccatgttgatccctctgagctgtatttaaaaatactcctcagctgacttcattcttacactctagttccttttttttttttttttgagacagtctcactctgttacccaggctggagtgcagtggcacgatcactgctcactgcaacttccgcctcctggcatcaagcgaccctcctgcctcaaccttccaagtagctgggattacaggcatgcaccaccatgcctgggtaattttttgtatttttagtaaagatggggtttcgccgtgttggacaggctggtctcgaacttctgacctcaggtgatctgcccgcctcggcctcccaaagtgctggggttacaggcgcgcgccaccatgcctggcccaccctaggaactttttttttgtttgatgggtcttgctttgttacccaggctgcaatgcagggggttcttcacaggtacaataaataatagctccctgcagcctcgaactcttgggctgaagtgatcctctcacctcagcctccgaagttgctgggactacaggaacctgccaccatgcccagctgttttataaaatatttttagaaatgggggtttcaccatgttgcccccaggctagacccatgggctcagttgtcctccctcctccacctcctgagtagctgggactacaggtgcacaccaccattcctggcaagaaaacattcttttttttttttttttttttccgagactgagtcttgctctgtcacccaggctggagtgcagtggtatgatctcggctcactgcaacctctgcctcccaggtccaagcgattctcctgcctcagcctccagagtaactgggattacaggtgcccaccaccacaccaggctaatttttgtacttttagtagagatggggtttcaccgtgttggccaggctggtctcgaactcctgacttcgtgatccgcccgccttggcctcccaaagtgctgggattacaggcgtgagccgctgtgcctggccaagaaaatattcttaattccatttaggttcacataaattccatttaggttcatatccaacttcagatgaattttcttgatagaacaaatgtgcagacttttcagtaatacagactgaattattcaccaaaactatattgacgctacatgacagaactaaaaaggagtaaattagggtcagtttaatgtttcattaggtatttagagaccaaaagaaaccacaaaatcttcttatttaaaatattttaatttctaaaaagcttaaatcatattaaaatttaaacaatttcattgtacagtacttgacaatacatttcaacaaactgaaaggcaaaccagtaaatcagttttgcttactttctaagcttaataatgtacagactcttgctcttcaagaagatgcaaaaatcagcaacagtacaagtgaaatatttaaataggaatctgaaacaaaacgaattcaatctgatcaaatccacaattaattgaagttttcattttattcaattgtgaataaaatagcagacactgtttcatccaataagccaatgatatcagcttaggagaaatgatctgcctggcttgtgcaagacaagaacagttaccttctgctgaaaggatgtgagttttcaaatttggttttcatgtcatagtttccaaataaatgaaccgctccaccaaaaacgacagtctagttgctacctatcttccagggtttcatcatacagccatttataagcacaatctttggaacgctctatagtttcaaaaagtgttttgaagtcttgagggtgcatgttaactactttctcatcctcctgttttcctatttgcatcaatatatctctcgcatcaagtggagtcaatgaactgcaaaagaaatacaaagtaaatgtacttaattctttctcatgcatctatcagttcacggtgacagaaatggcttctaagttgaattcaaaatgtctaacttaggcatacagagtgctataatggacacgggagaatcagcagggaagaggatgggaggagggtgaaggatgggaggagggtgaaggataaaaagctacctactgggtacaatgtacactatttgggcatgggtacactaaaagcccagacttcaacaatccatccatgaaaccaaaaaaatcacttgtattcctaaggctattgaaataagaagaaaaaaaaaagcctaacttattatatataagcaatcttatttagtttaagagcttccagtaactttatgcttatttctaaagtttcatagctaacctataatgaaaatattaatagcaggtttaggctttcacatactctaatcaatttttacaccgaattctagtttaatcactgccgtttgaaaaaattattatgcctacctctttcatccttttcctttctgcaaaaaatattcttaacttcttttggttcatgtcaaagttcagtaactataaacagcagaagttgctgtttggcagtttacaaagagggaatcatttttcacattttgatgtaaccatcattggtaaatacattataaagccgcaaacttccttatacagtcatgcattgcttaatgatggaggtatgtcctgagaaatgcactgttaggtgatttcattgttgcttgaacatcttacagagtacttaacccaaacctatgtgatatagcctattacagacttaggatatatggcatagcctattgctccaaggatacaaacctgcacagcatgttactgtactgaatactgtaggcaactgtaacacaatggtaagtaatagaaaagatacagtaaaagatacagcatctttataatcttatgggaccactattgtacatttggtccactactgactgaaacgaggtataacgaacacgcctcattatgaggtattatatatataaggtatattatataatatatatacaatatataatcaatgaggtatattatataccataatatgaggtacataactgtgtatcagcttagcaacaaaccatcaataagcctccaacaacaacaattgtaaaaaaatattttgggctgggtgcggtggctcctacctgttatcccagcactttggggggctaggtgggaggatcatttgagcccaagagttcaagactatcctgagcaacatagtgagaccccatctctacaaaaatcgtaaaaagttagctgggcatagtggtgggcatagtagtcccagctactcagggaagaggctgaggcaggatcacttgagcaaggggtttgtggttgcagtgagctatgattgtgccactgtactccagactgggcaacagagtgagactctctgtctgttcaattccaatactttttgatattgaatagaatcttggtaacatgtttctagtccactgagattaccaggagcatttttaatattttgcactatgatttacaacatttattccttatttccctattttcttgatattttcattcaaaatagccacaaggtggcaagatgaaaaataatagattgccttttattagtctattgccttttactagtctattaccacttttttttttttttttttttagagatagagtcttgctctgtcacccaggctcatctcaaagtcttgttggcgctctctgcctcccaattttttttttttttttttttttagagacaaggtcagcttgctctgtgtcccacactgcaatgcagtggtgagtttatggctcactacagcctccaatccccggcctcctcaagtgatcctcccaccttggcctcacaaaaatgctcggattacaggcatgaaccactgcacccaggctattgccacttttaacatttatttttagataaatattgtctagtcaacagctcattcagagttaaatattaaatgatcaaatttgttaaaataattattttaacattttacccatcctctggcgagactttgaatgactatgggctgctgattacaaggcataatgcacaacttacagggacgtatgcatcagccctacatacaaattacatggatttatgtacaaattacacagatggctgggcgcgggagctcatgcctgtaaccccaacactacttacagagatgtatgcatcatccctacatacaaattacatagatggccaggcgcagtggctcatgctggtaacctgagctgtacttacagaagtgtgggcatcaggcctacacacaaattacatggatggccaggcatggtggctcccgcctgtaaccccagcactacttacagaggtgtgtgcatcagccctacatacaaattacatggatggccaggtgcagtggctcatgcctgtaaccccagcactttgggaggccaagcaaggtggattgcttgaggccaggaatttgagaccagcctgggcaaggtggcaaaaccccatctctacaaaaattggcatacaatttataaacacaaaatataaatataaaaattttatatttttacaaatataaaaattagccgggcgtggtggtgcatgcttgtagtcccagctactcaggaggctgaggtgggaggatcacttgagcctgggaggacaaggctgcagtgagctgagactgtgccactacacttcagcctggacaacacagcgagaccctgtctctaacaacaacaaaaaaatgtttttcacttatatagacataaagcaagtagtgttacttacaagctattatttttacaaagctttgggtaaaaacaaaatttgatccagagcaagggaaccagggtggtataattatctatccctactctggttaaggaacagaaccactgaagacaagcaatgagaggtaagtgtgggcacgcctccagtaatgctgatttctctccaccccactagtggtaggcagctagtgcttcctgtaagataaagctaagcccatactctcaaaaagattaaacaatctgggcatttttttaaagaaggaaaaataaatgaaactcaatgagagattatgggaaaaatatattttcctcaaaatgtacaccagggagaacaaattattttgaagaaatatgagggaaaacatggtacctcactctgtcaatcaagatataaaaatagatctctagcatgaaagaataatttgtgcatcgttgctactttatacttgcttttattctttttactcaccgtaagtggtctattacagtggcgctgcgcctcccaaaacagtgctttaacaagtgaaaaaatatattatagttcataggtgttaagttcttggtaaataaattttgacgaggaatcatttgaataagatacagcttttgttgtaattggtctaataattcctggagagaagaaaaaatgaattgcattagtcacaaaatattgccagagtaagacattgctcacttcttccttcaagctatctgctgaaagacacaatcaccacaggccctgagtgtcttcacattctctttttctttcttggagatagagtctcactctgtcgcccaggctggagtacaacggcgtgatctccactcactgaaagctccatctcccgggttcatgccattctcctgcctcagcctcccgagtagctgggactacaggcgcccaccaccacgcctggctaattttttgtatttttagtagagatggggtttcaccgtgttagccaggatggtctcgatctcctgacctcgtgatccgcccgcctcggcctccccaaagtgctgggattacaggcgtgagccaccgtgcccggcccacattttcttattgtgtacaccaagaacacaaagccctaattggtctttaccaatgaattgggccatttctcagagttgtttgtgatgagtaaccttgagggaggagataacgtctctctccaggacaaagagcaggcctgtggctgggtgcagtggctcatgcccatgatcccagcactttgggaggccaaggcgtggatcactcgaggtcaggagttcaagaccagcctggacaacgtggcaaaaccccatctctataaaaaataaattagctgggtgtggtggtgtgtgcctgtagtcccagctactcgggaggctgaggtgggaggatggcttgagcccaggaggtggaggctgagagcatgccactgcactcaaggctggttgacagagccaggccttctcttaaaaaaacaaaagggcaggcttgcttaatgtttgctatgaaggaggaggattcattgggaggctgaggtgggcagatcgcttgagcccaggagttcaagactagcctggacaacatggcgaaaccctgtctctacaaacagtacaaaaattggcagggtatggtggtgcatgcctgtagccccagctacttaggaggctcagatgggaggatgcttgagactgctgcgtggagtttgcagtgagccgagattacgccattgcactccagcccgggtgacagagcaagaccctgattcgaaaaaaaaaaaaaaaaaaaaaagacctagattcccccagctctgtacttctcagctgcaaagcaagtccactaaatgcaaggcacccaactgagccacctcacatcactccatgggaagagaggcacagaacatcctctgtctgatccaggagtcttaggccaacatccgagaaacagtaacatttattaacatgtaagtagggtaaaatcaaatcccagacatgaggccgggttgctcacacctacaatccaacactttgggaggccgaggcaggaggatcgctggagcccaagagttagcgaccagcctgggcaacacagggagactccttctttacaaacaaacaaactagctgggcgtgggatgcacatctgtggtcccagctatttgggaggttgaggtgggaggatcacttgagtcccgggagtttgaggctgcagtaagccgtgattatgccactgcactccagcctgggagaagagtgagacactgtcttttaaaaaaagaaaaaaaaataggctgggcgtggcggctcacgcctgtaatcccagcactttgggaagccaaggtaggcggatcacctgaggtcaggagtttgagaccagcctggccaacgtggttgaaaccccatctttactaaaaatacaaaaattagccctgcgtggtggagcatgcctgtaatcccagcattcgggagggtgaggcaggagaaacacttgaactcgggaggtaggggttgcaatgagccaagatcatgccatcgcactccagcctgggtgacagaatgagactttgcctcaaaaaaataaataaataaaaaataaaaaaaggaaaaaaaaaaaaacccaaacatggcattaacatatattgagtccttgctatattcaagataaaacatcaccatcggatccaaaggacaaaaaaagttattgactaaaatttttaatcggatatttaaaaagtaggtctcaaacaaaacttggatagaaatgacaggccctaaaaacctgttaaatgtctcaaactgcttccatagcaatatgagcaccttgatatcaaagacacatgtgaaatatctaaaataaattctgtcataaaatatgacatttgcttatttcatcttcatccctaaaagtttatatatgtatatatacacacacacacacacattttttttttttttttttgagacaaagtctcactctgttatccaggctggagtgcaatggcatagtctcagctcactgcaaactctgcctcccaggttcaactgattctcccacctcagcctcctgagtagctgggactacaggcgcacgccaccacacccagctaattcttgtatttttagcagagatggggtttcagcacgttggccaggctggtctcagactcttgacctcgtgatccacccacctcggcctcccaaagtgctgggattacaggtgtgagccaccacgtccggccaagtttatatttttaagttggccaaaaaaacttaagcttttcagcttcttgctgaaaaactgagaaagtatattatatacaggattgttcatttgtggaatatttggataagtccccaatagtatccaaatgtactgtattagacaaaatgcattattcctattctgttttttgggactacataaatatgctgtataaatagtcaaacagaactaaaagcacaatgatgactgatcactctaaaatcacaacattgaaagaaaactgataattttctttttcctttagtggcaagtgtgagaaaaaaacataagtaagcaaacaaacaagatcttcagactaagctgttatgctgagattaggccattgttagcatttaattcgttttttttttttttaagccccaaaccttaaagacaggcatctaattctaaagtgaaacttctgaattgagtcaaaaaattgttttgtgaaactttagctactttattagaatttcacaactagccctgagataaactaaatggaggactataacattgtcactttggttcttacgtacaaagattaaaaaatgaacaaaaataaaggcctaactcctgggtaaaaatcaagaagtacctatcagtgaattcaaccatgtaataagagtagtaatatcacaatttttttttttttttttttgagacagagtctcgctctgttgtcaggctagagtgcagtggcacgatcttggctcactgcaacctctgtctgccaggttcaagtgattcttctgcttcagcgtcctgaatagctggaattacaggcatgcgccaccacacccagctaagttttgtatttttaatagaggcggggtttcaccatgttggccagggtggtcccgatctcttgaccttgaatatcacaaatttctaatcgattaatacgtcataaaattttgtttctaattaatcgaattagataaatattaaaatgattttattttccaaatttgaaatgtaccttcatttcaaaagatataagaagagaactcagattctgtttttaagcctattactatgctagcatccattgtataacagctgataactcttccaaaatacttttgattcattaaaagtagtaagatatgtttaaagaatgtttctagatattttaaaattaaaaagttaaatacagactaccaaatagtcctaaaaaaataaaataaaaaatacgtcacgtagggagaaaaaggaaaaggtattattttattcttaccctacgctttgggttttccagcggccctttccgggtgtatatatcaaatgatgaccaaggctcctggggaagaaaaacaaagcaaaacaacatcttttatttctctttggtcaaagtgccccagttattacttccttaaaaaacaccttgcctaaataagagaatggtcagtctaattggatttaaaagaaacatgttatagctaaataatacacatctctctccttaatttttttaaagaggaggaggatcaaaagtctacccaaatactagtacctcttttccttattaaacatgacttcgcctgttatgcaattacgcaaataagtatttgttataatttttaccactcaatatttccatatcacagtcagaatcagcagtttaagggatattagattaatgctgaggatttctttttgccctacttcagtggaaaagcctactaatcaaactatttgaatatgttagaacatatatggaaataaacaaataaagatactagtgtcgaccaggtgctgtggttcatgcctataatcccagcactttgggaggccaaagtgggagggttgcttgagcctgggagctggagtttgcagtaagccactgtactccagcctgggaaacagagtgagaccctatccaaaaacaacaataacaaaaacctagtgtcaattttaaaatggatcactatttttcggtatctatcttttgtaagagaattttgtgcataaggcaattttaagagatgatccggtcaggcacagtggctcatgcctgtaatcccagcactttgggaggctgagggaggaggaccgcttgagctcaggggttcaaggccagcctgggcaacatggtgaaaccctgtctcttcaacaaatacaaaaattagctgggtgtggtggtgtatgcctgcagtcccagctctttgggaggctgaggcgggaggattgcttaagcctgggaggcggaggttgcagtgagccgggattgtgctggtgcactccaacctgggctgacagagtgagatcgtgtctcaaaataaaaaaccgacccacctgaaaaagtattctctattaaaaaaactatacatacccataaccatattaaattccaaaataagagtgggttaaaatagatctgacataggcttaaaagactaaacaatattgaacacaaggtctgaaaggctactgtcaagtaacaatttattattaactgcaggggcaatgagagtggctaaaacatataattgtggccaaattgtgaaattcctagcagttccaggaatgtcactttaagtgggggaagaaaagcaccatcagccgtgcacaatgagtactgccacttcccacacgcctggtcgagcctcaacagctttcccctcatcaagcacagtggaggaaaacctgcaagacactgggaattgacttcaacaacttactctacagatgtagacacacagtggagcaagtgctgagaaacgttaggtccagaaagacctttcctttctggagtttagtaaatggcaaaacctaacacgggacctttgaaagcaaatactaagggaacaagaagacgaaaacattctgcaagctaaagtcctcagagggcctctctgaagaaactagctgaaagctaccaggacagaagacttgagatgaaagtcaacagaatgagacaagatcagtgggtaaggaagaattttagagaaaccaagaactatagtactgagagtacaatatacagtgcaggcagaaagcagaatcagtgatgtgaagactaagtgtgaagagattctgggaatggagaaaaatgatgagagcatgacagacacgaaagacaaggatcagagatccaacctaagaacctcaaatgtttttgaggggaaaaaaaaagaattggaacaaaagctaaaatcaaatgagataacattcctgagcttaaaaaaaaaatacagcaaggtgcagactgaagacctcagcatattctcaggcggaagcagtgacgagaacacgtgaagatccacattgtaaatatttaaaaattagagccagggccaggcgcagtggctcacgcctgtaatcccagcactttaagaggctgaggcgggtagatcacctgaggtcaggagctcaaggccagcctggccaatgtggtgaaacctgtctctaccgaaaatacaaaaattagcaaggtgtggcggtgcacgcctgtagtcccagctactcgggaggccgaggcaggggaattgcttgaatacaggatgtagaggttgcagtgagccgagatcgaaccactgctccccagcctgggtgacttgagtgagactccatctcaaaaaataaaaaaataaaaaatagagccaggtgcagtgggtcatgcctgtaatcccagtgatctgggaggctaaggcagaaggatcacttgaggccaggagttcaagaccaggctgggcaatattcttaaacattttaaaacttagccaggcatggtggcgcctggctgtagtcccagctactccagaggctaaggtgagaggatcacttgagtccagtagttcaaggctgcagcaagctatgattgtgccactgcactccagcctgggcaacataatgagaccctgtcgctaaagaaaaacgtttttaaacagaaggattttactcaccatgtgcagaaccttaatctcacaagctaattgccagataacacttaatacatgatacaagtctggatttccgggatctgccattagtttctagtaaaaggaaaataaaaattacatgttatacacatctataatcaattaaaaacaaatgctgactcttaataggactatcttaatggcatctagacatttaagaaaagaaaactagaattagatgcaaaaagccgggtgcagcggtgcacgcctgtagtcccagctactcgaaaggctgaggcaaggggactgcttgagcccaggcatttgggcgttccgtgtgagatgatcgtgcctgtgaatagccacagcactccggcaggggcaacggcagggcacgcggggtcacgcttgtaattccagcactttgggaggccaaggtgggaggatgcttgagcctagaagttcaagaccagcctgggcaacatagtgagaccgcatctcttaaaaaacaacaacacacaagtgttaaggctgacttgaaaggacgaggttacctcaacgaatgggaaggcactccgcagacaagaaaccacatgtgaaaaggtccacggcaaaagaggcatgggccagtggaatataaccctagcagcaggaatctaacacagcacttcctattcttctccttgtctttcctttgttgaatagcgtatgcacagccccaaggtcctgaggccctcgctgtctttccatggctagcaaatatgtatttactaaatgggtctgggggagcaaatcatcccttcattttttgccccactatcctaatccatagcaatacaaataagcattataaaaatcttaatcttctttgagtcttaatagtactatcttaatagcatctagaaatttaagcagagaaaactagaattagatacaaaaagctgggtgcagtggtgtgcacatgtagtcccagctactcgaaaggctgaggcaaggggactgcttgagtctaggagtttgggggttcagtgtgagatgaccgtgcctgtgaaaagccatagcactccagcatgggcaacacagcaagacaaacaagcatttcccgtcaaactggattaacagatcaataacatgaaacattctgggcagaaaagaaagatgacactcatagcgagatcaaggttgtcaggaagaccttccattacagagaattgaactagagtctcaaatcttaggctcggtgtaatggctcacaactgtaatcctagcactttgggaggccgaggcaggagaatcacttgaagacaggagttcaagaccaccctgaacaacacagcatgaccctgtcactacaaaaataaactacctgggtgtggtggtgtgcacaggtggtcccagctacagggaggctgaggcaggagtgtcacttgagcccaggagtttgaggctgcagtgagctatgaacataccacgacattcaagcctgggcaacagagcaagaccctgtctctaaaaaaatttcttttaatgttttaaagttaaaaaaaataattataataccccttaaatattaaaaaaaaatcctgttaaaactaataaattcagctgagtatggtagctcacacttgtaatcccagcattttgggaggccgagggaggaggatcacttaagcccaggtgtttgagaccagcctgggcaacaaagtgagacactgtctctatttaaaaacaaagggagggaaaaaaaacctggctgggcgctgtggctcatacctgtaatcccagcactttgggaggctgaggcaggcggatcatgaggtcaccagtttgagactagcctgaccaacatggtgaaaccccatctgtactaaaaatacaaaaaaagtagctgggcatggtggcgcgtgcctgtaatcccagctattcaggaggctgaggcaggagaatcacttaaactgggaggcggaggttgcagtgagccgggattgcgccactgcactccagcctgggcgacagagcaagactccgtctaaaaaaaacaaaacaaaacaaaaaacctaataaattcagcaaagctgcaggatacaaaaatcagttgcatttttatgcactaccaacggacaattcgaaaaacaattccatttacaatagcaccaaaagtaacttaaaagctagtaattaaaaacacaaataaatggaggccaggcacagtggctcacacctgcaatcccagcacctcaggagactgaggtagaaggatcacttgaacccagaagttcaagaccagcctgagcaacgtggtaaaaccatctctacaaaaaagacaataatcagccaggcacgggggtgcacgcctgtagtcccacctactggggaggttgaggtggaagcatcacctgagcctgggaggtcaaggcttcagtgagctgtgatcctgccactgcactccagcctgggcgacagtgagaccctgtgtcaaacaaaaatgaaaacaacaacaacaacaaaacccacaaataaatggaaagacatttcatgttcgtggattggaagatttaatattgaatactgttaagatgccactaccacccaaagcaatctccagattcaacgcaatccctaggaaaatcctaacgcattttggagaaacagaaaaatccagcctaaaatccatatagaatctcgaggaaactcaaatagcctaaacaatcattaaaaagaataaatttggatgaatcagcccctgatttcaaaacttaccaaggtaacagtagcaacacagtgttgtcttggcctaaggacaaatatttagatcaatagaatacaatagagcccagaaataaacgcgtacacatatggtcaaatcatttctgacaccaacgccaaagccatttaatggcagtaaagaacagtctttccacaaacggtgctgggaaaactagatcaaagaatgaagctggacactgaaaccataagcaaaatttactgaaaatggatcaaagacctaaacaagagccaaaactataaaactcttagaagaaaacacaaggaaaccttcacaacactggatttggcaatgatctattagctacgacacaggtccccaatccccgggccacgaactgataccagtccgtgtcctgttagaaactgggccacacagcaggaagtgagcggcaggtgaacaggcgaggcgtcatccgtatttatagccgctccccaccgttcacatcaccgcctgagctccacctcctctcagatcagcagccgccttagattctcataggaacacaatccctattgcgcatgcgaaggatctgggttttgcaagggccttatgagaatctaatcccgatgatctgtcactatctcctgtcacccgcaagtaggaccatctagtttcaggaaaactagctcagtgttcccactgattctacattatggtgagttgtataattatttcattatatattacaatgtaataataatagaaataaagtgcacaataaatgtgatgcacttgaatcatcctgaaaccatccccgccgccatccacgtaaaaactgtcttccacaaaactggtccctggtgccaaagatgttggggaccgcccagctacgtatgataccaaaggcacaggcaacaaaagagaaaaaaagacaaagttgacttcatcaaaatgaaaaactttgggcatcaaaggacacaattaacagggttaaaaggcaacccatagaatgggagaaaatatttgtaaatcatgtatgataagagattaatatccagaatatataaagaactcttaaaactcagcaacaaacaaaataacccattaaaaatgggcaaatgtcttgaacagacatttcttaaaagatatacagtcagtacgtacataaaaatatattcaacatgactaattattaggaaaatgcaaatcaaaagcacaatgaaataccacttcataccattaggagaggtattaccaaaaacccagaaaacgactctcagtaatgctgtggagaaatcggaacccttgtgcactgctggtaggaatatcaaatggtgcatccacgacggataacaaacagtatggcagttcctcaaaaaactaaaaatagactgggtacagtggctcatgcctgtagtcccaacactttaggaggctgaggcaggaggactgcttgagtcccagagttggaggccagcctgagcaacatggcaagaccctatcgctacaaaaagctgggcctggtggtgtgtggctgcagtcccagcttgggggctgaggcgggaagatcgcttgagcccaggaggtccaggttgcagagagctgtgatcatgtcactgcactccagcctgggcaacagggcaagaccctgtctcaaaaaacaaacaaacaatcaaacaaaaaacaaaaaacccacaaaaaactaaaaatagaattactatatgatcctgcaattctacttctagctgtacactcaaaggacttgaagagatattggtaaactcatgttcattgcagcattattcccaacagccaaaaggtaaaagcaaccaaatgtcattgatacatcaacacacaaactgtagtatatatatacaatagattttttttttgagacaaagtcttgctctgttgcccaggctggagtgcaggggcatgatctgggcttatagcaacctcctcctcccaggttcaagtgattctcctgttttagcctcccaagtagctgggattacaggcatgcaccaccacgcctggctaatttttgtatttttagtagagacagggttttgccatgttagccaaactggtctcgaactcctgacctcaagcgatcagcatgccttggcctcccagagtgctgggattacaggagtgagccaccgtgcccggccagaatggaatattattcagccttaaagaggaatgaaattctgacacatgctataacattgatgaaccttgaaaacattatgctaagtgaaatacgccagacacaaagaaatattgtagagtaaacttacatgaggtaaagagaatagtctaattcatagagacagaaagtagaataatgattactaggggacgcaggaagagggaaacgagagtttgtgtttaatgagtacagagttttggtatgggatgatgaaaagttttggagacagatgatggtaatggctgtacaatgggaatgcagttaaaaccactcaactgtacactgaaaaagcaacctgagcataagactgctctgcagaatttaaaaacaatcttagaccctcaaatgtcacgagccctaaattaaaatcgcacagattaagagtactcagagaaaaattacagactcagaacaaaaaataggtatttgttaataacatacctggaattctttttcaccaataaacatatttacttctattcgtccaaatttatatatagaagtacaggaatacaagtcatatgcgagtttccaaagtgcccttttctcacctctacttgggaacattccaactacttttaaagggatgtctgttaggaatataagcaaaaagatttgaataaagttcttagcattttgtcctatgtccatatttttttgagacaaactaagttaacaaactatattaatttcaagtttatttcaattaaaactaagcctcaatatctttccttggcatgaaacttggcttttggggaaataaactgggtacctgtgtccaggtgaggtaaatgccatattcagagtcagagcatctgctcataaactgtattaatataatataaattatacacaaattcggcggggtacggtggctcacatctgtaatcccagcactttgggaggtcgaagcgggcagatcacttgagggctggagtttgagaccagcctggccaacatggtgaaaccccgtctctaccaaaaatacaaaaaaataaccaggtgtggtgacacacacttgtaatcccagctactagggaggctgaagcaggagaatcacatgaacctggaggcagagggtcagtgaaccaggatcgcgccactgcactccagcctgggtgacagagtgagactccatctcagaaaacaaacaaataaataaaacacaaatttcatcaacaaatcagttatactgctagagacacctggcaaattctaggtatttgctttagtaaattccaaaaatgacctgctgtccaaggaactgcttctattcccaaattcttaaagagccctcgagaagacatagcaggtggttttattactccaccacttctaggatctagtttaaagaagtcacagtggatcactcgtagttttccatccagattttttcctaaggactaaagagagacaaagataacacgttaaaaattttcagcattaagtatactttgcagcaattcaaaaaactctacttcaaaaaaccataataaaatgtaaaaataaaaataattcaattacctggggtttttttgttttgttttgttttgtttttgagagacagagtctcgctctgttgccaggctggagtgcagtggcgccatctcggctcactgcaacctctgcctcctgggttcaagtgatcctgtgccagcctcccaagtagctgggactacaggtgcgtgccaccacacccagccagttttttgtatttttagtagagatggggtttcaccatgttggccaggagagcctcaatctcttgacctcatgatacgtccaccttggcctcccaaagtgctgggattacaggcgtgagccaccacgcccggctgaattacctttttacaaaaaatatttctacctccataactatgtaaagaaaatattactaacatacccaaaatttaacagaggaagtaaaaatcaattaatacctgaaaagtggcaaaagtacaatattaccaagaaaaagccccccaaacagaaataaactatcataaatttttctttatctgtttactttttttttttttttgagacaagctgtcaaccaggcaggagtgcagtggcgcaatcccagctgactgcagccttgacctcctgggcttaagtgatccttccacctcagtcccacaagcagctaggactacaggtgcataccatcacgccccaccaatttttggattttttgtagcaacagggttttgccatgttgcccaggttggtctcaaactcctgagctcaagagatctgcccaccttgacctcccaaagtgctgggattacaggtgtgagccactgcacccggccccacttactttctttatcataatggcttcagctattcaaaagcttttcacaccactccctgcctgcttagtagtggttacctgaagcactgggcaaagattctgacaccatggttggcctcttacagagaactgtgagccatctgctttggtcatgggaagaaaaaatgaaagatgtttcacagtaaagaaaaacaattaaaatataaaagtgaaaggcagatggattcaagagaatatctttcttctaggggaatctagtcagctatccaccaaataaatgaacttagctcatctccataattttcatttactttttctaaagacagaagcaactatacaccttgtttgctggaagaggtctaatatatctcagtcttctcactgctctgatttgctcatcttgcagtagtactagagaccttcatagttagggcaagaatcagttatagactccataaacttaattcgaagttacaaaaaaaaaaatcagtaagaaggcattatgtttttaatgtgtacactgatgtttctgtgcacagaaaattctattaatatttattaaggttggaaatgatgtaacttaaagttattaatgcaaacacctattttttcttaagcatttgtattcaacctatattatcctatttctaaatctagtaaaatactttttcttcttattttttattgagatgagtctcactatgtccccaggctggtctccaactcctggccttaagtgatgctcctgtctcagcctcctaagtgtctgggattacaggtgtgtgataccgtgtccagctcaaaatgtagtaaattttggccgggtgcagtggctcacacgtgtaataccagcactttgggaggccaaagagggcggatcacacaaggtcaggagtttgagatgagcacggccaacatggtgaaaccctgtctctactaaaaatacaaaagtaagccaggggtggtggcacacccctgtaactccagctattggggaggtgaagtgggagaaatcgcttgaacccaggaggcaggggttgcagagagctgagattgcaccactgcactctagtcagggtgacagagtgagactccatctccaaagtaaataaacaaacaaatctagtacattttaacaatcactttcaaggggaagttttaaaaagactagaggaagggaaagactgggggtggaaatcatacacatttggtcacattaatttcgagatgcctactatgtgatctaggtagaggtgccaggtaggaagttgcagacctgaataaggtgctcagtggagtggtccagtctgacgatataaatgtgtgggaatttggcttgttgaaggtaatttaagtcaggggtctacactagggagaaacagaggactagccctgaaggtagagtatgtccaaagtctaatgacaagaaactgagaatacaactaaggaggaaaaccagaagagtgtggtgtcatggaagctaaaagaaagagtacctacctaatgcatacgattgtcagtcaacacgcatggcaaggctgtctaacctgtggcctgagggccgcatacagcccaggacggctttgaatgtggcccaacacacatttgtcatctttcttaaaacattatgagatgtatgcatggactttttttttttttaagctcatcagccactgttcttattactgtattttatgtatggcccagacagttgatgtttcagggtggcctaggcaaaccaaaagattggacacccctgatatagcattaacataatctttcaagttatcaaaaaggcagtttaatctttgtaattaaggaaagctaaacagcacaggtgtggtggctcatgcttgtagtcccaggagtttgagaccagcctggacaacatgacaaaaccctgtctctactaataatacaaaaaatcagccaggtgtgggggcgtgtgcctgtaatcccagttgcttgggaggctgaggtgggagaatcacctgagcctgggaagttgagactgtagtgagctgtgactgcagcactgcactccagcctgggcaatgggagtgagaccctgtctcaaaaaagaaaaagaaaatgtataaacaatgaacactttatggcctcaatacacttgtatgttctgagagggcaccatacattcttgctttagcacttgtcagttaacactcaacaattcaaacatgataataatcaaagcttcaggataaataattcaattcatacaacagatcacatttaaaaattcaactggattgcattaggattcaaaaacagaatgggaaaaaacagagaaaaggcaagtaacccttgagtttttactagtcattaagttaggtacttaagttagtcattaagtttgtctcatttactgggtgcagtgggtcaagcctgtaatcctagcactttggaggctgaggcgggcggatcacgaggtcaggagttccagaccagtctggccaacatggtaaaaccacgtctctactaaaaatacaaaaaattcgtcggtcgtggtggcggtcacctgtaatcccagctctcaccactgaaactcctttcagttttcaggaacaaactttaggtggccagaagcattatccgctaagcgcagcactttaagtccctgacttagagccacaagagttctgcttacctattgttacttctcttttcactctggcaaacagattaattcacacaaaattttatttgaatggcttttcaatttatcataacaatggttactaaaaagtgagagaatatgtactaagggttgagtacaagtcagtgctagtagaaaataagagccttaatagagaaaaaactagttctaatcaaagactggatttagtcaatgatgtttatatttttagctgacatttatagcttcagaaacattttgttattgatattcctatcataattattgtttcaaaaattctctagtccctaaccttccttttttcattaaacaattgttttaaaattaaactgttatcttgaaggttttttttttcttttgagactgagttttgctcctgtagcccaggctggagtgtaatggcacgatctcggctcactgcaacctccacctaccgggttcaagtgattctcctgcctcagcctcccaagtaactgggattacaggcatgaaccaccatgcccagctaattttttgtatttttagtagagatggggtttcactatgttggccaggctggtcttgaactcctgacctcaagtgacctgcccgccttggcctcccaaagtgctgggattacaggcatgggcctcggtcctcagccttgaagatcttatagaaaaaagcaactactgtgttacagaataacaaactttaaatagaaacaaagacattttaatacaatcttaattactttgtgaatatgtagattaacctttaaatataggcttttttttttcctcaaatcaggataaaagttatcttctcatttttaatttccaagttgaaactacagatgactatgtttactgaatcacatttcaggatcttaaatcttcggacaattatgtgttttttcttcacatttttggaactccctcagatttaacatcaattaaataacctagctaaaaccttgaactcttttcaaaacagtaagtggtagaataacaataatttcatactcatagttttaaaagaattaaacaactggatttgacagacattttcacaattttttgttgtcatgcaattttggatacagccattctgcatggtttcacaaagttggcatagagaaatataagtttcctaagttgaaacggaagattataaaagagggaaggagaatgagagtaagagactggttaaagacccaaaggatttccacttcttcattgttacgtaaatgtgtctgctttttaagaagcacaatcactgaaaaatctatttggatgatgccttcactctatgcaactgtatctgactacaggctgagcatccttaatccaaaaattctgaaatgctccaaaatgtgaaactttttgagtgtcaacatgaagccaaaagtggaaaatttgacacccgaccttctgtgacaggcttgcagtgaaaatgcaggtatacaacacgaagatgaggtcagtctataaaaatcgaagggagtcatctaagacaaaaaccactgttaataaggcagatgactccatagggaacttttttttttttttgagacaaagagtgtagctcagtcgcccaggctgcagtgcagtggtgtgatctcagctcactgcaatctctgagtcccgggttcaagcgattctcctgcctcagcctcccgagtagctgggactacaggcatgcgccaccacgcccagctaagttttgtatttttagtagagacggggtttcaccatgttggtcaggatggtctcaatctcttaacctagtgatccgcccgcctctgcctcccgaagtgctgggatgacaggtgtgagccaccgcgcccggcccacaggaaacatttttaaaagccggccggcagaatgtctccttagccttgacggacccgcttcctggtccctcagctgcttctgatgtttcttcttaagaaaaaataaaatgtggtgtacagtaacctttcaatgaaaacacagcatcccaggagactgaaagcctgccgctgtgtgtttccactgttcaacagctgacacagggattctgatgctgctgtgctgcttagtttctctgaacacactttttttttttttttttactgtactaatggtatgtcattttttctactgttaagcactcatgtgtgaataagtgtaagaaaatgatggcttatcagaagcatataaattcggagtcaggagctaggcatggtggctcacgcctgtaatcccagcactttgggaggccaaggtgggtggatcacctgaggtcagcagttcaagaccagcctggccaacatggtgaaaccccgtcactactaaaaatacaaaagtcagctgggcatagtggcgggcgcctgtaatcccagctacttgggaggctgaggcaggagaatcgcttaaacttgggaggcagtggttacagtgagccgagatcgcaccattgcactccagcctgggtgacaagagagaaactccatcttaaaaaaaaaaaaaaagtcagggatgatgacgatgtcaaacaaggagattgttcacatgggtgggtgacatagtgacacctttgctttctgatggtccaatgtacacaaattttgtttaatgcacaaaattatttaaaatattatacagaattgcctttaggccttatgaataagatgtatatggaacaaaaaaggaatttttagactcgggtcccatccccaagatatctcattatgtatatgcaaatattgcaaaatatgaaaaaatttgaaatccaaaacagttgtgttcccaagcatttcagataaaatacttaatttgtatgccaacctttcttgcctttcaaaccctaaatatagaggttacacagatccattaacctaatattagcacttattccaattagattccaagctcacagaagaaaggagcacagcgcagcttagtagaaatggggaaacaagcctagggatgccagttatacgctttgttcaaagtcacccaactaggctgtagccgacctagaactagcaaacaagtcttagaactcctcatgtttcagccattcaacagcactgaatattaactgtgttctagtctttgggaataaacaagatatttcagagatggctccctaaaagatattctatgtaaaacactgtgtgcttaattccatttccttaaaccactcacagatagttgaacaaacaataacatacgttgagaaactaaaaatatacctccaaatgtggaataaaagttttgtcactttcgagcgcaaccactttggcaccagcttcaagtaatgcctgagtcaggattccaggacctggcacattaacagaacgaaaagtttatttgtacaagaaacataatctctttcaataccaaactttcattagatgtttcacacgttattacctggtttttaaatctgacagcatccgcaaagtagatgtcactctcctttttacatataaggaaacaggagattatatatacttatttgactccagcgtcaaaagtgatgcagcttggctttgaaatcattgtcagcgactgcaaaacctgcactcttttttttttttttttgagacgaagtctcactctgtcacccaggctggagtgcagtggggcaatctcggctcactgcaacctctgcctcttgggttcaagcgattctcctgcctcagcctcccgagtagctgggattacaggcgcccgccaccacgcccggctaatttttgtattttaagcagagacggagtttcaccatgttggccaggctggtctggaactcctgacctcaagggaaccactcgcctcggcctctgaaagtgctggattacaggcgtgagccaccgcaccaggtcaaaacttgcactcttcatcaccatgattcactacctcttagaagaaaaaagtcacagcaaaatagattgcctctagcctatcacttcctcacggactacacggatgctttaaccatcaaagagattgtcaagcctaaacagaactgactccctgtgatatgaaatggtgctttaaaaaactatcattcaaaaagcctataaatcttgtgttcttagcatcctgctatggtctatagggaatgcacggaagaataagataacatcattttttcagctggcagaggcttgcaactcttttggggagataagatctaagagcatgttttatcaaaatattgtgtaaagtgcaagctgctacagaaatactttgtggtgtcattaacgatacagactctacgcttatgtagtgggcaatctctccaactaaggagcttcaaacaaagacccgtatctggacgggcgcagtggctcacgcctctaatcccagcattttgggagacctaggggggaggatcacgaggtcaagagatcgagaccatcctggccaacacggcgaaatcccgtctctagtaaaaataagaaaattagctgggcgtggtggcgcgcgcctgtagttcttgctactcgggaggctgaggcaggagaatcgcctgaacccggtacgcggaggttgcagggagccgagatcgccccactgcactccagcctggcaacacagcgagactccgtctcaaagcaaaagaacaacaaaaaagaccccccagtatctaaaatagcaccccgaggagggtcaatacgtttgaataaatgatgaacatccaagaaaatgcaattcagctggactcacctggattgcactccagcagtaggtgtggaggtctacttggttttcccaaatagatttgcgccagggtctcagccaatctccgatcggttacgtaacgcttaaagtctaagctggccttagacgccttccttggcggattcctgaaatccggttcgggccacagctgcggagaggagtcagagagcccacagtggttcctcgccggcaaatgctttcgcgtcgccgcttcagaccctaaaatgcaaaagcgaccagcgcccgccaaggcggagagcctcagccgccgaggaagcccgaccactgggatccacatgtccttgtctctcaggcccgctccaagaatcacctagtgcagctactacagtgaaccccacgcagggtatcccacgtggaacattttctggcgtccgggccaggtcaagcggaagtaaacactagagcctgcgcatgcgaacagcggagccttcctgcttttctccctcacttccgcttccgcctcggctcagccgcccgaggattgtgagtggaccgttgaggagagcgaccgaccatccggctggtgtccggactcgtactctatggttgtccgcgctctgcgcttcctctctagccgccagtgctctatgctccgcggtcgcgggccgccagcctccagccggccagccgcgaggggtgcgcagagggaggcggggcggaaaggcgagaggtgtctcctccaccggagccaggggagacccgagcaagctccgtgacagcacgtcggccgccatgtcgccgagtggggctggaaacagacccggcgcccagcggtagccctccttgcgcctccgattcccaggtgaggagaggaggagcgggatgcaggggacccgccggctcgcggccgggatggaaagcctttcggaagcctctcgctcctccccctgcgctgtcctcctccagccgcgcagcctctgccctccgggtgaggtgtagcccggtccccttacctcctccgcctctcaggtcgcctgttttcctctcctttctcagctactgtgggtctcctattgctgcgcgtcgcgccaatttctccctccctaggggactagcgccagaagtcgttcctcacccggctcctggaggagcctgcggcttccacggtctccgttcctttctgttgtgtggcccacagcccgctctccccaccctcgtggatggttttcatttcccccccacacctggtcccccccatcactaccactttggttgtcaagaaccgcgtggtgtctcccttccattcctctctctgggccaatattttccttaattttttcagtttgtgtgtttaaaagacttaaagttaagattaaaaatgaagatgtaaaagcttacaattcctttctaagcttaaaaagattaagactttaggatgcttactgtattccttatgtaaacttagtcaaacacatcgtactgtggaatgcgatttaaaagacccaattttgaagactaaaaataggatgctgtaatggaaattttggcagtctttttttttttacctattgggcaatgttagaagacacggttctttgagagtgttttccgtgtttcaggatcaaacttagagcttttacccattatccttaccaccaaggcaagaaacggcagccaatcaactccgtgtcttagaatacgtacaatcctttctgcttactctactgagagtgtaattgagtttggcatttaaatgcacgaggaaaaggttcctaaggaatgtatcacccagcaaatagtctgaagattatactcatctgatgaagctcaagcggataaagaattgacaactaaatatgaccttttgtgtattataaatttgttaggacatcatagaaaatatctcatcaactgttgtgcaaactgtggggactcactcattggtcttaatttgcttaaattcttttttcgtacagttttctcactgacaattttctagaggtgactttgcatcctctgaacctctctccattactgagctgcctccccctctccccttaaaaaacattttcatagattcagaaatacacttttttccccctccaggacctggagtcctaaatatttttaaatcagataaaatagaattatgtcttcatggttcactcatagaaatgtgtcgttgaatttctgactttttaaaaaaaacactgtggtggctgggtatggtagttcatgcctgtaatcccagcactttgggaggccaaggtgggaggatcacttgctgccgggagttcgaagccagactgggcaacatagactctgtctccttaaaaaaaaagaaagaaagaaaaagagaaaaagaaaaataaacacattgtggttaaaaacaaaacagttattttaaaatgcactgtcttatttcataatgtttgtggaccaaagttagcctactgagtcctagaaaaactgatgtcattttttattttgcttttgagtgttattattttctcttggttttgggaaagagaattacattataatattccctttttacagtgttgatggttcacttgtttgtaattgaaggtacttgaataataagagatttttgtacatcttattttttttctgaggtcccaggtgctgagaatgttgatttcaccttaaagatgaactttatgatcaggatttagacatactttattagaaaaacttgattagtgtgcagtatttcccatcttttttcttaagaagtgtggttttctatcctatgctgtttttgcctttttgaagtaattttgagatggagtctactctgtcgcctaggctggtgccatctcggttcactgcaacctccgcttttcgggttcaagcagtttctcctgcttcagcctcccgagtagctgggattacaggctcctgctactatgtccagctaatttttgtatttttagtagagacggagtttcgccatgttggccagggtggtcttgacctcaggtgatcctccgacctccacctctcaaagtgctgggattacaggcgtgagccaccacgcctttaaaatactttttttcttgctttttacatttaaatatatttatttatttgtgaaggcggagttttgctatgttgcccaggctggtctcaaattcctggcctcatgcaatcctcccacctcagcctcccaaaacactggtattacaggcatgagccaccacacccagcctcttttggcttttaaatgacaactgtaattgggaaatgccaagtgatagtccttgcttgctgttagaattaaggctgtaggtctgtagcagcagtcttcaatagaaatacaatgcaagccatataagtaatttaaaattttctagtagtggtattaagaaagtaaaaagaaacaggtaaaattttagtagtatattttatttaatcttatatatgttattttaacatgaaatcaatttttaaaatgagatattttacattatttgatactaaatctataaaatctggtattttatacttacagcacatctcagtttggagaagccacatttcaagtgctcaacagtcacatgtagctaaatgttaccttactgagcagcacaaatgataggatggtcacatgatttttaagctgtcttcctacactgagagtctgattctgtggggtaaattaaaaactcctcttcctgaagtactgcggtatttaatttgagaagtttctatgcaggaagagagttctaagtctcttccttttagtgtttttgttttgttttgtttgttttgagacagattctcattctattgcccaggctggagtgcagtggcagtcccggagccctgaactcctgggatcaaatgatccacctcaacctctcaaagtgttgagattacaggcgtagccaccatgcccagcctctttctcttagtgttgactgtgttaacgttgagccccatgcttgtttaatgaggctcataagatgaatagtgttcagtcatttcctggcgtgtcattgttactagttatttacatctgcacgtcaacagtgtgtcaaggcacagtatgagtttctgtcgactaaattgtagggagaacttgaggaccttcaagaagattgaactttattgtgaacaggtagagtacctgttgttgcagagttattttctgagtcagtttcaggtaaggctaagagttttataaatgtgcttctttatatcatggtgtttcttaccaagggaaagatcaaatctttgagcaaaatttagaaaggaagagagtaggttttatggctgtagaatgctgggagcctgagtaaagtaaaagattaacttgtgtatggtggtttaggggaatttaaaaggaaagatggcagtttttatataaagcaactgacatactgtctccatacgtgcttcaagttgtttttgcaacaagggtggtgatttacgtagaaccgtcagtggttcagagctgctgtaacaaaggtaactctaaagccagttaacctccatggggatcagtcagacccatcattgttcctgtcttgacctctgtgctctaataaacttccctaaatactactttagctgctgtgtgttatatctacattaatagctaaattagcctgaaggcctaattaatattcagtgtaatttaatacaggaaacatgccctcttctcaacctttatagtatgaagaaattttaaattacctggtcagtgaacaaactccctctgtcaaatatagtcatgatagacctggcacaatgtagggactatggggagtgttagaggatcaaagacagaattggggaaggggtatagttactggatgttacttgttctgtgagagatgtgtggatgttctataagaaaataataatgttttttgtttgtatttaaaactagatagctgtttattggcacccttttagttggataagagaaaatacattgcttggtttctacaagtgagtcttagcaaatttattgtagttattttaggaagagtaattgatagtgcagtaatcttcagtttttaaaaagccctgataaggtttaactgggctttaaaagcattatatgcttaatgagaaattctaacttaatatatgtatgtcttgatactgttatgtaacctttccagtttagggccttcaagattcacatgaatacaggctttcctttatgtaggaatcattctcatgggggaaattatatatcctctcagggaataattttgttttttaagcatttgaaataattgtttgtaatattcgttaaagaacacatcattagcagaattctgaagtcttataatagcttgagatttcttaaattgtttttatcctttttgagacagtcttgctctgtcgcccagggtggagtgcagtggtacgagatctcagctcactgcaacctccacctcctgggttcaagtgattctcctgcctcagcctcccaagtagctgagattacaggcgtgtgccaccacacccagctaattttttgtatttttagtagagacagggtttcactatgttggccaggctggtttcaaactcctgacctcaagtgatccgcccacctcagcctcccaaagtgctgggattaaaggcgtgagccactgtgccaggccaaatggtttttatcttagttttgagatcctgctctttaacattttggagatggaaactttttgccattataccctccacccttccgtctcttaggacttcctgtttttcatcatcattagccacgtggaaaggaaagacagtgtgtgcctatgaaaatactgacaaatcaagatgatttttccttttagattaagaaaaattctgaaacagtaaatggtaaattttgtcatatttatttacttattttagagatgaggtctcactatgttgcccagattagccttgaactcctgggctcaagtgatcctcctgctgtagcctcctgagctggggctataggcatgtgccacactgtctggttagtcacccttcattgacatttgggcatttgatatttaaattgacagtatctaggcaattatagaaattaacattattttgcaattggcatatgtattaaattttcttatgagaataattgccctgtttttttctggagagccactacctgattaaataatcacatattttttctaccttagctgcattttgaaaactcagtgaattaggtgactgtggttttctaatttgaatgaaggtaaagtaacctttaaaaatggtttttggccagtcacagccatgcctgggactcacgcctgtagtcctagctactctggaggctgaggtgggaggatcacctaagcacaggaggtcaaggctgcagtgaagcatgactgcaccactgtgctctgcactccagcctgggtgacagagtaagaccctgtctcaaaaatacatacataaatgaattaaatacttttttatattatagattttgaaataagttattaaaaaatttgggaactttataagatcaaatgctgctgtccttgagtatttgatagtatactgcttatattttgattttttgtatgcattgtccttgttcattatttttctcttctgcagcttttattcccagtatacaactaaatcttaaaaataatttttagatgaactgaaaaacattgcctaagatttttcaataaggatttttgtgaaaatgtgtgtggtttgttatttagagatgagatctcactgttttgcccaggctagtcctgaactcctgggctcaagtgatcctcctgccttgacttcccaaaatactgggattatagacgtgagccaccactcccagccaaatgtatgttttatttattgaataataaatagtggagttatttatttatgtgtgtgatatgtggtttttttaattattaattttttagaaaaatagaagcagggtttcgccatgttgcctagggtggtcttgaactcctgagctcgagcagagtgcctacttcagcctctcaaagtgctgggattacaggtgtgagtcactgcaccaggcctgagttatttgtttttacctcatgaaacaacaactaacattttagatttttttttccacttgtgaagcatgaaaaagtttacttaaattggatcttacaaggattcatgtaaccaacaggatttcctccctcagcgtcaactcacatgaaaagaggggtggacgtttgtgcaaattatactggttatgatattgtgaaatgtagtttcctggaaaagtcattattgatacccatttttggcatcttaattcaaattcagccatcaggctttattttaaatgatttacacagcaatctctagattcttcttgctacaagtattttaaaaattttgttgtggagttcttcggcatgccagttagagttatacctgtagcattggataagcactgtaaagagccaaaattagaggtaatacccttgctcttccctactttaatcatgtaatataggtcttgtgacttggaagaagattgtcttattaccattacatttgaacttttgttttaaaattaatctgttagatcatatattcaccaaagctcatcttttcactagccagagaaagctgtatttcaaaataacctaaagtaaaatagtatttaattcaagaagttagtttttattatatcaggtggcctcttggttggttatagtttcgtgcattctgatgcctgcgggctttttatccttcctgtctccactgcatagctggggaaaacctagggattgcccggtgaatgccaacagagctttaacctgtgtgtccatggcttgccttccctgaagcctcaaagagaacagctgcgagtgcaaaaaccttatgagcaaaatttctgctccaggaacacttatctgggctgaggaaacatattctaagaatatctgttttgtaactaaagcttccatgtacttgtgtaacgctttgtgtaaaaccacgtactttgtatagcctttgctggagagtttccattttcctccagctcttcagtgtaagtgaaaaaatgtgcccagaatgtctctatagattattctgccttccctcaccttttagttttttccatggaaagctgacaggtcagaataggcatattttattagaaactcgaagtggtggggggtagaagtacacatctttgcctcttttttccttcttgattacagaagtaataatgctccaaagatgttttttaataaaactgagtctcgctctgttgcccaggctggagtgcagtggcgtgatctcagctcactgcaagctccactactcctgggttcacgccattctcccgcctcagcctccggagtggctgggactacaggcacccgccaccgcgcccggctaattttttgtatttttattagagacgggatttcaccgtgttagccaggatggtctcgatctccttaccttgtgatccgcccgcctcggcctcccaaagtgttgggattacaggcgtgagccaccgctcccagccgctccaaagattttttaaaaagataaataaattttaacttgaggaaaacatggttattcaaaaattcgtgttttttctttttctttaaaaaaaattttttttagagacagcttgtcgcactatcacccaggttgccatgcagtggcaagattatagctccgtgcagcctcaaactcctggactcaagcaatcctcccacttcagcctccctagtagctgggactgcaggtatgcagtctaattttttttttttaactttttgcagagatagggcctccctgtgttgccccagctggtctagaactcctggcctcctccaggagcgatcctccagccttggcctcccaaagcacaatacgtgtatttttcagagggaattctcaactttcatcagatttttcaaggaatatgttactcaaaaaaggacaacaaccacagcatcagtttgacttggttggttattgcatgtccttcctaaatctctcttataagcagctatggctttataaggattcctatgtaaaagcatcatttttagtagtattttatttaaaacaaaaataatttaatagattatgaaggaaagtcatagtgagtcaaagaacaaatctgaacaaatcttcctcaagtattttatttatttatttatttatttatttatttatttatttttgagacagagtctcactctgttgcccaggctggagtgcagtggcacgatcttggctcactgcagcctccacctcccgggttcaagtgattctcgcctcagcctcccgagtagctgggattacaggcacccgccgccaagcctggctaatttttgtattttcagtagagacggggtttcatcatgttggccaggctggtcttgaactcctgacctcctgaccttttgtcaagtgttcagacaaaaacgtgcacaaatgtttataacagcattattcacaggagtcaaaaagtagaaacagcccaaatgtccatcaactgatgaatagataaataaaaggtggtatatctgtacagtggaagattctttggcaataaaaagaaatgaagtatcagtatatagtacaacatggataccccttgaaaacatgctgagtgaaagaagctaattgcaatagaccgcatattgtataattccatttacgtgaaatgtccagaatatgtaaatctatagagacagaaagtacatgagtggtttgagtgattgcctggggctgtggtgggggtgcaggagaatgggaaatcactgctagtgggtatgtagggcaggggggatcttttcggggtgataagatgttctagaattgattgtgtacaatttgtgaatactaaaagctattgaattgtgcattttaagtgggtgaattgtatggtatatgaattatatgtcgataaaggtgtcatgaaactcaactagaaaaaatacaagtttatcatagaaaatatgtaaaatacagagaagtggaagaggaaaaaagtaattagcatttttaaaaattccctatttttatttcaatgataaaaaataatataagcttattcaagaacaatactgacactttaaaacaacattctcatataagatttcagtgctctctgggcgcggtggctcgcgcctgtaacgcctgtaatcccagcactttgggaggccgaggcgagcagatcacttgaggtcaggaattcaagaccagcctggccaacatggtgaaaccgtgtccctactaaaaatgcaaaaattagccaggcatggtggcgggcgcctgtaatcccagatactctggaggctgaggcaggagaattggttgaacccgggaggtggagcttgcagtgagccgaaatggcgccattgcactccagcctgggcgacagagccagactccgtctcaaaaaaaaaaaaaaaaaaagaaacaaagatttctcagtaattggtggtgggagagttggatcctcacgtgcctatgataaccgtgcagtcacagtgtataccgtattccactagtgaacaaaactttaatttttacagagcagcatcgtgttcagtgactattattttaactttattgattttttttgcatgtcataattcgtaaatttgttttggtttaattgtgttagagttagaagcacataaaaattatgtttttacatccttttttttttttctgagatggagtctcactctgtcacccaggctggagtgcagtggtatgatctccactcactggaacctctgcctcccaggttcaagtgactctcctgcctcagcctctttagtagctgggaccgcaggcatgttaccacgcgcggcacatttttgtatttttaatagagacgggatttttccatattggccaggttggtctctaactcctgacctcaggtgatccacccccctcagccttccaaagtgctggggttacaggcgtgagccaccgcacccagccacaaattatatttcttaattctttttatcctattaccccttcccttggctaccaccccctaccctccacccacatccacagtgctttaagataaaggagattaatttcgcctgtaggaatccatgggaacttggccttcagacttcaggcaagcaccagagtggaaacatttggaagtctcattctaacatgtttttaccttaaaattttttaaaaattggattaggtttttatgtttttagaaccatcttgccctcccttttctagcttttgacgggacattgccaaattaataggctgttttgaagattactaagatgggcatctttcatttcagtagggaaaagaacatgtgctaaaggaattattcaggtgaaaatgcttttgtgattaaaaatgttcttcagaactgatacttctcatgaagtaaatttcaacagtacaagcaaaccctgttttcctgttgttatgactttgttgttctcacctgtcctccataccgccccaccacagcgtcactccctttatagcctcttcctactggtacctccttattccggttctctttctagaccctctactatcctctgtgtttattttgaactgaactttggattaaagtactacctttttgtagctgttactcaaagtttgtcttcacttgtgcttggaatttgaggttactctactgttgttcagactttacctttaaaattccaggagcatcctgttagtaaaacaatgagttttaaaaatttcggtaaaggtggtcataattcttacaggaaccagttttatcccatttagttcacagattttcattttgcctttttaatgggcatagaattctctttcatgtttttctgtagccgagaaacctagtcaagaatgtgaggtgaacctttcaagtaaaattgtagttgaagaaacaaaagtggaaaggctaggttaaaataaatttgaccctggcctaattccatttatctcatacccactttagaaaagaactaaaacagtctgtgcatggtggctcacacctatcatttctttgcgtttttactaattcatgcttcttttttggactttgctgactcgtccctgtattaatctttcactgacaaaaatatcctctgttctcaagtttccctcttctgtttcctaccagataatacttgtggtttttttgttgttaagtacattttaaacatcatctttagagatataaccatttttttctacatctgtttccttgggtaaaaggtagtgagagactttagtattgtagttcaattgaacaaacattaattaaacaccgttcatatgcctgggctatgttttggtgaggattgtaaaagaagtaatgggcacattctcctgctgcaagcattcaagcacttgaattccagatgggaaataatatatatgcatgaaataacttgagaaaaattctaaaacaataaataagcaaattcgagacagtgtctactaaataccaaataagttacagtgctttaaaataagctctaaaattatcgtgctctaaaaaatgggtctctgaaaatgtttcagtgtggattctgtattaaccattgccttcggctgggcgtggtggctcacgcctgtaatcccagcactttgggaggctgaggtgggcggatcatgaggtaggagatcgagaccatcctggctaacacggtgaaaccccgtctctactaaacatacaaaaaattagctgggtgtggtggcacgtgcctgtagtcccagctactcgggaggctgaggcaggagaattgcttgaacccgggaggcggaggttgcagtgagccaatatcgtgccactgcactccagcctaggcaacagagagactccgtttcaaaaaaaaaaaaactattgcctcaaattataattggcctcttctaaggctaaatagtattattacaatttctgttcctccttctcctcctaacttatcaaactcttcaaccccagctcaaattccatcttgcttatggaatctgccctacataccacaagcagcacagaatctggagccagtctgcctaggttgagtcctaattctgagaactgtttgactttggatgagttgctttacctattagtgcttcaaattgcttgtctgtaaaatgctagtgctaataataactacctaataggactgttgtgaggaattgttactatatgcatggcaaagcgtaagcactatataaatgtgtcttgttattctcatactctggtattacggtcacttctcacaatagacttaaacataaacatttctataaagtgatttatttgagcttaaatattttttggaattttatattttgtatattctgctctataatagctgtttgtgttaacataaaattagcatctctcttccatcctcacctttagaagtgaattgatgttaccagagagtgtccatttatcatcctgtgactttgcagatccctggtcagctttttctctttcctgtttctgttaagtatgtattcattctgccttgttgcccattaggttctgcatgtgtgcttttcactaccttattataagctcttcctcccaaggagcaatgctgtttcagtgatgacaacaaatgtgattattgaactcttagtgctatgcatcttgctatcactagaaaattcatgattcacaaatagccagtagctgggctaggtggctcacacctgtaatcccaacactttgggaggccaaaacaggaggatcacttgagcccaggagttcaagaccagcccaggaaacatggtaaaactccatctcttctaaaaatgcaaaaatggtgggcacctgtaattccagctacttgggaggctgaggcaggagaatcactagaacctgggaggcggaggttgcagtgagccaagattgccccactgcactccagcctgggcgacagagtgagactctgtctcaaataaataaaaataaaaatcacacagagtcctcagcagagtaaataaaacaaaatttctagcggttgacatctggagactatttacaaggatgttcttaatttatctttatggatgactttagcagtttcccataaattgtctcattttattcttacagcaaagaaacaaaggcttatagagttgaactaatttgactaagatttcacagctggcgagtatcagaaaactgtatttgcactgagaagggaatgactccaaaattagagcttcctttcttactgctctgtcttatctctagtcttagttcttgttttgaaagggaacttctggtacttacgaatgacggggcttatcttcttgaaagtggtaataaactgtactaaatttctaaggttaaaaaattaagatgtaacattaccagttttctcttttattgatggtttccttagattttttttaaataaataatctcttgtacctttttttgagaactgtatgtagatttcattctggacatataaatattaagggttaggtagcatttaaagtatttgtggtcagaaattaaatgaatgcatgaaatactgtactcttttgagtaaattctaaaaataatccctaatcatttcattacagacagttggacattattttgccatttaccaatatactttttttttaatataccttaaagaccagagagaaaggtaagaacagttatgaaattgcacttctctgattagaagacttattcaggaggactggaagcagaattttcagacgtttctttctaaatggattctattaacttccacagtactttgttcatagcagaccttcaaatatttggttggcttcatgcaaaaaggaggtatctctttactcccttctgtattgctgatgctaattgaattatcttttaaagattcagcatattttacggggatttaattttgagaacattggtgtctttctgaaggtttctttttttttctttttttttgagacagtctcactctgttgcccaggctagagtgcagtatcatgatcttagctcactgcaacctctgcccccagggttcaagcgattgccccgcctcagcttcctgagtaactgggattacaggcgcgcgccaccacacccggctaatttttgtattttcagtagacgggatttcaccatgttggccaggctggtcttgagctcctgacctcaagtgatccccccaccttggcttcccaaagtgctgggattacaggcatgcgccaccacgcccagcctgaaggtttctttatagcatgtaaaaaaaatgtaattcatcgaaatatccactcacatcctgatacttccttgagtaataatcttctgtctttagttgctatttctgtcctgtattttcattgcaattgtatgcttttcttctttaaccattcccatacatggatatggtaacagccacattggatgaaacttcatcagtgtctccatgctgtattttttctacccataccaatctttttttttgagacggagttttgcttttgttgcccaggctggagtgcaatggcgcaatcttggctcactgcaacctgtctcccgggttcaagcaattctcctgcctcagcctcccgagtagctggaattacaggcatgcgcctccacgcctggctgattttgtatttttagtagagacagggtttctccatgttggtcaggctggtcccgaactcctgagctcgggtgatccgcccaccttggcctcccaaagtgctgggattccaggcgtgagccatcacacccggcccatcccaatcttttagaaacgtagtctgggtccttgtaaagcacatggttgcttaaaaacattccattacagctgcaaactcctaatgtgttctagaggacattgcattttacattttccatttcttataaacttttacaaaagcaatataagtaaatagctgataaagtgttctttgtggctttgaagaaacgttagtagcttaggagatgccctttaccagcagcccgttagtacttggtttatattattttttattcatatgtctgagctggattctgtagggagaaatgaaaaatgttttataggcaaaattttatgagatgtctgctaatatcataggcaaaagtatttttgcaatatgtattatatctaattaatttaatggtatccagtataatataatatcctttaactggggtttttttaaatagaagtgtcttttcattacagcttaaaagatggttgtaaactttcatataagtcaagtacgcagttgttaataaccttatatgtatgtactccttatatttagcaagatgaaatttttcagatccatatgctaagagttatcagatttactggcccttcacacaaatcaaaaaacgaagttaaacacgactttgctgttgctgtttttctttcctctgccttctcccactgtattctatctctcaccatctgttactgacagttatcagcatagagtgacctgtacctggaggtgggttcataactgtcttttaccttccacatctactcagtcctgcaaactgtgaactccacctccatgcttttttttttttttgaggtggagtccctgtctcccagcctggagtgcagtggtgtgatcccggctccctgcaacctccgcctcccaggttcaagtgattttcctgcctcagcctccctagtagctggaattacaggcacgagccactgagcctggccgggcttacgttttgtatccttctcccctttaccccctagtaattggttcatggcccactaggggaagaaaagatggtctttcacaacagatagtctgaaaagcgctggtctcaattcctgtactgggctctggccccgcctccgtttatcaggctcgtcactactttacttcagcactcttattccaaagtctaactattcgctgttcattctgtacttcctcacctttttatttggtcctgtttatttcttctcttgagattacctctccatgcacctcaggtacgagtagaatggagggaacacaccatctcagagctgggttacaatgtcctcttgtccagtgttatctgctatatcaacatttcctccagaccgtggctgaagatgaacaaggcagctcagcagattgaaggtgcctggggccagcactcattcgccctgtctgagaaacgcagggacctccctgaccctgttgtccgcccgttagcgtgatgagcagctgtggatttcatctgtgtttcttgggcaggggggcctgtaggtatagaaatggatactaccaattggattggctgatttaatacctcatgaatatcagtaccttcatgagtattttgtgtctcctctggtcttgtgaatatttggtggttatgagtgctttcattccttcctgtgtttaccatacagatgccctgtttactttctctgtgtctaacttctcacgctgtttgctctgcacttattttcatctcttttatttgtatctttgattttctgtaatggaattggatattctcaaatattcacgcattacacctttccacagtaaaagtaaccttcattcctctgactctcaaagaaattgcctgtcattgatcacattcttctttgtagcaaagtttttttgagagaagaggaatgttagggcagggtttatagacatagcgtataattcattacctgctagagtatcagctcttgtatttttattagctacttttagaatatatagtcctcagggcatgttgtgtctcatctgtctctctcttgcctcattgtatttagtatgtggatcttgtttgttgtagacactcaaaattgattaccctgaaggctggtgaagtttagttaaagctctgaggtcagagttcagtctcatgtggagacttatttgctttgtttcatgtcctcatagtaaccttgaatgctggccaagtggcttttggttacaaagagcactgggtaagacaaagaattagcacttgtattgcataagcagtttaaaaccagtgttcctctgaatgtggggcaggagcatcgtgttcccattcaaagggcaacattatatcataatttttcaagataagaaaaagtagacaatgaggatggcagaagaaaatatatgtgaatttgcctgtaactgtactttttttttctttttaagaggcaaggtcttgctgtgtttcccaggctggagtgaagggatggtcatagctcactgctgccttgaactgctgggctttaagcagtcctcctgccgcagcttcctgagtagctagaaccacaggcacacgccaccaagctcacctaatattttagagtgtctgtagagatggggtctcgcttcaagacccaggctggtcttaaatccctggtctcaagcgatcctcgcagagtgctgagccaccatgcccagccacatatgttggctttcttgtataggtataagaattcagtgatgtatctatgttagaagaatccgaaatcgctaagaaatatgaaatttcaaattcacttatataagtcaacattttaagaattaattttctttaagtgaagtaaaccaggggcaagagtttcaaaaaatgcattcagatgtccacataaagtgggaagaatggcggtgcagtcaagaataaagagggagcacaaatgaaaattggtgtcgagatagactgaagaaacctggtctttccattatgatgaaaaaaattccagcgtaggtatcagtcttattgatactttgtactcaagtagaagattaaggtacaggattcttttagccagattgtggatgatctgcatgatgagattgatttgaagacagtgtatgaaaccaagtcgaatggagacggagtgtgtagtggaactcatctcagtagaccgtcccggcagccctgcagtcctccacagctgccaggacagttactgttcagtttcccacactggctattttaaaccttctatatgctccccaactccttgctcccaacataccactccctccctgcctccggtatatggatctcctatgagtctgtttctgctgtttttttcccccagttttcttttttaaatcaagacgtgatctcttgtatgcctggttgttttggattatatactgaatattacatatgaaaagttgtggaaatagtttcagcctttgctggatttatcttgcagagaggattgactttagtttctggcaggcaacaggttagaacagaccaccttaattcaaccagagattagatgattgattctgctgggccttagtccctgtgagcactgatctatttcaggcttgccttttcttctggggagtatcacttttaggtcccaccgcaaggcctgtggtcccctcttcttggaagacctcgaactctggtttttcgtccagctctgtgagcctgctcaacactctgctcagcttttccggcttccaaactgaagctttctgccagcttttctagtgatcagcaggaggggtttgtctgaaatgagccagtctgcccttgccagaagtacaagctttcttatgtttgtttttgcacatgtttaaaatgacagagccaggtgctggctcacatctgtaatcccagcactttgggaggccgaggcgggcaaatcacttgaggtcaggagttcgagatcagcctgtccaacatggcgaaaccctgcatgtactaaaaatacaaaaattagccaggcgtagtggtgcatgcctgtaatcccagctactcaggtggctgaggcggcagaatcacttgaatcgggaggcagaggttgcagtgagccaagatcacaccactgccttccagcctgggcaacagagactctgtctcaaaaaaaaaaaaaaaaaaaaaatatacacacacacacacacacacacacacacacacacacacacacacactatatatgtatacagcataagtgcatatgatttatgaacagatatacctacagtgggtatactcaacgatcagtttctttgcctacgctgggcgtggtggcatacatctgtaatcctggcactttgggaggctgaggtggcaggatcacttgaggccaagagtttgagaccagcctgggcaacatagtgagactctgtttctacaaaaaatttaaaaattagctggatgtgatggcacgcacctgtagtcccagctatttgggaggctaaggtgggaggattgcttgagcccaggagttcaaggctgcaatgagctatgaccttgccactgcactccagcctgggggacaaagtgagaccatgtcttgggggagagggggagatatatatatatatatatgtgtgtgtgtgtgtgtgtgtgtgtgtgtgtatatattactgatagtatgcttataagcaaagatatatggtatatctttgatatgtatctttattatatagtatatataatatataccttttattatatctgatatatattatatataaagctatatatctttgatatatttctatatataagatacatatacaagctctatcttatgtatcatctatatcaactttatatgagataaataagatacatagatatataaaagatctatatcaaagatatatcaaatatataacatatcttttatatatatctatatatgatatatatgcaagctatatcttatgtatctcatatatatcttagctatatctgagatatataaataatatataaatatataaatataagtacaccaccaaagtttggagactcttgcatgttagtccctcttttttaacgtgatgttggttcagtaagtatctgtggcctgcctggtaaaaatttttctaaatgcacaaagatgaatgtcagagatcttacgataatttctaatggggcggttatatagcccaacatataaacctgaagaaatggactcataacattaaaggaatgcagcaaataaagagtcttattggtgggttttatttgctgtgtaacctatttttctacattgtacatatttggaaaacatctcaagatattggaaattgttcattttgtggcctccttaaagtagcaatttggtatttacaacatatacacctgaaaacagctggtttttaaaagtaatttaaaaatgattatagtggttaaggatacaggctctggaatcagattctaaattgaatcctggctttgccacataatagcagcgtgactgaggcctatgcgtttaatctttctattgctgtttacttctataaaaaatggaaataattttagaactactttataggacttataaggattaaattatatatatgtaataaacttaaaacactgatacttagtaaatcttcaataactgttaaagagatggagtcttgctatgttgcgcaggccggtctggtactcccaggctgaagcaagcttctcacctcagcctcttgagtagctgacactacaggccacaccactgtgcccgactagtctcagcattttattcagataatgcaagctattttgtcaggcatcttaaaagaaggttctaataaattatttgcttttgccattgtattttcaagaattgacattttaaaacaatgtatagttttatgtgtctatttaatgagtaaagtataagacagtttccatgaggatatatagttgatacaggcagtaaacatgatttttgttttaaaagaggtggctatagtctgaaccaaagtattttcaagtcttagattctgttggttgtggcttaaaagaatgattgcagtacatttttacaacaaagaggtatttaaaaccaaataagcacaatttggatgtgtttacttctcttttgtttatttaagtaaaacttgtgtatatctgtgcataagagaaggaaaagagaagagagatgactctttatcttcatactgcttgggtatacccacaatgaggcttttgacctgtcatttccatttatgtaatggattttgaactcaaaagccctgtaaatacataagcgatcttgaaccaagccccattgtgaaaggcaggattgaggaatatgaaacaaattatgcttcctttcattcactttatctgccccaaggtttttttcggaatatgagtcacatagtttcagttaatttcttcatatttttaacagtgctttctcttcataaccgaaaatctgtatttgatgtttttttcccttagaatcattatcttcacatttattcttgtttttccttttgtgtcttgtaactttgtcacatttttatccttcttgcctaccttatagcataaattttctcttctgtggcctttctttttgctaaatgaagaactaaatctttatgaaattatattttttatttttattaaagaaatgttaaaacaatgtgatttacttttatactgtactattatgtagaaatttaagtatttagaatgattactgaaaggccgttttactagttttaatgacaatactatttaacttttatgaagtgccaggggtatttggaatatggggaagtacaaaaaaaaaggaacagcatgatctagtgatttacattgtgaatatgggaaataaggaggtaaaaattaattttaaatagtatctatttccttccacaagtatttgcatttgtttaattacagtaataataatatctatatccaggaaatacctatagcataacttgtgttagcaaggaagaatccagaatggagtgattcaccatgagccatatttggctactgtgacactgtcaaggcaatgtcatagacagcagcatcgtccaatagaaatatgtgagacatatatgtaattttgtggtctagtaaccacattaaaaattttcaaagggaaaattaattttagtaatagtttattcaatatatctaaagtattatttcaacatacaatcaatgtgtagaattaataaattcttttatattgattttattcatactaaatcattgaaatatggtatgtattttataaatgtagcacatcttaatttggacacaattttcattggaaatgcttgaactatatttcaatttcataaaatgtacaggtgaaaaacattcacatacccaagttattccaaacatacttgagtttttcagtaactgaattgatgtccatttaaaaatttaaatttattaaaatttataaaaatgaaaaattgagtccctcaatgtgtgttcatatttcaggtactcaatagccctgtgtggttagtggctaccattttgaatagcataggtatagaatagagctcacagttgaagatgtcagctaagaaaccctgaatcattattattattgttttattttattttattattattatactttaagttttagggtacatgtgcacaatgtgcaggtttgttacatatgtattcatgtgccatgttggtgtgctgcacccattaactcgtcatctagcattaggtatatctcctaatgctatccctccccctccccccaccccacaacagtccctgatgtgtgatgttccccttcctgtgtccatgtgttctcattgttcagttcccacctatgagtgagaacatgcggtgtttggttttttgtccttgtgatagtttgctgagaatgatggtttccagcttcatccatgtccctacaaaggacatgaactcatcattttttatggatgcatagtattccatggtgtatatgtgccacattttcttaatccagtctatcattgttggacatttgcgttggttccaagtctttgctattgtgaatagtgccacaataaacatacatatgcatgtgtctttatagcagcatgatttataatcctttgggtgtatacccagtaatgggatggctgggtcaaatgatatttctagttctagatccctgaggaattgccatactgtcttccacaatggttgaactagtttacagtcctaccaacagtgtaaaagtgtccctgtttctccacatcctctccagcacctgttgtttcctgactttttaatgattgccattctaactggtgtgagatggtatctcactgtggttttgatttgcatttctctgatggccagtgatgatgagcattttttcatgtgtgttttggctgcataaatgtcttcttttgagaagtgtctgttcatatccttcgcccactttttgatggggttgtttgtttttttcttgtaaatttgtttgagttcattgtagattctggacattagccctttgtcagatgagtaggttgcaaaaattttctcccattctgtagttttaatgaactcctcattaaagaaggaagaggctttattcgggcgggagctttggcagacttgcatcttaagagccaagctccctgaaaaagaaatccttggcccttttaagggcttacaactctaaggggtccacgtgaaagggtcgtgatagatcgagcaagcgtggggagcgtgactgggggctacatgcatcagctgacaggacagaaagtttcgcagggcttcctcatacgatgtctggaatttacagataacacaagtagtttaggtcaggggttaatattattattatttttttaaccaccagggccaggtggtggtgccagggtcgtctggctatttatcttacttctgtttctttccaactttttgctttctcccttttcgcctgtcttataaactaggcaaaagtgggagagaggagggcagcaggagaagtggtggtctccttccttaatggtatagggtgaatattttatcttgtacttttcatggttttagagactgtactttacatgtttctaaagattaagcatttctactcattaagttgaagaatctttagaagtcctctcactgaggtttttttccagaattactggattatttctttcatacctatcatttttcttaaaatgtaatacacttgtagataataagaggaaataaaagatgactgataaagggcttgcagtctgttttgtaaattttaaaaatattagtggtatccttcaagcagatttagcatttcttccaattctacactaagagtagcctagagttaaccatggcctttttttttttttttttaagtgttcaaaaggattttgatgacaactctaaggtaccttccagggcttatttttaggaaataaaaaataaaacgatagtataaatatatgctacctaaacttcccctcacatacttttttctaggttatttttttttaaaatcttcaaacattttcatttccaaatattgctgctgtttagccagagaagaacttatacaactagctttcagttgtctgctgagtgtccagggattaacataagagactaatttcagcacataacctatttaactagtcatttcattcaggcagtggtcccaacctgatgcacattagacttacctagagaacttgaaaaatagtggtgcctaggttccatcctcagagattctgatgtaatggtctagaatagaatttgggcagcctctcaggtgatcatcatgaggagacaggcttgacacctgtagtattcatgtgagaactagctgagtttggggttgggttgcatatggtgaaagggaatgaacttaagtcatttccttctcttccctatttacaatgaaacaacctaagagaaggggaaaatcaaagatcactgagaatctgcaaaggttagaaaatgaagtagcttttttctttttgtcattgtagacatggaaggtctttaatgtaactttaaatggttcaccaaaggatgctctaatggatgacagcgatactcctacatattatctgcaaatagaaccacaagatggatgtcatcctggtgacagcgtggaaaggagtgtgacctgtctgccttctgcatcagatgaaaatgaaaatcagcttgacggggacgggcatgagcatctgaccagcagtgacagtgcgatgggaaagccccaagtgtctgagcaggacagtctcaataataatgaaagctgcacattgagctgcgaggtggctgcaggtgagaacttgcaaaacaccctttgtgaagcctccagagatgaacaggccttcttgggaaaggacaaaaaaattcctggaaaaagaagtccaagaagcaaaaaagggactgctaagaagataccaccaggtattgtttaaaatagtatttatcctcttctttaattaattaaaaatgaacctccttccctcccatactgtgtttactgtcctgcaccttgcttctttgcttacgatattctggagctagttccgccgcagcacaagtagatccaactgcatgatattccagtgtgatacgtctccacactgttccaccgtatgggtgtaacacaatttatttaatcacttccttatggcccttcccagtcttttactatcataaacagtgctgaggccgggtacggtggctcacgcctgtaattagcactttgggaggccgaggtgggcggattacctgaggtcgggagttcaagaccagcctggccaacatggtgaaacgccatctctactaaaaatacaaaaaatgagctgggtgcagtggcgtgtacctgtaatcccagctactctggaggctgaggcaggagaatcgcttgaacctgggaggcggaggttgcagtaagccaagatcacgccactgtactctagcctggctacagagtgagacttcgtctcaaaaaaaaagaaaagaaaaagtgctgaaattgacatcctttgtacatgttttcacattaggtactttaaatatatgcagcctcctctccctcctttataaattagaccattttctaccaatatcaaccttaaaaattgccttctgtcattcctgtggctttgatccctaacctgtgagtttagatgctactgtgacctctttatagatctttccatctcactcagcaggtaaataaaatacaggaacatatattaatgtacaatttaatatgtagtgttgaataagacatctggttctaattatctgtatcactttggttaaaaagtaattcagagtatttcttgtttggtatgcagtttggcagttgaagtttagagctatggaatttttggcctgaatcacagggcccccttgggaaaaggcagcctctggttattttttttatcagaaacatatgggactagaaagttttggtatgccctagactggattccttagtgtagtaccactttttacccaagccaacagattttacatcagactctagtgaactaagtagaatgcctcttcatcttctgttctcttctttggttaattagaaatatatctgtctatatcgtattttttatttgtatttttaaaatttgaagtaaaatacaaaacttttcagtttctacaaaatccatatttattcaataaagtaatttgaaaactttttaatataattcataatctggctttctggttaatgtaactcataatttggcttttcacgtccctgtatctttttcttagtagactcaaaataatttttaaccagggatatgaaagctttttttttttttcttttttttgaggcgagtctcactctgtcacccagtatggagtgcagtggtgcaatctcagctcactgcaacctccgcctcctggattcaagcaattctccttcctcagatgattctcctgcctcagcctcctgagtagctgggatcacaggtgtgcaccaccatgcccagctaattttttttgtatttttaatagagacaaggtttcaccatgttggccaggctggtctcaaactcctgacctcgtgatccgcccacctctgcctcccaaagtgctgggattaaaggcgtgagccaccgtgcccagcaaaagcatttcttaaaagatctaataagcagaggatatttacagtactatgtatatataaatcagtttattctataactatcattcaagggcaaattcaccaggcctctcaatctgattttgtgattttattttattttcaagacagggtttcactctgtcacccaggctgaagtgcagtggcgtgaccatggctctctgcagccttgatctcccaggcacaagcgattctcccacctcagcctctggagtagctcggacaacaggcatgtgctaccatgcctgactaatttttcttttctttttatttttgtagataaagaatctcgcactgttgcccaggctgatcttgaatttctggcctcaagcgatcctcctgcctaggcctcccaaagtgttgggattacaggcatcttgtgatgtctttaagaactgatacttagttgcatacctatgagtcagtcatagctttaagattgtgagtccttttactcctcccttccatggtctttattccacttttcttaggtgtgattatattattattatatttattttagagacaggatcatgctaccttgcccaggttagtttcaaactcctgggttcaagtgatccttttatctcagcttcttgagtacctgggactacaggtatacaccagtgggcccagcttataatttaaagttatttagtatttataatactgtgagaagatatgtttagaattactattccctaatgcatttgaaacatatgatttataaaatctagggatagtctttatacagcttactttaaacattattttctatatcttatataaagtgagtttaagagagtaagaaaggccaggcgtggtggctcacacctgtaatcccagcactttgggaggctgacagggcagatcacttgcgctcaggagttcgagaccagcctggccaacatggtgaaaccccatctctaaaaaaatacaaaaattagctgggcctggtggcatgcacctgtagtcccagctacttgggaggctgaggtgagagaatggtttgagcctgggaggcggaggttgcagtgagccaagatcctgccactgcactccagtctaggcgatagtgccagaccttgtctcaaaagagtaagaaaacagaatgaggagttataaaacccaagtacaaatcttatgattccaggtcacttggtgagactgaagcagtctctaccttgttgttgtcgtctgtataatgatgatcttcatctacctaaatctatgaaattcctttttaagctgtgagtttcttagatttcatagtagagatggtatactctatacttgaataaaatgtggtgattcacctctagtgcatctatagagtttttatattttacagatacatttttgtttgtcttttaagttttgttgataaattaaaagaaaggatactcctgtctgcccgggctggccatggacgaggcgggactgagtgtcctggggtgagttagcagggcacaggtgtttgagatgggggacccttaattttaaactgaataggattcttttgggtgtggaattaatcctttctagatgtggaagagacctagaatgggaagaagctttagtattgcctggaaagcttccctcagagtttagttgctgggaccccaccctaagaacttgcttcagcctgtcgtctctcagtacgtatccatcacccggtctgagtaatgttatctccctgtgatctctcaagtcagtctgtttctctccatcttcactgccacagttcagcagcatcttcagctggagtactgcaaaagccccctacatttgtttcccatcttgcttccatcctccatgtcaaaaataatgcaaagagtttatgcataggagtttagacaaggatgtgtttactctaatttttcggttaaattcttagctcctaagtaaataaagtttcaaatttttcagacgtgtacttttctaataattgaatagcttctcaaatgtgaaatgacatataaaaaacatgatattcagttgcaaaccagaaatgcagttttttgtaggtagatgttcttgtaacactttttagaaaatgtaaaatataaaaataaagaaaaaaaagaccaaaaaaaagaacatgtaaaataaagtaaatttattcactctatgctcccttgtctagtttaatttgtagtcatttttcaattactactgtccaaaggctagtactggaaaaaaaatgatagtgcaggactcttgtcactaatagtcatgtcattcctaatagtcatgtcattaggagacatgtcactgtttatgggtttgctggaggcagtatttgtgtcaatgggtaaaaccttgatcttagcctcagggaagtccagttgtcatcatataatgagcttttttttttcccccttaagagaattgaatccccttgatatgcttaactaagcaggatttcaagctgtgttacaacaagttttcattatagggcgggtgcactggctcatgcctataattgtagcactttaagaagccaaggtggaggattgcttgagccaaggagtttgtgaccagcctgggcaacacagggagacctcatctctacaaaaagtaaaataattagctgggcatggtggcacgtgcctgtagtcccagctacttgggaggctgaggtgggaggatcacagcagcagtgagctgcatggttgcaccactgcaccccaacttggagacagagtgagatcctgtctcaaaaaaaaaaaaagaaaaagaaaaaatttttcactgtagttaaaatggcaaagctttaggtaaatattatcctaaaaactaatgaccattacttatttattattatttttcacattcttacctggggggagaaaaacaatggaaattaatgtgttttttaaacagttttattaagatgtaattcatatacatgcaattcacctacttaaaatatataattcactgatttttggtatactcacagggatgtgtaaccatcagcagtcaattttagtatgttttcttcaccacacaaagcagccacttacatattagcacccacttcttacttccacttagacatcctaacctgaggcagccattaatctacttactttttctacagatttgtctactctgaacattgcatattagtggaatcatacaatagaaggtctttgactggcttctttcatttaacatgttttcatggttgacccattttgtagcatatatcagtactttgttcctttttgtggtcagataatattctgttgcatggatagaccgtatttcatttatacatcagctgagggatgtttgggttctttccactttttgactattctatggacattgctgtacaagtttttgtagagacatgtgttttcatttctcttcgttatatatctctaggagtggaattgctggatcatatggtaactttatgccaaacagttttccaaagcaactgcaccattttacagtcctgccagcactgtatgagggttacagtttctctccatcttcaccaacacctgttaatatctgactatttgattatctccatgtagttttaaaaaacttgtaattcgtataccataaaattcacctttttaaagggtacaatttagtggttttagtatattcacaaagttgtacaatttaattccagaacattttatcctccaggaagaaatcacgtacccattagcagtcactcctcattcttcccttccccaagcggtggctaccactgtcccataaagtttgtatatttgtatgagacaagtttagatgatgtgttttatggttgtcgtaacaacactagatatttactcagcgctagtcaccatagtatcaaagcatttaacaaaacagttcagcaaatggcgggaagccagaaataggcagcacatggaaactgggaagggaagacctttctcaattgacctgccactatcagtgccctgacttgtttctctggaggccttcacagtgtggccagctgaaggatgacaaggaggctagaaccttaaaaagcctgagtcaggctggtgtagtgagaacaaagactttggatttgaatcttggttatttgagtctcggttctgcctgttcttacctatatgatcttagaaaaggagctcatttccctgaaccccttttctcatctgtaaggaaggctgatcctacatgtcttgcaggattgtccttagaatgaatgactctgtatgtaaagcactttgtaaagtacccagcataaaacagcttcttctaaatggtagttgttgtgtttatgtgtgtcacaagatggtatttatttatttatttatttatttaagacaggattttgttctgtcacctaggctggagtgcagtggcgtgctcgtggctcaaaaacatcctcaagttcccaggctcaggtgattctctcacctcagcctcccaagtagctgggactacaagcgcatgccgctgcgctcagctgaattttttttttttttttgtagtggcgggtttttgtcatgttgcccaggctggtcctgaattcctaggctcaagccatccaccagctttggccccctaaagtgctaggattagaggcaggagccactgcaccagctacacaagatgatttctgagtggcgtgactgggagtaccattaagcaaaattaagaaattaatttgatttgactttaagtccattttacttcttttgtcagtacttttttttatttcctaggaactttttaatactgtctcttttcagatgtacctgtccctgccccattcccctaatgtacattcctaaaaatatatttccagttccatactagtttaatgtcagatgcaacctgctttttgggatgttaactgatatcaaaagtaataactagtaatgccataaaatatgaatccccaaaggcctatttgcatttttatatattgacttcggctatagtagaacattgatagctggcctctaaatcagctttatggagacaattgggtaatatctgtactggccagagttgagatccctgagattggtggggactgtggtgaacaggagtctacatcatgccctgcctaagtgcattcaaatttttaaaatgtaaatgcctggctaagcccctgtaagcagaatgatagggactggggttgatgttttgtgattgtaacccattctactcactaggtagatagacggacagtttaactcccttaggagtacataccacactttcagaattcagaagtcctggtttaccttatttctgctcctagtagatgttccacctcttttaagttaacatttctttggacaatgacatgcagaaacagtagcctctcattttactcttccttctttaagggattgatcaatgaaggcaggccatgtcttttctgaaggtcagctagtaagaatagaataaagagttcctgatttatatagagtcaaataatttcacagtcagaagagacttcaaggtcactagccaaaactgtcttaggaaaaaaaaaaaaaagccccaatattaaaagtgtgttagttttctattgctactggaacaagttatcacaaatttacaaatctagtggctttaaacacacgacaacacaaatttattatcttacagttctgtagatgaagaatctgacatggttcctactgggctaacatcaaggtgttagcagggctgtgtccctttctggatgctccctgggagaatctgtttccttgccttttccggattctagaggcttcccacattccccagcttctgttacccttcctccatcttcaaggccagcagtggctttgaagtgagctcaagtcctcacattgcatcactttgaccagctgacacttctgcctctctcttccacgtttaaggtcccttgtgattacactgggtccacccatatattgcaggataatctccctttttaaagatcagctgggctgggcgcaatggctcacacctgtaatcccaacactttgggaggctaaagcgagcagcatatttataagttctgggtatggggacatgggcatctttgggagctgttattctgcctaccacaaaaagattttaatatagactagatgataactttacataacagaataattcttcactttataaaagtttttctgacattattttgtagacccgtacaggattacatagtcaatagatatttattgagcattgttgctgggcactataaaactgctggtgcacctccctttcagttttgtatgctcaagtgagggagccacgtaactaacaagtgcagtctagcaagacgggagtcataagtaagcacatggtcgtggaggtaacctgtcctggagagttagagaaggttgtcaggaggagttggtatctaagctgagttaggacaaataggtgctagtgaagtaaaagcaatgcggacaaagaggagaggaaggacgtcagagatggcaggcgtaccatgggctagagctcacaagacaagaagagagcatcctacatttcagtatctgctaatattcctgcttgagcagaataaaagaaaagagtgaatcaaggggaaatagtagagagtagagcagtagagagatggaggcttagaagattagcaaagtccagcttataaattgtttttaacatgaccagtttgggccttaacaacaggtttgaataagggaattgcattttttagaagattcctcagtctgcagtgtggagaattggttggagcaatggaagattagaagtaatacagagttaaggggttttacagtaacatctgccagagatgctggtgatctgtaatgagagagtagctgtacggctggagagaagtaagtgaattcagagttactaaggaggtggaattaacaggactggatcattaattagatatgaaaaaaagagtccaggataatctaattctcagttatctggtttaagcaccaggatgcttgataatgccatttattgatttattgagcataggaatacagggagagaaagagcaagtttggagagaagagagtagaagacagtgttgtgcttttgggtcaggtgtctggggtgtcgtagacgtctgagtagacctgttaaacaggcttctggtcttggctagagatacagatttgggagagttgctagagagggccttaaaagtgacctagtctaacttcttagattttacatgtgaggaagttaaagatttaattgagagaatacattgttcatttttgcaggagacagaataagaattaggatgtgaatctagggctcctaatgagctagaatgtgttttctatgcatcagaggcctacttctcccaccaaacaatgagacgccaggcatggtggctcacacctgtaatcccagcactttgggaggccgaggcaggaggactgcttgagtcaaggggtttcaagaccagcctgggcaacacagtaggacctggtcttttcaaaaaataaaaaaaatagcaggcgtggtggcatacatctgtagtcccagctactcaggagactgaggcaggaggatcacttgagcctgggaggtcaaggctgcagtgagccatgatcacgccactgcactccatcctgtgacagaatgagactcttgtctcaaaaaattaaaaaacaaaacaatacaaaacaatgaggttctgttggtagggtaaaaatgatgatgagccaccaactgttagtgattttttctattgtagaaatatttgccaagcattaggaatacagtaaggacaaagcagatcttgtgcttaccctcctagacccctggtggagtccagtgggaaggcaggtattaaataaaattaatggcctggcacggtggctcacacctgtaatcccagcactttgggaggctgaggcgggtgaatcacctgaggtcaggagttggagaccggcctgaccaacatggagaaaccccatctctactaaaaatgcaaaattagctgggcgtggtggcacatgcctgtaattccagctactcaggaggctgaggcgggagaaacacttcaacctgggaggcggaggttgcagtgagccgagatcatgccattgcattctagcctgggcaacaagagcgaaactcagtctcaaaaataaaataaaataataaataaataaataaaattattgcaagggtgtatagtctgcttctagaactgacacacattcactgtgtgtgtgtggaatggaatggagagagcagtttggaagatggtaggagatgagttttgaagtattacctcttggatattctgaatgctaatgagagaaaaccctttagtggaaagcttagttaagggttgatagttgggagtaacacaccacctacttataagaggaccctaaactgatggttagaatgatagaaatgcattccctgctgttatctagctctttccaacagactgcaccatttccaggagtgttgggaaaggtgtttgttacaattgaaagtacaaacgtcagaggaagggatcaacaaaatataataaaaaagcagaaaattgaagaattgtgcatggtctgtgcattagctatctcttgcagcgtaacaaaacttagcagctgaaaacagcaaacatgtatcatctcgtggtttttgtgggtcagaatctgtgtgtggcttagcttggagcttctgacttaagtctcttatgaggttgcagtcaagggttggccagggctatagtcatctcaaggtttgatagaggttggataatctgcttccaaggtcacatggttcttggcaggcttcagaccctcgccacatggcccactccacagggctgccttacaccatgacagctggcttcctccagggctagcagtcaaagagagagagcactcaacctggaagtcatacttttttaatgacctaattttggaagtgatattccatcacttctgcatattcctttcattagaagcaggttactgggtccaacttgtacttatgggaggaggttgtaaaagggcacaaataccaagaggcaggaatcacgggggcccatcttaaaggatgccaggagaaagtcggtgcctcagattgtggcaaggaccccgtgagaatgtaatggcaattctattcacagttccttttttccctctgaacacctttcctgagattgcaggtggaacccaggatatatgatggtacagacagcccagttagatagttttctttttgtctagttttttttttttatgatttcagtcgtgctgttaaaatgcagtatctatgcagagagaaggtgaaaaagaaaagaattacaatcaatcaaacctttcaaattctgtcccaaaaaacagcattctccaagtctcagtaatgagttaggtattttttaagtaatgtgatattttatgtgaagaaaaattaagaaatcaaaactaagaaattaagagatttacctccagatgcatgggaatatttatgcagttacatacatattaacctagatgaatgaagactttttaaaagtttttagatataagcatataggctatattttaaaatacggtattttattactgattttataggactcagattagtggaagcttaggtgggagtttagggactcttggcttctcagttctttactgtgaaagtcaaactttccaatatttaatcgttttctaaatagtcaccttttgcttttctgtttactccttttgtttttactggatcacgatctctacaaagagtgactgttttgtcttcatttgtttaaaataatggtttctaggcatcactgatagggtgagaactacaattaagagttttttgttgtcttgtttttttaaacaaagttatatgcgcctgccgcttagtttgtaaaaggcacacaagtgaacatttggaaatgtagtcacacaaatgaaaagcaggtagaggttatatgcatgctatttagcaatgaaaataaataaaatcctaatacatggtgtaacatggatgaatcttgaaaaggtgctaagtgaaagaggacatatgtgtgaaatgtccagaataggcaaatctatatggacagcaagtagatgagttggctgcctagagctagggaggcagtagggggatggggtgacagctaaaggatgtgggatttctctttggggtaataaacgttccaaaatgtaacatggtgatggttgtacaacacagtatactgaagtaaagccactgaattatgtgttatgagaattatatctcagtaaagccgttaaaagaaaaaaaggctggacgtggtggctcacactgtaatcccaccactttgggaggcctaggcgggtggatcacctgaggtcaggagtttgagaccagcctggccaactggccaacacggtgaaaccccatctctactaaaactacaaaaactagccgggggtggtggcgcgtgcctgtaccattataggcatgagccaccctgcccggctactggagagactgaggcaggagaattgcttgaacccgggtggcagaggctgcagtgagccgatatcgcgccattgcactccagcctgggcgaagacgcaagactccatctcaaaaaaaagaaaaaaaaaaggggcttggtgatagttggtttgatgatatgaagaaacggtgtagttatttgtctccacaaaatttaaaaactactagtgtaatggaaattgatgtaacaattttctgtaaactataataaaatgccattaaatgtgtttctctgtgcgtttgttttgatctattgaaagttcagggttaacccctgggcttctaatgcttccgttcttatatgatttcattaattgcaaagagaatctctgatgttagtagcttttagagaattatggaatattaaagaaggggggcttttaaggaaaatttcactgtttggtttgctttggctattaggctctcccccttctcccacaaatatatatattttcaggagacggaatatatatatataatacttatatttattgttattattttgagttgcactcttgctgtattgctcatgctggagtgcaatggcgtgatctccgcccactgcaacctctgccttctgggttcaagcgattctcttgcctcagcctcccaagtagctgggattacaggcatgcaccaccatgcctggctaatttttggatttttagtagagatggggttttaccatattggccaggctggtctcagactcctgacctcatgattcgcctgcctcggcctcccagagtgctgggattacaggcgtgagccaccgcacatgcaccattatttttgttttgaatttaaatacatgcctttatatttgttagagaaacaaaatatgtttattttcagacatacgagaaaatcatatacttgtaagaaaatcatatactttcttataaggtcatgtaaattttgagaattctgatagttgatgaattcagtgtgcttggaatgaacagggaaaatatggtaaaatttagccattttgatattagcaaagtcagtgtacttccaatggataaacaatgaatttaatcggatttgaaaaatccaaaatatggtgcttgagttgtttgtggacctggataagtagttttaagaatttggctaggcacggtgactcacacttataatcccagcattttgggaggccaaagcaagggagtcgcttgagtccatgagttaaagaacagcctgggccgggcgcggtggctcacgcctgcaaggctctaatatcagttggaaccccgggagcgcgccaacagacagcacaaggcggtgtggagcatcacgctgttttaatgcgcgcctgggtgcagacgggctgaggcctaaaatggcgtcagcgccacatgaggacggggcaggggttttacagtctcctgtaaacaggaagtgtccctgtctgatgtaacggctacgtggtacctggatggcctctctgtctatcctcggtggtgggtgtcttccggccggggtgcgtgtcttccggccggggtaggtgtcttccggccggggtaggtgtcttccggccggggtaggtgtcttccggccggggtgcgtgtcttccggccggggtaggtgtcttccggccggggtaggtgtcttccggccggggtgcgtgtcttccagccggggtaggtgtcttccggccggggtgcgtgtcttccggccggccctcttcctgcttctgcttctcgctgacgcgcgctgctggtgcaagcggccttgcgccttgggactgggtctgaggagggaggagttattcatccccccaagctttcggccccggggagaatctttcattcctgtctatttggttatagaaaaagggaaaaggggcgactttctccataactacttcaggtgtgacatagggggtggcgtgggcacctcggaaaaaaagaaaaaattttggcgtattcttgagagacgggttggtatccatcgtgtcgttgtagcaggagcatcgtctggattgtctggcggttaactgtagtttcaacaagagttttaatggcttttattatcagtgggataccacaggggagaaacaggaggaccccaatgatgaagattactgtccctaccagcgttttaaatccccctaaattagagaaccaccctcctagaaggtttgttgggtcccatcccttccaggtttggactggtacacgggctacttttctgatgtttgaagcgatttctagaaccgcttttccattatcatctatgttaagacagcaattggacatgttaaacttagcacagaccgcaccctcttctgttaataagtagtctagagccagcctgttttgataaattgctgggtgcgtttggttttgttgtcacacgagcatttccagggctgaggcggtttggttagtgattatctctagagcagcctgtagtctaattattctatttaggatatatgtgggagtgcgataaccccgtgaaccatcctcagcccaggtggcaggaccgtaatattcgatgatccattgcggaggccactcgtcctctcacggtctttggcttcctcctgcctttaaggaccgtttttctctggttatcatacgcagggactccgagggtgttgcccgcctgctttggaagtaagatgaatccaggttgaattgtgcgtaggaagctagtgctaaggtagccgtgagcaagcctgggttccccatatccaaaggaatccatcggggcagtccgtcgtcagctggtgttcctaggattgtcgcatagtgcacttaggcaggcgtatgtggcagaagagttagtggtgtttgtacagttccaggccttttttgacaagacacaattgaggtagctgaagttagagggagaccaggctccggggggtaaccttggccaccactcggctgtggaggcgttgactgttagggtttggtgacgggctttcacctgcggcacgatgggttttatcagtccacttgcgggatatgcacgccgtccctcttactgggttggtaagtgtccaggtcgacgggcgttcctgagaattcaaagtgaggctggggttttgaaatgctagtaattaagggggaaggtctatcccatgccacggccactgttcactcctgcgggctcccccgcatacccagcaattggacacattcgtggtaagcgcgatgccctctcctagatctacaaaccggttttttcctggctagggaggggatacgtctgcttatggtttttgtataaagggatggaagtaccacgggtgattttcgggggagttaaccccgggagcgcgccaacagacagcacaaggcagtgtggagcctcacgctgtttaaagagcgcctgggtgcagacgggctgaggcctgagatggcgtcagccccacgtgaggaccgggcaggggttttacagtctcctgtaaacaggaagtgtccctgtctgacgtcactgctacgtggtacccggatggcctctctctcgatcctcaggagtaatgtcttccggccagccctcttcctgcttcggctaccttggtgacacatgctgctggcgcaagtgtgctttgggactgggcctgagaagggaggagttattcatccccccaagctttcaggccccggggagaatctttcaacgcttacaatcccagcactttgggagacagaggtgggcggatcacgaggccaagagatcgcgaccatccagaccaacatggtgaaaccccatctctactgaaaatacaaaaattagccgggcatggtgtcacccgcctgtagtcccagctgctcgggaggctgaggcaggagaatcccttgaaccggggaggtgaacattgcagtgagccgagattgcaccactgcactccagcccggcaacagagcaagactccgtctcaaaaaacaaaacaacaagaaaacagaacaaaacaaaacaaaaaccagcctggaaaacatagagaacctgtctctacaaaaaaaacaaataaataaataataaataaataatttaaattagctgggcatggtggcatgtgcctgaggtcccattgactcaagaggctgaggtaggaggatcatcactagaccccatgagttcgagtttgtatgatcctgccactgtactgtagcctgggcaacagagaccctgtctttaacgtttttttaaaaaagaagaggtttaagaattagcatcacaaattgcatgcttgggcaaatgtcttacacagttttagtttttaataaaacgtgttaaagtgtaaaatgtctaatcaaacttctgagaggaaaagtagagaatccaaacattaatgcttattgacatgttctacataatttagatgctaaatcccagaaatatttatgtgtactgattgtgccttgattagaaagcctgaagcaggctctagacagtggtggagcttgcgggagtcacataaatgctgtgtgatcaacaggatttaagcccgtgggttacctgcttttacaacctaagcaccaagggatggggagccttggccgttagcagcctaagggagctcttgttcccacgcatttttcaaattccactggagtttcatgaggttcgttttaagactgccacctgaaatcaagtccagtggctgttcctgtcttcccgtccctgtattgacattaaaaccacttagtcaacactcaagtgcaagaatagtgtcgccatgttgtatgcctagtaaattctggatgtacgttgtacgtcaccttatttaaccttttgccattagtttacaagaagacgggttgagcgagtcaggttgcttactttaggttaacagggcagctggactccagcctaagctcttcagtgaagccctgcatcactccctctgcaggcagagggtgcaacccgggggtgtgggagggagcatggcacactcagcacgtggtaattatgtcataatcacataatacattcttttggcccgaggtcaggtcagaaggaagttgactaatttccagatttatttcagtcataatacccgtgtctagtgttgaggaaaaggaagggatgtttcctgtttgctgcttcggtatggttagccaatgactggaggtatttaaaaggtgagcactggccaggcacggcagctcacgcctttaatgccagcactttgagaggctgaggcaggcggatcacctgaggccatgagtttgagaccagcctggccaacatggcaaaaccccgtctctactaaaactacaaaaaattatatgggcatggtggtgggcgcctgtaatcccagctacttgggaggctgaagcaggagaattgcttgaacctgggaggcagaggctgcagtgagccgagatcatgccatggcactccagcctgggcaacaagaacggaactctgtctcaaagaaaaaaaagtgagcattgtccttcaccctcctttccattttcatggcattgatcagaaccttagaggatgaaacatgtcagaaaaagggagcagggcagagagattcttcacaggaaccacatcaagcgtgtgttaaaatttatttctgatctgccttccaaaattatgcccaagatatgcatcagcattaatgggtaaggcggtttgaggaattcggttatgcaatgactcaaagacccattaaatcacagaactgaagacatttttttctgtacataaatgtgccattttaaccatttcattctacagttcagtggcattaattacattcataatgttgtgcaaccatcatttatatctatttctaaaacttttatctccccaaacagaatctctgtgccattaaacaataactcccagccaggcgcagtggctcaggcctgtaatcccagcactttgggaggctgaggcgggtggatcatgaggtcaggagttcaagactggcctggtcaagatggtgaaaccccatctctactaaaaatacaaaaaattagccaggcatggtagcgagcacctgtaatcccagctacttgggaggctgaggcaaagaattgcttgaacccagaaggcagaggttgtagtgagctgagatcgtgccactgcactccagcctgggcaatggagcgagactccgtcgcaaaaacaaacaaacaaacaaaaaacctccccattcttttttatattttctgtcttttttattgatattctcattttttcctacattgtcttcctgatttcctttagttcttcatctatggtttcttttaagacagttgatttaaattctttgcccaggaaattcaatgtctcggcttcttccgggatgttttctgtctatgtatttctttcaccagaatgggccacactgtactgtttttttgatatgcttggtgatgtctttgtattgaaaaccggacattggtgtattatgatgtggtaactctggaaattagggtctcgcctttgttcagggttggctgttcttgattgctgaagccttagcttgtgtttcttttccagtctttcagattggctctgtgctcaggtactcctttaacacttagccaggtcatctataattctgccccagccttcacttctgcttgcactaagttgatgggtcttctctggccctttctaagcgtgcgtcgtgtcctgagctgtcgcgtgtagctttctgaattctacagtaccacaaacatttttgaatgctctgatttcccaaggaagcgatcttcctggcttttccccctggctttagattgtctagtttatgcctcaaccgtattttttttgcacccctccgcccgcttggccgtgggtttttgatcacctgacaatattttccagcaacacctgctgcttttctgctctgaacgtgttctgagttttgcaacagagaggcaagtgccttgtttcagtctttgggtagccccagacagattagaacaaacacagtgatttgcaagtaagatctgctctgctcccttcaaaagcaagtactggggtgccacactgggaatgagggctgctgttgagctggggaaaggggtgaggtaagggcaagtaaaaacacccaaagctttgctactcttttgacattgcctttctcttgattcggtggtcactgtcttgttcaggcatacctttgtttttcacagttctaagaaagttacatcttatagttctggatgttgtttttttttaaaatatttctgtgaaagcctcagagtttgaagctgcctgttctgtcattttgcttatgacactcaaggccttttcattttagggcttccagtagcaagaactgtgcccagagggatggaattagatcgaactgctctgaaagagtactactatttcatatttttatacaaaagcatattttagataaggatgtcattgatttagaaactcaaaccaattaatctttgggaagtaatattatctctgttttagag

SEQ ID NO: 745 - DNA, 660046 bp, Homo sapiens
atcagtctgctaagtgaagatatctcggtaagaactccaattttaaggggaatgaatctttacagaatgtactttatcttgtcagcactttgaatctaaatttccttctcaccctttcaccctaaaatatcagcttgcatcaggcacaaaggaagatgcacagctgcaagtgctcaagatgactaaggaaggaaaagcagacaagtcactaattactctccaaactggaggcctaaatcatccttctcttctacctgttgtttctggaatagtttatgtcagtaatggaaaatttaaacactgtcatataattccattttttttccccactccagctcttaaaaacatcctagatgttaagatgtgtagcctaggacagtggttttcacacagtgctctaaggaacctttagagccagacacacagaggaggtatcaataggaggggtctgatgccccttcgacacatgttactataattaacatgtattttgagactgagaatgtaggctccatgaaagccgggattcctgtttcctcacagccatcacctcgtccttttaacagggcccagaatacagtaagctgccggataaaagttttttgactgaataaactgcacggttattacagctgggaactgatttcgctgatttccacggtaaccctgtgaggcacgtatagtagttatcctcactttgcagatgggcaaactgaggctcagagcagcctggcttccaagaccctccttctaaacatcataccacatgacacagcctcccacgtgagccagcagctgtatttcatctgttttacatgtgaggtttcccaccatttgactggagaaaggtcgatgttaggggagaaaaaaccatttaaaaaccaccaacttcatggtgaaatccaaaggctgcaagtaatcaatctcactccttgctctgtttttcctgccacccttgggacttgacgcaagtggcttaactgctcattgtttcaggttcctcatcttattttacaacctatcttgcaagatgagtatacatgaaatattagaggatcctgatgttgtcagaagtgtagttttgcggatgttgatcccagaattgtgaaacaaggacacggttgagatgatcgctaaactctgcctgaagttcaacgcctctgtcattgaagaccttgcacagtgccgtccacatggttattttattcctccatgtccttaccaactaaacaagccatatgattttaggtttcgtggccagacagcctggctaagctcctatcaacatgtcagccagatgaggtgaagagatggagaaacaaacctgcatgtgggttgcgtcgaacaataaagagaaaacagagaccaaaaatcttgtgccaaggtttgacctcaacaaccgcaaaaccaatcattgctgtgttgtttcactatgtttctagaaacatccatagaggagaaaccaaagtcggcctgaatacatgttaatagctttcacgggcttacttctgatattttaaacaggcaacaaaaaagaaaaaccaagtttcagatcttgccagaaattggggtttcacttaactgtaaaacagtcaaggggagtttatcaggtaagacacgaagcctttctttataagctcttataagactagagaccactggattgccgtgcagttactgccgctggcattattttcttagcacactaagaaaaataaaaatgttcaaagtcctgtttttaaaaacaggatgagacttctggcttctgatctggtatgtaagaagcttagaagtcaccattccatcctaacaacaagtaaaaagctaaacaaactaaaaaatcaaccattcttcttacacatttgagatgctagatatattagcttaatttaattattccacattgtattaaaaactcacaataccactttgcatcttataaatatacacaactataatttctcaatatacagtgttaaaaaaaaattcttagatctgccaaagaaataaggtcacagggcaagctgctgcccccaagactagagagacagaggggcgcatacagagcattgcaacttactacaacagaaacctccatggaaatcagtacccggtagaaacctcaattgtactcgacatactgctgggggtctagaatgaacaactcttcgagtttaaaactccagaggtgcccatcatggggagtagggagggataagcttttgtgagtttttttttttccaggagctctagcagggcctcgcagtgagtatcagagaaaaattcccttatgcttccagtggaaaaaggaggaaaaggaccattttgaaaaaacaccagagatcagcaccataggaaaaggaaaaaagaaaaagaaaaaaacaccagagaattatgttcttaacaaggttttgccctccagagaaactaaccagaccctaacttgctggggctttggcagagcctaacctacctggggaaggaaaatacccaactccagtccactctagtcatcctgtcccacaagaaaacaaacaaacaaactgagaagcactgagtgaagctcacagtccagggtcatgggctcactagaagactgagacccactcacaggactacaggagaacaattccattctgagttagtccactttgcatttgctataaagacgtaaccaatgctggctaattttcaaagaaaagagatttatttggctcacggctctgcaggccatacatgaagcagagtgtaggcgtctgcttctgatgagggcctcaggaagttcaccatcatggcagaaggcaaagaggggccagcatgtcacatggtgatggagggagcaagaaaagggaaggagagccagactcttaacaaccagctcttgtgtgaactaacagagcaagaacctgctcatcaccaaggggaaggcaccacgccatgcatgaggggtccacccccatgatccaaaacctcccaccaggccccacctccaacactgggggtcatatttcaacataagcttcggaggggacaaaacatccaaacagtatcactccccagtgatttaccaccacatcactaaagacccattcacaattctttttacccagtacatcatgacatccgtctttcagcaaaaacttaccagacatactaaaaggcaaaaaacacagtgtgaaaagattgaacaagcatcagaatcatagtcagatacagcagaaatattggaatcattcgacaagaaaatttttgaaaatgatgaataagctaaaggctttaatgaaaaaaggacatgaaagaacagataagtataagcagatgaaaattctaagaaagcaaaagtaatgctagagatcaaaatcattttaacagacttgaataatccttttgaccaacttattaggagactgaacacaactgaggaaaaatctcagcttgaggatacgacaacagaaacttctgaaatgaaaaagcaaagagaacaaagattgtaaaaaaaaaaaaagaatatccaagaactgtaggacaactatgaaagatgtaacatacatataatgggaatattagaaagagaataaagagggaaaggaacagaagaaataatattcaaaacaataatgactgagaaattccccaaattaatgtcaaacaccaaaccacagatccatgaagcttagagaacactaagcaggatgccaggaaaactacctctgggcatatcatatttacaactaagaaaatcaaagataaagaaaaaaaatatttaaaaaaataccccagagggaagaagaacatacttcagtggaggtaaaagaaaaacttttgttttcttattcttaattgatcaacacacaatatctttttcaaaataatagcaacaatgtactcaattacgtatgcatatatatgcttatgtataagtgaaatgaatgacagtgatgattccaaagatgggagggaagaattgggaatattttgttattataagatatttgcactactgataaagcagtttcatgttattcgaaaatggacttggattagtagtaagtgtatattgcaaactctacggcaaccattttaaaaagtaaaaagaagtataattaatatgctaataaaggagagaaaacagtatcatataaaatccagctttattcataatttccaaaacttggaagcaaccaagatgtccttcagtaggtgaacaggtaaactgtggtacatctagacaacagattattcatcactaaacagagattagtcatcaagccatcaaaggacatggtagaaccttaaatgcatattactaagtgtaagaagccaatctgaaacactttatacggtatgatttcaactgtatgacattatggaaaaggcgaaagtatgaagatagtaaaaagatcaatggtggccagagatgagaggggagggagagatgaacaggtggaacatgaaagattttgggggcagtgaaaaaagtctgtatgacgctctaacagtgaagacatgccattctacatttgtgcaaactcacaggatgcacaacaccaagggtgagccctaatgtcaactcgggagtctgggagataatgtgtcaatgtaggttcatcgactttagcaaatgtaccaatctggtttgggatgtttatgatgatgggagataggggtggggcagggaatggccaagggttatatgggaaacctctatgctcaattctgctgtgaacataaaacggttctcaaataaaaagtttattaattttttaaaggatttttacacaactaagccttgataaacatttaccttctttcttcttcatcataattatttttccgcattattttgctattttccttctctccttctctctctctctttcttttagagacagggtctcactctgttgcccagcctgaagtacagtggtgccatcacagccaactgtaacctcgaattcctaggctcaagcaattctcctacctcagcctccccactagaactacagacgcctgccactatgcctggctaatgtttcagtttcttcgtagagatgaggtctcattatgtttcccaggctggtcttgaactcctggcctcaagaactcctcccaccttggcctcacaaagggccgggattacaggcgcacatcacgatgccagacccaattttgctattttctagcataacatggtatgcacacattaaattaaatgtgaaaaacaaaggcaaaaagaaaaataaatcaacaaaagttctccaatcatgactaaaatcatggactatttccttctaatcttttctacaggctgatttttaaaaacattacttaattcatggagaatatcaaccagagtgctcaagatctggcccttgggaagacaggctttcagatcatctcgagtccttatttcctttctacccccaacctctgctgtgcctggtgctcagggcccctctccagaaaccgtcactctgaagatgagcaggcacattcaaggctgtagggagtacaggggaggatctgatgcagtctttcaaatactccttttcttttaaggtccccatatgaacctatcccccctcaggacctcacttcattaatttctgagcctttctgagcaggaaatatgcttgcttctcatcgatatccaccactgtaggcactcagatcccacctagctccccactgttaattcagtcatcagaactccaactgctttttgtcttcattattgatcaatgtgttataatgacttttgattccatcaaaagtagaatttgtttttccattcctcattctccttgccattctatggtgatggatgatttctgagagaagaaagaggtagaaatctctctattccatcacaattcttattcttacatggtattgtaataccatattatctttattaatctggctttataatatatttcactgtctggcaggaacatggtcatttcaaatttgactgaatgtttcaaaaaagtattttctatttgtctttaaagttatgggcaacttaccagataagttgaaaagaagttcaatatcctaaattcaaaatcctaaattttcacatgtagaccttcctatcaactcagacaatgccaggcacaaacctatgatcagtaactgctgagtgattgtgaacaagccatccaagaaaagtcaaatgcataggggcatttgtggaagtgtggagttgtctctgaaaagctgttgcactgtgaacttgtttcagcctgagaggcaagaaaggctggcctgtgattacttccggtgtctacctagtgtgaaatgtgttgagtcaatgaagcatctggaacagacttagttcaactggaaggttcatgactgggatgcttcctggagccctcagaccagagggcagacataacccaagaattgcttcttattaaaggaacagagacaaaaacctaaacagagggataacggcagagcattaaatgcagataattccatttgcgactaatttacccaaataaaatagcagaaagcagctttcagtggaataatttaaggcaacaggcaggagagtggcgtgaactattattttcatatttccattgcttacttgtcacttccagtgaatatttaacttttgagcatccactttgtggcttaaggatgttcctaacttccccaaactttgcatccttgaccagtacactacaatatttattcacaaccctgggaaatacctatgggaaagttactgttccctgaacgaaatacatgaaaatccagatttctctactcgctgacagtttatatagataatgctacttccccctcaatttatctctactctgtttcaatctacacactgctgtcagaacagcgttagaccacagatctgagcactttaatccccccctcaaaaatggcccccctctgctcaccagctccatgctgaggctctcacgtccttctcatgatataacccccatctactgagacactcagttctcctcaaatgaatctattctccattccctgactaagctgcagcgttctcacctcagtgcctttgcctaggctgtgtcttccatctgaaatgccctttaccagactactggaatgacaactctccttcaaggcccaagtgcctcctatattaaaacaataatggttagaactttccatttcaacaaaatgatgcagaattcaccttatattgaaaaaggcaggtagtgaaggaaattcagtgtacgagtaacaatgcacctcatgtaaaccactgtgaggtaaagaaaaggcaaggactttaaagccagatattcatggatttagctccctggtctggcatctttgaatcttgtgactcggggcaagttactcaagtcttctggaactgagttttctcctctatacaatggacacaatggtacctgtgttgcaagtgtggactgtagacacaaaccacgcgtttcccatattccatttaataattctgtgctgccctcgtctttcccgcgttgtaaatttcagccttctcaggtctgtgtctttctcctgtgccgttcatcagtggaggcttagttcccagtgctggtggaagatgcctccgtacactgttaaggaggcaatgctttctcttcctatcattgataatattctgcatcatagggctatgagacctccaggcttcagagattaccactgtgtcctgtggaggcaacctctaaaaagtatgtaattctgattttcttagttaataatgtgtcactctggtaacactatttaaatgggtctctattttctcaaaacgtaagtacttctgagttctctttgttaagccagaaggggaggcaaaagaaaataactttgctagctttcttatttaaattgagagcctgggatcaatgaaaatcaacacgggtttgctgtgagaatgaaccacaataattaatgactcttcagtggctagaacataaaagatagctagtgttagtgagaccatcagcaacaatacaactgcacaacttctactaacaataatgacatggacactgttctgccagaccttccagtccacaggcctttgaggccttagccaagacttttctctactggaggggtaaaaaccactaagcaaagcctcgcttgtctgagtcagctgagtctcatagccagggtatttgtctgaccctgttttcagtgctgaatttgccatcctgttgtaaatcagtcagcacaaactcagaaacatacccgttcatttacttaacagcacacaatccttcaaagggcaaagtggtttgaggaaatccaaactaaccaaggggggaaaggccaggaacacggattcctctgctgaagataaatggtagctatcaaatctgcacacaaatccctgaataaataccaacagcattccttcgtgttgttttgaaattcaaactacattaggaaaagagaaaggtgccttactttttgacataccactaagtcttcactccatcagaatgctattagcattagtggcagattttattacctctctaagtgtgtataaaaaccaagtgtctctaaaaagtattatttttgttgacatttatcataaagactattaaaacaacatataaaaatgtcaatgttgactttcttcagagaaatagaaagaactacttaaatttcatatggagcccaaaaagagcccatatagctaagacaatcctaagcaaaaagaacaaagctggaggcatcatgctacctgacttcaaactgtactacaaggctacagcagccaaaacagcatggtactggtaccaaaacagacgtatagacgaatggaacagaacagaggcctcaggaataataccacacatctacaaccatctgatctttgacaaacctgacaaaaacaagcaatggggaaagaattccctatttaataaatggtgttggaaaactggctagccacatgtagaaaggggaaactggatcccttccttacaccttatacaaaaattaattcaagatggattaaagacttcaatgttaggcctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaaagtatcagaggaaacaggcaacctacagaatgggagaaaaattttgccatctatccatatgacaaagggctaatatccagaatctacaaggaacttaaatttacaagaaaaaaaacaaccccatcagaaagtgagtgaaggatatgaacagacacttctcaaaagaagacacttatgtggccaaaaattatgaaaaaagctcatcatcactggtcagagaaaagcaaatcaaaaccacagtgagataccatctcacaccagttagaatggtgatcattaaaaagtagggaaacaacaggtgctggagaggatgtggaaaaataggaacacttttacactactggtgggagtgtaaattagttcaaccattgtggaagacagtgtggtgattcctcaaggatctagaactagaattaccatttgacccagtgatcccattactgggtatatacccaaaggcttataaatcattctactataaagacacatgcacacatatgtttattgcggcactattcacaatagcaaagacttgcaaccaatctaaatgtccattagtgatagactagatacagaaaatgtggcacatatacaccacagaatactatgcagccataaaaaaggataagttcgtgtcctttgcagggacatggatgaagctggaaaccatcattctcagtaaactaacataggaaaagaaaaccaaacaccacatgttctcactcttaagtgggagttgcacaatgagaacacgtggacacagggagtggaacatcacacaccaaggcctgtctggaggtggggctaggggagagatagcattagaagaaatacctaatgtagatgacgggttgatgggtgcagcaaaccaccatggcacgtgtatacctatgtaacaaagctgcactgttctgcacacatatcccagaacttaaagtataattaaaaaaaaaaatcaatgtgtcatttgagtagctcattgcacccaaactggctattgcacaatttcagtttatacaatctattaagagaacgcacacgctctcgtctggttagaacgcattcttcttcctgagggaaaacctgagcttaggttgttctctctgaaacatccccactaacggggatgtcccttgaaggccgcagggactctaccttttatctctaaatctctggagcctaccttggtgcctggtacatagcagtcactcaattcatggttggtgggtttatttttttaaaaatagcagctgtcatttaaccagatgctgctttgtgggaggccctttgcttacatgatcactaacacttaaaacaactctgtgaaggaggctaacaaatcctgccttacagttgaggaatctcagatttaggaagattaagaaacttgtccacagctacatacctggtcagtgagtaaaagattcaaactccaaagcccagctttgcagagtctgaagcaaacactacgctgtacagagtctagtcacctatagtcactgctgatcttgccatgtctcgggcaccactgatgcctcactataactgaaccaagtgggaagggggcactgatctgaatgtattctgacaacagaccatgccctaggatgtaagtccctggtacaagactgttttcattattcttactcctgtctcctaaaagcaggcaagaaaaccagtttttgatagattagaattgcactctattttcattcggataccaagtcctgagacaccttagctggctaggtaagtctggtggtgggagacctgctcctgaagccataagcaagttaacatatgtgaatttcctctgtaaactccacatggctctatgacaacaacacagtgttcaatggtatcacggtggtgaaaagagcacagatttttaaatcagatataacagaattagaatctgcacctcccccttacaacctcatcatctagggcaagttgagttaattaacctctcaaatttctaattcatcatctggaaagtgtacagaataatctgcacattgcaggatgtggtgaatattgctaggtgttcaccaacatctgttctcccttgctcccagggcacaggcctgaactacgtttcccagttcctcccccaacccctggaatcaggcacagctacgtgactaagttcgctccaactgagtggaagtgaaagagttgggaactgcttctggagctaagccttgagactgtgggctggccctgctgggctcctttttccacttcttgtgaaggcctgaggggcggtggagcaacaccatggaaagaatccgggccctgaataacagcatggagtggagtcacccacccacctggtacatacattacacaatcagtgaaaaagaaataaatgtctatctcctttgaagctactcaattatcattatgtccctttgttacgagaacctggccttacctttgccaacagtgtttttcccacctattataatgcctggcacaaattgggtactcaataaataaatgatgtcattgctgctgctgttaccactactgccacacctaccatgcaaagcagttcccttcttacacacattgaaggttccacggccacagacacaaactgctgcccttagctacagaaaggaaagttaatgaaatgaagatggctctggaggaaaacaaaatcaaaactttcaactctagaagaaatagcttaaagcacatgccctattgaaggacaaacacttagctaaaacagccatcatcattgttgcttttgttaggtattatgtttttgaggttatagcaggaaagcttatagacacagcacaagaaggaaatttaggaaggcatataatcggggtgtccatgttatacacagggtgttcacccaatctgcaaatgtttattaaactattcaccaaatatttgtgaaaccaacgaggtaccaggtatttgctaaatggaggtacagataatagcctcaccctcaactttcacaggagttttatcacaaaaaaaatcaaatgaaaataagtagcttattgtgtacatgtgacaagggaaaaaggagaggaacaaaacctacccatgttgtgaggctgcacgagagagcaaacataccaaagaatcttgctttattttctcagcgaaaagagttctagtgcacccatcagttgctcttgtaaccagacactgtccaaggagcatcagaccatcccaactcaagaacaaatgtcccagttagccatggctaaagaacacttcccttaataacgtcttttgatcggcacgaggaaatctacctatatgagtacttttttggggggttcagtgagtcactcacagacctatttctcaccaagtcattcggaaacgtaaatgtccagaaaaataaattttaaatatgataggacttcctggatgttaaattcaatttcagagtattttctcatatgagagtcattttgtaaaatagacttttgcattttaacaaaatcatcatcattaatacctatgcttataggtctaaacagtttcaatcaagtcacaaactaaatcaggctgcccttcctccagaccctgacttgctaacagatgccactatctgttcaggcaccctcctttcctcttcccacctctctcaaagccactcccactgtgagtatcctcactctgacacttgtgtactggaagatgatttttcaatgagaaaaaatctctctttaaatgacatttttcaaatttaatatgactaagttctgcccccaaacctactccttagatgggaagattcattcccatctgagagatgacagtatttatttttctctaatacatgagcagtattataaaaccttcccccatttctccccaatccatgtcatccagtctatcagagtcatgacaattctgaccccagaatgtatcttgaatctatttcatttttcccatctcctacatctcctatgccaacctcctaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcctagggaaagccatcgtctccggcccagggaaagccatcgtctctggcctagggaaagccatcgtctctagcctagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcctagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcccagggaaagccatcgtctccggcctagggaaagccatcgtctccggcccagggaaagccatcgtctctggcctagggaaagccatcgtctctagcctagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcctagggaaagccatcgtctccggcccagggaaagccatcgtctccggcccagggaaagccatcgtctccggcccagggaaagccatcgtctccggcccagggaaagccatcgtctccggcccagggaaagccatcgtctctagcctagggaaagccatcgtctgtagcctagggaaagccatcgtctccggcccagggaaagccatcgtctccggcccagggaaagccatcgtctccggcccagggaaagccatcgtctccggcccagggaaagccatcatctctagcctagggaaagccatcgtctgtagcctagggaaagccatcgtctccggcccagggaaagccatcgtctccggcctagggaaagccatcgtctctagcctagggaaagccatcgtctctagcctagggaaagccatcgtctctagcctagggaaagccatcgtctccggcccagggaaagccatcgtctctagcccagggaaagccatcgtctccggcccagggaaagccatcgtctccggcccagggaaagccatcgtctccggcccagggaaagccatcgtctccggcccagggaaagccatcgtctctagcccagggaaagccatcgtctccggcccagggaaagccatcgtctctagcccagggaaagccatcgtctctagcccagggaaagccatcgtctctagcccagggaaagccatcgtctctagcccagggaaagccatcgtctctagcccagggaaagccatcgtctctagcccagggaaagccatcgtctctagcctagggaaagccatcgtctccggcccagggaaagccatcgtctccggcccagggaaagccatcgtctccggcccagggaaagccatcgtctctagcccagggaaagccatcgtctctagcctagggaaagccatcgtctccggcccagggaaagccatcgtctccagcccagggaaagccatcgtctccggcccagggaaagccatcgtctctagcccagggaaagccatcgtctccagcccagggaaagccatcgtctccggcccagggaaagccatcgtctctagcccagggaaagccatcgtctccagcccagggaaagccatcgtctccggcctagggaaagccatcgtctctagcccagggaaagccatcgtctctagcctagggaaagccatcgtctctagcctagggaaagccatcgtctctagcctagggaaagccatcgtctccggcccagggaaagccatcgtctctagcctagggaaagccatcgtctctagcctagggaaagccatcgtctctagcctagggaaagccatcgtctccggcccagggaaagccatcgtctctagcccagggaaagccatcgtctctagcccagggaaagccatcgtctccggcccagggaaagccatcgtctctagcctatgttattgtgacactcttaacctcatctcatgcttgaccccttgaatccattctctatatacttctctagacagaattagaatcatctttttacaaacatgaaggattcagtcacacccacatttcaaacatttcaatggttttctgctacttcagaagaaaattgaaacttcttcaaatggcctaacacggctccgcttgatccagcctctaccacacaacagccatccccactcttctagccttgctccctcatggcatggctttaaatgccaccattggaggaagtccatccttaatcacaaaaccgaaaggaggggccacgcacggtggctcacacctgtaatcccagcactttgggaggctgaggcaggcagatcacttgaggccacgagcttgagaccagcctgggcaacatggtgaaacctcgtctctactagaaatacaaaaattagccaggtgtggtggtgcatgcctgtaatcccagctactctggaggctgaggcaggagaattacatgaacccaggaggtggaggttgcagtgagccgagatcgtgccactgcattccagcctgggtgacggagtgagactgtctcagaaaacaaaaaacaaaaaaccccaaaacttaaaagattctcccttgcatgagaatcttatttgccctccacttaccaccatttataataattcctctttttgtttccttcctgccctgttattaacacctctgaaggttggccccatgcagggaacatactacttttatagtgcactcggctggcaagcagtctttcttactttctctgtgttgtgtctatgtatacacagcatatctgtgagggagatattaatattattcccattttacagataaagaagatgtgaagcatatggaggctaagcccctccctccatcaggccacagagccaggtgcaagcccagtctcaccccagcatcctggctcctgtcagctgtcgtttatcatcactatacaccagcacgcctggctctttgtaggagctgagtgaacatgggcagaaggaatcgtgaagtaaacgcttccaagtcggaacatccagagacatttggttcctctctaggtgctcttacccattcctagttctactatttatgctgggaggcatcttctgtcccttactaattgataagttcatctagggcaagaatcatgatttatccatcttcgtgcctctcatgatacccaacagtaggcgctcaaaaaacttttcctagtgtgtgcaggcatttaaaactcagtagaaattaaccacaattgcaatgaagtaaaattcaactaagagttcccacaaaaaataagtacaacagtcaccattccagtcatttatagagctgatctgaatccagaggtaagtttccagaattaaagagctgttttatagactgcgtctttctacttcacgagtgggtagaaatcatctttattagaaaaaaaataagtgcgggagggcggggggcagagagaactatttcaaaaggtttttccctgtttgtcctaaatcctccagagcaggcagttaaacgttgagtccagcgtttcggagcctggccagtctattacaggccttggtggtgaaaggcagagtggcctcatccaagctttgtctctcgtcagcaatgctacctgtgctggcctttccgccttacttcccaaactcctctcccatttctcatttctgctcccatttccccttgttccctccaacactacgaaggcaaattatggggctcaatactgagaagtcctttccaccttattgataatgaatttctttcctgggaaacacctgggaaagagaccaaaaattcaggacagtacagcctaatctgaggtatctgtccattcttggcaggtatgcattgctaaaagcatgtgactactaccgtatatcagagagcccttttatggaacgtggctctctgctccatgagtgggtggaaataatatttagtgaaaagaagagtctcggcatcttaatgaaagaaacctagataggagatgagtcatttaaaccctctctctgtcatcacacagaaatagcttgaagaaagaaggagtcaactcaaatgcccaaggagggcaatggcaacagagatttgggaatcttttccagggtaaaaacaactgggatgggctaggggtgaataaggaagttccatcctgtctaaaggtgtctgttatggggtgaattatgttccctccaataagattatgttgaagtcttaacccccagtaccctaaaatgtgaccttatttggaaataaagtcactgtagatagaatgagttaggaaaagatcacactagagagtaagtaggcccgaaattcaacatgactggcatcccagtaagaaggtggccatgagaagacagacacaaggagagttccacatgaagacgggggcagagactggggtgatgcaggtacaagcagggaacaccaaggacagcctgctgccaccaggagctacgggaaagaaacggaacagtctgcctcagaaggagctcaccctgcccacacgccctgatttcagacctttaccctcagaattgtgaaaaaaattttgttgttttaagctaccctgtttgtggtatgtcaccatggccgttttaagaatcgaatacagcatcccaattcagacttaaaaaacgcaagatgaccaaacccagccccggcagctagatggtctctaattccaatgctcactattcagtgggcagtcacatttctgtcaaaaacaaaaatgcagttacaaaacattttctggctaaacaatgcattctcctggatctcacacatcagaattatcttccagatcccaggggtgagaagcgcagcttctgcgtcagacaccagtctagtggacatcgcacgctagccctgccactcgccagctgtggggctttgggagctctgtgcctcagtctcctccacctataagtgggaatgatagtgaagtcggcctcacagatgaggatgcagggcacactgggaagcctgctgaattacaacgagggggagaactcagcaacccaagcggcatgatctctatcacaggctgcagcactggattttaccttactgtgcatgatttttcatttgctttactgtgaactcacctaggacggggtccaggccttggtcacttttgctctccttgcacatgtgtggcaggtagtcagacatgcctcgggaatgaaggcaggaatgtacttcatcgactccactcctgtgatgtgagatccctgagggcaggacccaagtcctacatcaaccctagagcccagcaccaggtaagaggccacacagagggcaacgaagtcattgtgttggaaggacgtctgtagatgtattgctcaactctgccaagctagcatgggagcaggaattaaatgcttcattccagtttcaaggtctgagtttgtctgtttcctttctgcttatcacacacatgacatgtagaacaaattagggtgatgcttcctcactgaggctttttgggaaacctattaaaccaaggtggaaaaaataattcaagaacatgacaaatgcagctgtcagtaactctgcaacaggcagcaaatgctgagaaatgcacttattctctatggctgccgacgttgactggaaagctgctttgcagtctgggaaacaaatccctactccagactgtatgatatggattctgtctcagtggattggcattgtctagactagcagtcaacaaactacagcccatggtacctcggccactgtttttgtaaatcaagttttgttggtactcgtccctgcctttccagttatgtattgcttatggctgcttttgagctacaaggcagagtaaagcagttctaagaaagacggtatagcccagaaagcctaaatcattcactatctgaccctttagagagaggtctgttgatccctaacttggagtatcccactgtgattacacttaaaattaagcttgaagaggacagaaaccttgtttatctgggtcagacctatctagacgatgacctacctgatttatagtaggtgctcaataagtctgcaaagaataaacatgaggccaaataaatattgaggttttaggacaggtagtgccaacagcacacagtgctaaggggatgcctgctgggctagaccagtgtcccgaagctctgccctttttgagaggatgaggatctgccactgctgggtgtcccttggttaactagctacctgagagccctctgggagccctgggctgcacagacaaccaggacatcttcattttaagaattcaatagcattgagctgtcaggacagattaaacctgactaagaagaacctttcagaatccttctatgtatatacatttacattagaaatgttttaaaggaataaacacttgcaaagcggtttaaatttaaaggttcccttatacaactgaacccaaaacagctgtcagaaaccaaacatttataaatacaaatgctcaaggtaccaagtgaaaaaaagatttttagatctaaaagaaaaagtccaatctatcctgccataacaaaagcaaagaaggaaacagaaaagccagactttctgagaatgatcctttaatgttaatactgaaagcatgtgtaagttctggctccaataaagttgtttatggttagagttaagtaagaaggggtcctttaacttgggaaacgattacatagaacttgttgcagaaagaaagaattccatactatttctctttttctattttgtcctctcaaagaactgttgcttccatgcatcaggtcttcaaaccaggcttgggcaggcgagtctcccagccctccctccagcctggctctgggtgcagacccacggtcatggggaccttgagcacgtggggtcttcttttaggagggtttgtggaactgtagctctttacatagcccagagacattctccctttaaagtttttgggtaatgctcaattccatctttaaagaggtgggagttttaatagcacagctgtaatagaatcacatttcgagtttttgagacaggatcttgttctgtcacccaggctggagtgcggtagcatgatcacagctcattgcagcctccaccttctgggcttaagtgatcctctggtctcagcctctggagtaactgggaccagcatgagccactgcagctggctaatagttttttgtagagatgaagtctcactatgttgcccaggctggtctcaaactcctgggttcaaacaagtgtcctacctgggcttcccaaagtgctgggattacagatgtcagtcactacatctgtcccacatttatatttaaatagaagtagcatcctatagtctcaatttctgatcaaatgtgaaacaatcaaaatgtcagtctgagagttgatctaatataatagtaaaggctcacttataggctaaatacttccatcaaataaatcttaaagtaacattttctaattcaggttttgttttgttttttactaatccccttctaaacccacttaatttgtatttaattcatattcccaataataaaatcaaggaactacggaaacattgcatattccactaaactgtgtttacaatattaacaaaatctatttactccatagaataagcaaaaactcagacaagaattgactcactgggttcgctttgaggactgttatattccatttagaggtaggatttccttatttctttcgtagccacacctttggagatgtggccaagcattctttacacgaaacaagaaacacttgcaaagcggttcaaattcaaaggttcccttatacagttgaatccaagactgctgtcagaaaccaaacatttatcaacgcaaatgctcaaggtactgagtggaaaaaaggttcttagatctaaaaagtccaatctacccttccatagcaaggagctggggctctgcatgatggtagatgacttccaacgtgatctttccccccatgctaccagctgagaagacctcatactgaaggtcttcacagagacaagatgcctcatctccctggccttattttgtggcagctttcgggacattgttttcagttataacttttcagactctttcaccccatgggggttgtgttcccatattagaattaatataaatgcattttcatcaaaaggaaagaaaatagaaaaagaaaattaatgactagttacagcaaattcattatttcccctaaaaactaaacacatcaaaatgctgcttctttatccaaattcttcaccatattgaaatcatgaaatgaaacgacaaccagctttcatgaccagctaagaaacgcatttgatgagatcaaaagtccagcacgtggccccctgggacccacgaccagatgcccatggcagatttttaaattgtttgacttttcttcttaaaaatctacgtcctgttttgctgttgttcatttcaaacctcctgtgtgggagtgttaataaaatctaacatctgtaaatttctcatattggtttgatgaatccttgctcaaacattctcctttattctggctctaaatgatgtgatctcagccatctcctgaaagtatccaaagattaagacaaagatttaaaagccccattgaaaccacaaacaaaaagcccctgaacacctcaagactgagtctcccaacacaggctatgatggaatcgtttcggtttcaaggaatcagtagcaagaagaacagtcagctcctgctgagaaagggccaggaggaagagtgtaatgagggagagaataaaggtatgcttcagcttaaaactaatcatattataggtcaattagaatgcaacatttccaaaaccttaaatgtgtatttcatttgagtaaactcaatcaagtctactctttttttttttttttttttaaatggagtttcgctcttgttgcccaggctggagtgcaatggcgcggtctcggctcactgcaacctctgccttctgggttcaagcgattctcctgcctcagccacccaagtagctgggattacaggcgcctgccaccacgcccgggtaatttttgcatttttagaaacagggtttcaccatgtcacccaggctggtttcaaactcctgacctcaggtgatccgtcccgccttggcctgcccatgtgctgggattacaggcataagctactgacccagcccaaccctactctcatctcaggattcaatggacaaaactgcttcctagttcaaaaagaaaaagtatgtcatcaggaacaaagcccatcaacttcacaaccatgcagcacaaatctatttgtgcctgcgcccgcagaagcacctcccctcctgtgcaagggcatgtgcactcacctgggccctggatcccactgttcctcttcatctaggacaggagctctccagcttgagtgtgcgtgagaatcacccagaaggctcattgaaacacaggctgctgagctccaaacccagagtttctaattgagtaatctgaagtaaggactggtaatttactttgctaacaatttccaggtgatgttttatgatcccagagcagactctgagaacaactaatctaagacctgctacactgattatcctctcatcctacatttttgagtctctcctttcatattgcttctttccctaagcatataaacatgttcaaatttgtcatcttaaaacataaacaaaagtctccctgacctccctgggaatgtagtgtatttctctttccttctgtacacatgtaggttcttaagagaatgttctccatacaccacttccatccgacttctccttgctctgtaatctatttgccctctcaactctgctgaatgtgcacatctcacgaccccacatgaacttaacagtttccaggccaatggatacttcttaagtccctgtttgactctctgccttacctaccatcgctcacctgaccacacagcattccctcctcccttggattttataacctctccctatcctggatctcctaccacctccttcactgcctcccttttggtctcccgtcctggaatatctgcttttcaccatccctataagtgctggggatcccttgggacctgtccttggctctcgtcttctgatgccatacattttgcctgagagttctcatccatgcctgtctttcacctataatctatatcctaatggctctcaaatctagacttctcttctaaacttcaactacatagaatgatcatcaattagacaattatatttgtccaataggcatctcaaagttatcaatacttaaaagtgaacccattaatttctaccttgttcctgttccccttcctttattttttacctaacaaaatggctcctccaactgctcactcatgcaaaccacctttatgtccttaaggaaaaacatgtccttacgtctcaagcacaatcacagttcagaggtgggtccaatccacctcttaactgtctcaaatctgctcccttattcccgtctccaagactgttgctccaacttcggtcaacatcataatacttggttcttccctttcttaactgcatttctagtcacctccttctcatattttaagctccaataacaccaaaaactagttaatgatatctttgaatgtggcatgctctcttacaatggaaaacttctatatattttattccctctgcttggaaaattattaaaatccctgcaccaacatgttctttccaaaaccttcccaaatgttcttgactttggactcctttctggctctcattccacttgaaacctgcctccattacagcaattacctgtttccaagcctaacactgcgccattcaaaggtaaatccttgaattcctagtgctgataatacctggctcaaaataggagccctactaaaaagtacttttatacaacatacatcagtgattctgaacaaggaaacacactcccctggcagtagagtaagcgagtctaccaaacattttaggatcgtttttagcgtttaattctcctcctacagaattttagataactaacatcacatttatttcatctcaactttaacatgtttcatctcttgtttacttcatttcttcaaggaactgagagaggacccactgaaattcagtttggggatgttaggaacctgttggaagattttctggagaagttttctcattacaacagtgtttcctttctagtcattagaagaatgaagggagctgagggaagcagatacttgagagttttacattttctgtacctcagtttgttctctaccatttcagtaaaagacagctactcccaaatacatttttgctgtatgcaactgtgctgttattcctgtagctggtccaagttttatagattactcacacagccccctagtgagcccagctgcttttatactattatgatgccataaacaaaattacataacattttaaggccagtaataaatgcctgaactagctgactggaacatgtagcatttgggcattttcatggtcttcagtgacggttttactgccctgaaaagccctccctgtacgttatcaaagaacaggaagtctccatgtctccactctcggttgttccagcctaaaggtgacccacccacgcccacatgcaaggctggcaagaacgggtcatcgtcaaagagaatatgctaagtgcattgaaacaggctgtgtacaaccttcatcaagcttcaagtagttaaaatcgtgccttacaagtatttttaaagaaaactggtataggtggatacagcaaataaacatgtatttgaaaatccagagacaaatataagtaaaacttgatgaacatatttgcattttatgtaaatgtcaatgtacatgttgtggaacaacttggctctctgctggagagcatacctccttttaaatgagtcaccacttgcggatgaataggaaaacgctgacagatccatgcgagataaaacggatcacagcagtcttggaatcaacacacttttatgatgaaaccaactcatattcatgcctccaaacacagcttaggcttgaaaccaagttgcagaacgtccaaaaattcttgaagaatccagatgttcccataatcagccactgatcaatttcccaggagaaaaggacttaaacaaggatgggaaattccaagacgtttaatacccagaggatatctgcacccagagaaatgtcacactcagaccacaggaagctatagctctgctgttgactgatgtagtcaggtgtctagaattttatgccagcctctacccactacacaccattactgttttgagataaattagcaaacaccaaaaattagaggtaaaaaagatctagaaaaaaaacaattgaaacgaactaaagaagccagagccagggaggtttaacaatcattagtaacaggtgatatccactgaaacttttccatgttcttccagcttcacgctaagaacttcacgttttcttaacttattcctcacaacgatttttaatttaaattgattattcccactttataaatatgaaaactaagacttagcaatattaagagatttacccaaggcacacgacttatcaacagtggagacggaatctgaactcagtctttctgattccaaagtcccggcacttaagcaccacactggagcctgaagcaaaggctcatgggtgaccccagtcttaaacatctgagggtttgtaacatggaagacagaacagcttcgttgtattctaaagcaggagtcctccaaacctgtttgtactggagaatcatctctgaaacttaaaaagaaaaaagaaaatccagtttctacggtcccactcacagactctgcttcagctgatctggcatggaggccagaaaactgtatttttataatgctctgctgggtttgagaatcaccgctccatacctcagaactagaataaacgcagaggaatcactaggaggcaggtttggctttacgttattaaacagacaaaccaaaccaaacacacacacacacacacacacacacacacacaccgccacccacaaaccagtcctaaccacagggctacacaagcctcccctgcccagtcctaaccaacagagcttcccaaatggagctgtagctgcctgctcaagcgccacgatataatggagacaacccagtctctggaaacagaggctgccatttccagttctgattcagccattctcaggtgtgtagctctggtcaagttattttctctgagtctcagtttgctcaactggaaattattggagaacacttacctcaaagaattgttaagaattagagacaattaggtaaaattcaaagaaccgtggctgatgtggctgatggtgctcataagcaaacggcacctgcccacttgaaatgtaaccatcttcttctgtagcttctgtagcgagcctctgcatgtggacagcgtgggccgcctctgcagcacccttccccttattcccaccattgtcccacccactgacatggccacgtcctattggcttcaagcccagattttagcaatgggctctgactggcctaatccaatcagcccacacctggcccccttgccacagccataggcagggaccagagcccaggccaatcagcagatggtgttcctctggcagagaacggtttgggaggaggctgagcatgtgtccaaaattgggccaatcagagtgaactcaaaggctttttttgtcagtaggaggaaagggagtatctcctcttccagaatgtatgacacatcagcctgagagctgacgctcagcagccattctgctaccaagagcctttatcaaactatgtctgaagcctgggctatctccatatttttgagatctgtgaaccaataaattccccgtatcatattatttaagccttgaggttgtttttctatggccaaggctgaacacattgtaacttatccagaatcccctggctgggagtggtgagatgtaaccacttagatcatttctaacttcatgattccatgacttcttagactttatccaattaatacctgtcttcacatttataacacttctgacgactggtttctgcagcctggaacatcctgtccccctttctcttcttaagaaatcctgctcaccttttaggacccaactgaaatgggtccactgctgcaagatctttgaagaggagtcagttaatccatcttcctgtgcactcccccagtacttgaccatttcctctcttatccttaatttcattgtgtacttttctcactcctatcttcacctatgtttaggctgtgtgcactttgaagacaacacccccttccctaggcattacttgttaacaggccaactgtgcagcaaagtagcacaaatccagcttgctgcacatgtccaatgcctaagatgaggctgggcctgcagcaggcttgcaagaaacaaccactcattcattcaatgccacatgagtggttaactggatacaaaggagaagcaaacacaacgaaggcttctgccttaaccttctaggtgtcctaccttgtaccttgaagggattagagagaaaaacattctccatcttgcactgctgatttccaatgacaagtggggcttcccccctcccacagaggattacaggccaacttgggtatggtagggttttggggactggaggtggtttagagttttttccaatcttattaaacttactcagagcttaacatctattaatgaaattatgttttctataataaaagtagagactcaaatcctatagatgccctgaccttaagatataaaaattcaattttaaaaaatattacacataccaaatacaaaagatctattctgtgacctcttctctaacaccaacaactgtaaatttaatatcatcctgtgttacctgaggtagttggaaggtgtttcttctacgtttgttgtatctagctttttcttttcagattttattatttatttatttttgagacagggcctcagtctgtggctcccaagctggagtgcagtggtgtgatcatggctcactgcaaccttgacttcctgggctaaagtgatcctcccgcctcatcgtcctgagtagctgggaccacagggatgtagctgggactacaggcctgcaccaccacacctggacaattttttattttttgtaaagacagggtctcactatgttgcccaggttagtctcaaactcctgggctcaagcaatcctcccgcctgggcatcccaaagtgctgggattataggcatgagccaccatgcctggccagctttttctttaagtgagaaaaatggtgagagagaactgtctcctactcctacttccttttggtcacacagctatctcgaccttgaataaaatttctggatctgacatggtttcagtggctgcaatgagaaaggaagtatacagcacaaactaggagtagatttgttattcatactccaacacctgattaccttctcaaaaaccagggtatttcctgcaacccagattcctcattgacaggaatcatcttggtctgaaggaagggatcaggagccaagaaataagagtggcctctagaagctggaaaaggcaaggaagcagattctccctagagtgtccagaaggagccggccctgccaacaatcttgaattttagtccagtgggactcatgtcggactttggacctacagagctgtaagataacacgtgtgtggtttttaaagccattgatttgtggtaatttgttatgacagaaacagaaagtgagtgcactgacttccctgtaccagtgaccactaactggcatctacactagtccctttccaaacagtagtgctgtttaaaaaaattgttatgtttatcaacatgaagcatcataagaagtcacaatcgtaagttgaagtcaattagaaaaaagaaaattctaacaattaccaaagatccaaacaagaaaaattcagtatcaaacattcctcttatattcacaaaagagacctgaatacacacatgctttaactaaaatgatttctttcctatatgtggaaaaaatgcacttattcattaattcaacacataatttacagagcctctcccacctgccaggcactgtgaagaatcctgagggtttcctgccatctatctgagccagggcaggtgtggaaaaaaattttcacattagttcattaatggtaaaataggaaaaaggaatagagccacagcttaaaagttatgtcgttatagacagagataccagcagagaactaagccacgtgcatttgttatctgtttctgagcagcttaaagcaaccagctaagtgacttcacacagttctgagggtcaggaatccaggagtgtcttagctgccatggttccgcctcagggtgtttcaggaggttgcagtcaaactgtcagccagagccacagtcaactcaaagatggacaaaggctggggcatctaagctcactcctgtggttgctggggaacctcagtcactccccggctgtttgccaggggcttgggttacttgccaggagggcttccccttagagctgctacaagaaggcaggtggcttcttcccaagtgacccgagagagagattctgaccaaaacagaagccaatgtgttttacaactgaaccccagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggccacacacaccaacttacaactgaacctcagaaacggcctgccgtcatttctatcatattctattggtcacacacaccaactgtgatgcagtgtgggaggggagtgcccaagggtgtgaacctcgggatgcaggaatcattgggatcaggttgaagcctgactaccacaccatgttcttccaaaacatttcaacaaaggagccatgtagtaaaatcagcatggttctagaatggcagtcatggggcctggagtagccatggatcggccacttctagaatggcggtcatggggcctggagtggtcatggatcggccacttctagaatggcggtcatggggcctggagtggtcatggatcgcccacttctagaatggcggtcatggggcctggagtggtcatggatcggccacttctagaatggcggtcatggggcctggagtggtcatggatcgcccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcggccacttctagaatggcggtcatggggcctggagtggtcatggatcagctactctacaatctatcaaggcctcggtttccaaagccgcaaaatgacaatggagtcccatctattaataaaactttgggaggtagaagggctgctgcttctgcactcaacgtttactgggtgttcatcatgttccagatactgtttgaagcgttacacccttattaactcactttcttctcatcataaccctctgaggtggttacaatgttcactgctgtgtaagagctgagaagactgaagcaaagagagttcatccatttgccaaagcctcaccattagtaagaggtagtcaggattcgaacctaagtggtttggcatctaagtccacattataacccactgtactctctaacagagggtatggaaatgatgcaagtcagtacactataaaatcatcagcaatactaaactttaaaagaagaaaccacgtttaaaaaattggttaaaaaataggagccaagcatggtggtgctcacctataatcgcagctactagagaggctgaggtgggaggatcacttgagcccacgagttcaagaccaggctaggcaacatagcaagacgttgtctcaaaaaaaaaaaagatagatagatagatagatagatagatagatagatagatagatagatagatagacagacagacagacagacagacagacagacagatatagattccatttacatgagggacctagagtggtcaaacttataaagacagagggatggatgccagggctgggggaatagggaatggggagttaaaatttaatgggcattgaattttagtttgagatattgaaaaagttcgggggatggatggtggtgatggtttcacaacagtgggaatgtatttaatgtcactgaactatacacttaaatgatttaaatggtcatttttatgttatgtatatcttaccaccataaaaagaagacattaaactacaatatccaatattccatccaggggcttcctcaaaatggaaaatccccatggttaatcgctttagatgcatagaaaatcgttccgttctaaggtgtaggaagaaatccaaaaggacttgtcttttctggttggtccatcatcgctctctcaacttcttttcattgcacttttcattacagaaataaaataaaatgtcggaagagtttctgttactcttatctttcccaagtcacattaagtaggaatttttaatttaagtgcattccatttctaaagccaggaaaatctgcccacacgaggtgcttcatagcatacacattaggaactcctctatggttctcattatttacacccttcctcggatgtgccctgtgtgttttgagagtcagagattggcccgacaaaatgaaagcgaaggcgtcagctgagagggacgcggggctttaggtaaaggacacacgatgagaggccctggccatcgggttactgttgtccacgtgtcggatggctagagacgctgtgagagttactctctctagaggtcagcactttggatgccctcaccctctgaaataagcattttctcccgggacatcaaggagctggggactccaagcattttcctcaccactctggtcatctcccacatttaggaggaaagttctacttccatgaggcctttgcttgcctcatttcagaaataggggagggccttctcataaaatgactttttatgccttagttaagagcatatgtttaatttaccactcacttccctctcattatccatctatgtgcggatcacagtactaggtggtatgaagtgagactgagaaagtaagagatgaagaaacttaaaaaaaaaaagctgtaaaaaggacacaggtaaaatctaaccttcggctgggcgcagtggctcacgcctgtaattccagcactttgggaggccgaggtgggtggatcacaaggtcaagagattgagaccatcctggccaacatggtgaaaccctgtctctactaaaaatataaaaattagctgagggtggtggcatgcgcctgtagtccaagctacccgggaggtggagcttgcagtgagccgagattgcgccactgcactccagcctggtgacagagcaagactccgtctcaaaaaaaagaaaaagaaaatctaaccttcgaagaaatggaatgattaagacacatgaataaataaaacaccacttacctagaagtttctaatgtccagtaaacaaattgtcatgcttgttaaagttacatatcacaggtggcttcataagcctcaggacaacctgagaagcagccctgtgctacacggaagtcatgggactagagtagaaacaactaggtccaaaccctgaattccgcattaattcatttgttgattacgacgtccacccatatgacaagtatttagcctaagtctgtttatacacctgagaaatggagaacagtaacaaatgcctgagggtgctataaggattaaacaggtaatttatgccaacgtgtttggtaaatatttacagatgatacaattatgaactgtagggctggatgatatttcaagatatcaatttgtgctcttctctttgcattgcctttctttttctcccacagatcagactctgctcagtgcctcaggggaggcatgtggcagtagagaaagcagaaaccatctgcaaaatctgggatgcagtagggggtgggggagagactaatgcagcctgcagggctgacggagcaggggcctaggccccagttctaagcagggctgccacccagaagcacaacttccccaggagggggatttggatagacagagacacatgcaactcctgagtcctatgtgtggcaaggatgcatcagagagccaatagacatgcacagggggcaggccaagagagccatgcccctaacagcttggtcctggggatgagcccagaaccctgagaagggagatgaagttttccaccacaccagtggaaagacaatcagccagaaattgggcagatgtatagaaaaaaaaatgaaatgttatttttggcacattagagtttggggactgagttttatacccattataatatttaacttcccaacacctaaaatcctcctggcagttaacaacgaatgcccaatggaagaaatgtttcttgtttaatttcataaatacatatagagaagccatcttctctgactaaaaagaccacagattgtgctgctctaatgaaaagagcattggcagggcataaattctgaaacgattttctatatgttgctagccacatagaggatgctaaataaaaagctgttggctgatgggtgacaaattgtccagggcagctcataacttccctagactcttgagatcaatggcacacacctgccaaccagtgggctgggattaggggtataatgtgttgtgatgaatggaccttttctccatgcaatgctaatgggtttatatagaatagaattcatgatacaggtgttattttaaacactgtgctctaaccccttgaaaactgaacaaatagacacatactcattaggccaggaccacatctatcaagttacctaatgcattcccagagcctagaagactactaggcacagagtaaaaattcagtaactatctggtgaatgttaactcacagaagacacaatactgcctctaacttcacctatgaaatgcaaagtagaggcgtaactccaacaaataaagccaagcccagtatttaaaagcccaaaacaaatgaagtgcaacaacagaacaagagctggctagctttccagtgtccccatccaaactagggacacctacagaaacacagaaagttcaaagcctatgggaggggaacgtgggggagggagagggacttatttaccagccccagctttacacttcctccatctcctcctcttctttagcaagatgcctctgtgctttccatgaagaagtcggccccagaacatgacctgcatctcagagaagttctgatttatgaattggcactgaggcgacgtcgctggtgcggaacaccatgacgtctgtgtctagggtatgcgcatatgctgcgtttttccgcaggtgcctcgcagtctgctctggctcttagggcttccgaactcagttcagggcatggattttaattaacgaaatgaaacactggccctacacgacgggacacttaatgaatttatttaatgatgccaaatatggggaacccctttagggagagaagcaaaaggaacaggagaaaaagatcaatttgttaaaagacagtcaaagcaactgagtgttactctcagacaggggggatgtcaactggggagtgatccccagaaaatcaacttcattgtgaaatcagaagtacgagcatctttctttcaactggaattcattgagcatctactgagctgctatttcagcacgcttgctgctgggagacacagaagacatccttcctcctcaacatgcttctgatagacattattaagaaaaactatttttttggctagcaatgcagtttcacctcacatgatttcacttccttggagccgtgaatcagcagtggcagggattatctcccctgaggaaaaccaagatgtgggctggctggctggggtagggtggtgagaggcagtgctgtgcaggaaaggactttctccaggccagcaggctatgcagttacacagaggagcaagccctgcacccaccatcgtgattcccaacccttccccagacctcagcacctccaccaccaccagggaaacaagacacagtcacggcagcggacagcactttaggacaaagggggaaggacaaaggcaggatgtgaggatggtcagggagtgatcagaactgctgggagaaagatcagccattgctaagtgtgtcttcaagccctacacttccctggagagatcacagctttctctggcagatgctcagacaagaggtcacggataggcactgttctggcaattgccagacaaaccaacctctttctgatcccactgagaggctggacaataacacagtctgtagacaaggaaattcaaagcatggcattcctccagggaaaacgctgtgctggaccaggaccagggcctgccaacacctgtgagcagacagattccaaaatgtacagtcacaggctggctcctctgaggcttggctcacagtgcttcatcaaaagaaataaagataaggaagtatcttcctgctatcagcccctgcttcggtggcaccccactcatctcttacccacccttggggagggaatggagatctttaaccctgggtaaagagtacaatgaaacttcattttctgagctcccagaggttttggaacgtgatagctcctacagagacatgattcttgctgaataaataattctaagtcagtgacctgactagggactcatgtctgaagcaccgtttgattcttcaattttcaatttttcctccttttatttactagccaatatttccatgtgacaaccacatgcccatcccattaggagggctattacaaaagaaatgaaaagtaaatattggtgaggatgtagagaaactggaatcctcgtgcattgctggtggggatgcaaactcctgcagctgctgtggaaagcagtctggatgctcctgaaaaagttaaactaccaaacgatctagcaattctgcttctcggtatatgcccaaagcaaacgaaagcagcgactcaacagatacttgcccaccaatgttcatcgaacattattcaatttccaaaaagtggaaacatcccaagggtccgtcatcagatgaacagaaaaaatgtggtgtagacagaaaataatattttgccgtaaaaaggaaaggaattctaataatgctacggcacagacaaaccttgaagagattatgttaagtggaagaagccagacacaaaaggacaaatactgtgtgattccacttacgagaggttctgagagtagtcaaactcacagagacgcaaaacagattggtggtgtccagggttgaggtgaaaggggagtggatgattgtcgcttcacggggtaggaatttctctgaggtaaggaaaaacttagaaatagatatggtgcacaagactgtggatgtaattaatatcactgaattatacactcagagatcattcaaatcacaaactttatgttagatatattttaccaccaaaaaaaacccacaaaaacaaccaaacatgaaaccaaactataaagaagaaaacaaggtggaaataaaaaaaaaataagagcttaagaaataaaaggggaagattgcaaaaagcacacagaataataacattagcaatgctgccatattaactgcatgtagatagtatttactctgtgccaggaattgttctgggtgctatccatataacaacttgtataaccttcatgggaaccccttgatgtaggtttttattattatcctcattttaaagttaataattctgaaaaccagcaaggttaagtatcttgcccaagatcacagagcaagacatggcaaaacctagatttaaacccagaaactcttgacctggaatctatgtttttaaacaactaagctggttgccagtataaaagacctaagagtgagtcaaaaaaagaaaaaaagaaagaaagaaaaaggatttaaggatagggatgtataaacaattatatactacctaaagcaagagagagagaaagagagataaagactaatgaaaccaacatactgcattcttatttcaaaagtcaaatattaattgttccataaatagtacaggatactactgatcttttaggctcacccaagtctctcccagaaaacaaacaataaagcagaaagagcacggaactcgaggttataaaatctgctttaaaatcctggctcaatgacttactttgcttacttcttcatttagcgagtatgtaatgagtacctgctaggcaccagggaacatgctggctagttcactcaacgttttgaatcctagttcctcttttataaaattggaataatatacctacttcacagggttaagaaagctaaatgagataggctatgactgttcttgactcctagtttacactcagtaatggttgactgaagatgttttctcttgcctagtttctcagaataaaaattcgtgatgatgataagatatataaatcatgcggcttgggttttcaatggaggcattgtgactgccaggctgtagacaaatctacacagctactcggctccttgtgccccaccctctttcttacccttaagctggcaagatgatgacacatggcagggcaccgataagtgtcggtttttttctgttcttcccagaaggggtgggaagagacaacagaaaggagaaaggaaaaggagacaggagaaaaaaggaacatggaagaaaaaaaaacagaatgtgaagatggagataggatattacttccttcccttctctcccactggggtagaaagggctgtggtctgcagggggcgtccaccttccatttctctctagaatgtcccatagcatcaaccatgcccctaaaccaaaaatgacacaaaccttctccagactctaaaaagcccctttggaccacacaggacttctctctgtttccccctcccctggacaccaccatacacacagttcaatgatgaccttttattttgcatcatggccaaaacagttattaaggagtttcatttccagggcgctcactaatcaagataacagagactaaaatacaaggcctacaagccttacactcatcactggtgattcgctgagttcaccttgtcaagtaaactgtaagatgctggaagacagagaacgtatctaacagaacatatctatcagtgagtatttgctaaagccacatcttgacttatgacatatggagtgtttggaaacagaagatcacatttctacattccacatagatcgaaagtctagctaacttagagactgctttattttgtccgagtaaggttttccttaatttctaaagttctgtgatggtaagaagaagcccaccaattatcagcccatttacaccacttcactcaagtcttacgaaatgaggccgctgtcctgcgcccccgacgaggagggaaacgagactgatgcaaatgatactctaaggccaacagacagaaccatatttaggatcctatcgggctagctccaaacgctgccttcccacctattcacctgaagttccttgtaatttgttagtgtgaattaaatgacatctcggaaagtgttgcttctgactagtgagaaagttttatgtcaagagaagatgaattgctccaaggagaaaaatatgccaggcaagtccaaacacgtctgcctacctacaagtatgattcccacaagcacgtcctcctcttgccaacccatcttcaaccttatagggtgcagatgtttttgaaagtttctccttgctccaggtactatggaagagacagtgtctggcttcatcctggaaaccatggggtatgtggcatccatcatgttttggagatgggccgtttttacattagccacccttgccaaaatctaagaagcatggctgtttctcatcatgtggtcgctggctctgcgagctgtggtttgaagacggaaacaataataatcctatacataaatgactaacattttatggggaagacagaaaatagtttaaatgttttccatgatcctctttttgaactacaaatgatagtcaaacaggggtcattgccctggctgataattttcagaattgcagaccctacagtaaataacattcacagatggttcctttctttgaatatcaatgctctgccttttgggagctggcagctactcagagaagagcattaaactggccagaaagagacctgggatcctctggatctctttcctttgttcagaacaagagattttgacagattctccggccgccagtcttccagctctggtttccagctctggttctgggcgatccccaagagatcacagatactttgtatactttccacatccaccactgtaattgcagagtccctatcttccttacgattctgtttactagaaccaaacccatcatttttgagacattgccaaattcactgcaggaacaagtcataagtccactgagaagcgcatgccagttgtgaggagactccggtctgacgggcaagatgaccacctcctttttattttattatttttttaaatggagtctcgctccgtcacccaggctggagtgctgtggcgcgatctcggctcactgcaagctccgcctcccgggttcacgccattctcctgcctcagcctcccgagtagctgggactgcaggctcccgccaccacgcccggctaattttttgtatttttagtagagacggggtttcaccgtgttagccaggatggtctcgatctcctgacctcgtgatccacccgcctcggcctcccaaagtgctgggattacaggcgcccgccaccacgcccggctaattttttgtatttttagtagagacggggtttcaccatgttagccaggatggtctcgatctcctgacctcgtgatccgaccgcctcggcctcccaaagtgctgggattacaggcgcccgccaccacgcccggctaattttttgtatttttagtagagacggggtttcaccatgttagccaggatggtctcgatctcctgacctcgtgatccgaccgcctcagcctcccaaagtgctgggatgacaggcgcccgccaccacgcccggcccattattatttctttagagacggggtcctgctctgtcacccagcctagagtgcagtggtgcaatcatcgctcaccgcagcctcgacctcctgggctccagtgatccttccacctccctctcccaaagtgctgggatcacaggcctgagcctccgcgcccggccacctcctcttacagtagttcccaacccattcttcggcctcactgcatggctcacacggaaacatctcagtttaccaccgcacgatgtaagtgcgttctacactcaccaaagagaaaagaagtctgaaggataaggcagagaagagaaaggttgtaggtaggaggattggtgagcagggaagagatatgatggaagaggcggagggaaagacggtaaaggggcgaagaaatgccaagtgaagatgtgtaggcacacagaagaaccgaacccagaaccagaaaggggaaaaactctattgttctgtggggctccaattcacaggtcattaggctttggaggatccccacagaaggttgtcatctgcttctcaaacctctggcaggggcatcaggtgtagctatgctaccacagcgccatctggtggagcggtgggacttatcatgacctaatcaaactcttttaggactaattccgtcttgcaacaattccaggcaataaatacaggtgacaggatatattattgaggaatatggacagctgaagttcacacattgttacgtcctatggattatctcctctcagaacaattgtagagtaactttacaatccacatactgaaagattccctccccattcctttttatctcttcccaccccattttgaacggctcagctatcaacaaaattttcaataagaaatacattgcctttagatgtacctttttcagcaatgtaaaactaccttgcttattattccaatgatctgaattttgagcatctctttaaattacatacagatcaatgtcatgaagcattaaatttattataatatgtaatataaatatctcacacatctagtcattaaacactaatatttactttgttgcctttctttctccacagttttcccatgtgattctcttaagaacaaaatataatacagtcgtgtaaatctaagtgatttattacacaagtgattatcctagagatactgggacccacgacttggggctccaccaatgttcctctgttatataagctcaggtatgagttctgggaagccacagggcatgggagcaaaaccacatgctttggctcagacctcgattggaattcgggcaccgccacttactaaggggccttctcaagcctgtctcctatctgtaaaatgggaatgagcctaccgacttcataggattgctgtgaggattaaatggaaatcggtacgcaaaatggccagcacagtgctaacatctagaaggtgctgcccagccccaaagagatctaccagagaaataataattctcatttttagtcaagctacaaaataagactcctcatttctgatttgttttataaaaatgcaaaaaagagagagaagaaaagccttccaagattctgataccgctcaccccagttttcacttgaaagtcaaccaatgaatgagcaccagggtgaagatggaattctgccagccacagtacctgcaagagtccacaacacacttgactttcattcatgtgtactacaatcctgtgggttaaagggccataaaagttgtcctggtttttcttatacttcaaaggaagcaatttaatggccatgaatgacagcctcccgattacactgtaactatgaaacacgactgttctggaatgatttccaggctggctccctcaccaaaggaacttcaaggtaagaatttaaacaaaataacctttccaggctttcatccagcttcctcatgcaagaggctctatccttgggagcccagggaatgtatgtgcacacaaagggttacgtagggttgaggccagacagagggtggtctggagagttgtgttgaggcagggcaacccagaaaatggacagcactgttccctggggaggcctatatgctacagacactataagaaataaaagaataagggataataattttttttttgagacagcgtctcactctgtcacccaggttggagagcagtggtgcaatcatgactcgctgcagcctcaacctccttggactcagctgatcctcccacctcggcctcccgagtagctgggactacaggcgtgcaccaccatgcctggctaatttttttgtatttttttctagagatggagtttctccatgttgcccatgctggtctcaaactcctgcgctcaggccatctgcccatcttggcctcccaaagtgctggtattatatgcatgagccactgggactggcctaattttaacattttaagggggaaacattacatgaagaatgttggttacaaagaaaaacctcaaaaatgtgggctctgcctatcttactgccattgcttaattagccagatagagcaagccaaaaatattcccattgccctatgactcagcagacaagtataaatgtttctcacagtagcaaagcaaacgcttacagctggaagaccatcacatatggtggagccaacgctgtacttggaactggatttgattttcaatcctggtttctcaattaactagctctctgaccttgggcaacttccctgaacattggtttgctcatctaaaatgcggatagtcacctgtctctataaagggctacccattaaattagaggatgtgaggataagcaaatcaaaactcccttggtatgtcctatgcctcctctcagctggaatacagcagggcctaggaaacaggtccagttttctgcagagagtcatatgggcatagtttaagcatgtaaaggggcacgcttacagtgatgttataaaagcaaaacacaagtacctgcttactgcagaatcctctcacaaacagagaatcctatgaaaactgcaaaagggataaagaaagaaaaagtgggggaagccaggtccttcaaacctccagtcagcagtcactctcaatcattaccagacgtcgtcactgaatttagggcccctgtcagaaccagcacacatatggagccgtggttacaggccagaacacacacctcttgacatttaaagatgttcatcttcaattggcctccatatgagatgtggagtttgagaacctaattgttcccaagctctgtgaatgggttttatatactccgaagacagctagatattgaaaggggagaaaaggcgggatcttgacatttgggaagcaattctactacactgttttaggattggttttaaaaattaaagacggtgatttgatgtttgtgttgaaagcacaaccacgtcctgactgctaaaagaaatctaacctatatgtcatggtcccccaaagccccaaagtggattttaaagttgttaaagtaaaaatctactttgtaggaagagcccgccttgctattctaccttaaaactgatgagcgagttggagggactgggatgttggaggggctggggtgctggaggggcggcggggggcgggacaggggagacacgggtggtgaggaacagtccagggatatccaggctggacccacgtaggttcctcttcctaccaaaggggaactgggacgtgctccctgtttcccagacggaactcctgggtgataatgtgagaagcccttactgcacatctgtctttccccacatacttacaaagttagggggaaagctggaaagtgatatgcagcccctgtataattctgacttattctcagaagattttttaaaaaactaaaaaataaatggaaatcagctgcagccttcctgatgtgtgaatagagacaatttaaaagacatcaagtgccaaatactgacctgtctcgcctaacaaaactgccctgtctttcagcccactgagaacagagggacacacaccacagggaggtgagctgtctcggaaggagccctccacgcagaccccacagctatattaactgtgcttaacgtaatcatgaacacataatcgcggggctattgaagactccataacaaacaagatcaaggagcctggagcctctaaaacatgaaaaccaattagcactatgaaatctaagagcagacacagccagagctcgagaaaaggcatgggcaggagctggactgctcaatcctgctcactcctcccttccttcctgttacacggttctgttctgaggtgctgctgagaggggcttcctctcctgggccagaactgaggctaaggcccgaagctgaggacagaaagtgatcaactccccacattctaaagaggctgctggagaagcggccacgactggggcctgacatccttctctagggattatcaggcagcactctgctacccatcccacaggaccgtaacttatccttcccaatccgtagaaagcaagactctgaagcatgtgcgtttgtctttggccttgtgggaggtttctattcaagaggaaaactgatgccatgaaggatgggatgaggtgctttctcttcccagaagggaaagatttgggtgcctcgtgaaagggagtctggagtcagctccctggtcaatgatctacttgcagagacaactctctgatctcaccttaataaatgagattcattcacctggcactttgggtttcatgtagggggagagatggaagagttaggggaataaaaggagatgaaaggactaaagaaaaggcagaaggaggccgggcatggtggctcacatctgtaatcccagtatttcgggaggtctatgtgggtggatcacttgggtccaggagtttgagaccagcctgggcaacacggcgaaaccccattctaccaaaaatagaaaaaaaaaaaaatttgccaggcatggtgccatatgcctgtagtcccaactactcaggaggctgaggtgggaggatcacatgagcctgggaggttgaggctgcagtaagccgtgatcacaccactgcactccagcctgggaaacagagccagaccctgaccaaaaaaaaaaaggcagtagggcatgacaaaaaatatactgtggggcaatttgtactcagacgtgggaaacaggattaaatgcattagaaaagaactaaactgaaatatttaaaaatgacagtaatcagttaacaatccattccccatggataagaaggctgtgatttttacaccaaaggaaaagtgtttaagtcatagtccctaccataggggcttcaacaaagtgatgccaaagaaagactactgtcctacgaagacagccatctggaggaggtcctaatggtatcacaagcgatgtgacaaaaatgaagtcccttcatttctctcagcctttccttacctgtaaacagggcaagaatggaaggctgaaatagccagaggttccaaacctcaatggtaatgaagaaacacaacctgtgcattgtattctgaaaggcctcggagaaactgtgtccttatccacagacgcacagagcggtgttggagaaacatcagttaccacttgcctaggatgtctaagggctcttgacacatcctgtaatgcgacgtaaataagaaataaaggtgggcctcactgaaagcagaactcctctcagccgaggactggcttagcctgagtttctgggaggtgatctgccctctgggcttcccctccctcggcccattaacatttctgtacttagaagtcggctgggatcctggagggcataagagctgtaagaatgccatgactatttttaaaattttgaaaaataaatactagaggctctggcagcaacagcgcttggggagtagccgtacctctgaagttttcctttcctttctcgagcaacgcagggagggagctgtttaatgaggagtctcaacaccggggaacaaagcagtagtgtttgcacacaaagcttggtgctggcaattttctcggtttcgttttttcatgctgccaaagtcatttgttttgaaaataagagcctctcctttgccctcagcatccctattaagacactaaaccacaggattaattctgtttaggcctgcagagtgaggtaaatcctctgagacacctcagcaccttccccaggtgagacaggagagtccggggatgaagaattcggctctggagtcacagactcaagttcaagtgccagccgtaccgcttgctagcagcgtggccttgggcaagtcacttggcttcggtttcctcctcttagctgcaaaatatgaaaaacgggcctgctatgaaacgactggcccatagtcaacactcagtaaatgataactatataaaataatggtggtaaaaccagcaaaaatcgacaggtgtgtatcgttgggccataatgtgaaaccacgctcaaagtactttaatatagcatccttcaaggcgctcacaatgctgcagactgtaggagcgaagtcagcaatacaggttggaattcatgtattgggggctatactaacatatacaaagtatacgtgatttgtctaggttgtttttgatgcaaaatagcctgaagctagaggacaccacctactcttatctacagtgtcccttctgtttctaggaagagtctacaatcctaactttaatgcatttttgtctaaactaagagtcttcacattttttgaagtcacagaaatatttgtgaatatatatttttaactgggacttgattactttgtaacatgtatgtgtgtatacacatacacacacgtacataaaagggtaacaacgcaaaaggcaatactggtttgtgtatatatcatatagtggaaagaatattagattcaagttagatcatctacttccaacactgcagatggccagagccgtaaggcaagtctctccaatcaggtcttagtattctccttatttaaaaaaggagaaagacattaaaataccttcaaaattattgttgtgaccccaggcagagtaactagaatgaagtagaagaagctattggaatatgacgttgtctcatgtaagatcttttttttttttttttttttttgagatggagtcttgctctgttgcccaggctgaagtgcagtggcgtgatctcggctcactgcaacctccgcttcgtgtcgtgagatcaagcaattctcctgcctcagccttctgagtagctaggatcacaggtgagtgctaccatgcccagctaatagggaggctgaggcaggagaatcgcttgaacccagggggcagaggtcacagtgagctgggaatgcgccactgcactccagcctgtgcaacagagcaagactccatctcaaaaaacaaacaaacaaaacaaaaacaaaaaaacaacaaaaaccccaatattttaaaacataacagtagaaattgtgtttgtgaatgtcataagaagtttctttacttcttctagttctctgttgagaaacaatacagaatcgtatgctctgtctattggggcaacaattcaatcacagcaggataaaaattgacttttaaaaagtgaccccctgctcttgttttctcctctccttcatcagttcactaccagacctcacaccagagatgaagcttctccatgcagagaaagacctaaaactctagcgtgatgtactcatggataagaattgatcaacatgtatccagagcccaatgatgccaggaagaaagcctaaacataatttaataaactccctctctgttttcttcatttcctactactttggtttacttaaaaatgagtgtttgcaggagaaatctgagtgcatttttggcaagcagctgagttatctttgcttattcattaaacgaacagtgtgacggagaaagtccaaataggaaagacaaggaaaaatggggaaaagttgacttctcatcccaaaatatttcttggattaaaaggcaaactcatccaatcttaaggtttagagggctaaaataattgttccatatgtagctgttagaaggcattagatattaactatggcatggtgtctatggatatctgcgtcatctatttagatagtatgtgctgaatatcaaaaacattaagctaaagaaggttaaggaaagatggtgtttccccaaggaaaggtgtgcttatcctagtttgacagtctcctaggaaaacttggatactttcttacataggaaggacatataacatgcttccagagtcacagggtttgaagacggctgaagacgtcatcttgtccccatatgcggcccaggaagagcgaagtctagcaccacattgggactagaaatctacattttaaatcgtattacaaatttagagatctaatggtgtattagcaagataagtttcaaatacatcaacaaaatgataggcagaaggaacctcaaaacttttgtgatctgaattccccatttcatagatggggaaatcaaggccctaagagctgaagaaattgccaaaggttgaaaaacactcctcaaacaccaccttcctcctctctgggacttcatattatttcattttcttttactattctgcctgagctttgactttctggaattttaaataccaatataggaatcatcagctggtgtcaatcctcaataagatgacttaaagtttactcataatggtttagcatggtcagaaagtgaacattattcataacggtttttcatggtcagaaagtgaacactacaggtttggcctatgtgcctgtaaaatttagaaaaaggacataaaaaggaggagaatttaaaaatcacctagaccactgtcgatgctgtgagtgggaattcctacttacaaaggccccagtgcaagctccctcttagttagctgccttctgacccagctatctcaacagagttcattaactctgttaaaaccactaacttatgccatggtaattcacataggagaatggcataactaattaatatgggtggaggggcactggctctagcattaaagtggattgataactcactgaaatctgcatgatcacacacaaactccttatcttgctaagtttacgcttgctccactacacaaactgaacaccagctcttagtaccctcaatagctaccctttcctcactgcagaagaactaagtttttcatcagacacccaaatgaaactgatactggccgtcagtatcattatccactgataccagctaccaattgcttgctggtactggctgtcaatatcattgtccactgataccagctaccaattgcttgctggtactggctgtcaatatcattatccactgatactggctaccaactgcttgctcgatgactgaacataagccaacgacactagccccaagtactttcctaccttttcatccaccattagcataaggaagagaaattcctttgttgtcttcttgagggaaaaactacacaaaatagaaagccttaggctccattacataaagcgttgaaaaccacacaccatgacaataaagacccaagcatgttttcaataaattattttcctcttatttcacactgtgaaaacccacatttgatagactattttatagcaaatgtaccggttatcaataaataagtagagtttccacgtgaggagagaggagaaatctactcccagcatttgcccccttcatgggtgcaacagaacttgtagcaattctctggtttaaacaacaggtggcagtgtcatttctacattttccctggcaagaaacctttgcagtttgtgatttcaccttccaggaggcattaacagttttgtaaccgcctctatcgacagcgtgtgcatatgttcctatgtagtaaatgcaaatgcatgcaggaaaacattgagatttgtgtaaatgcagtttcaccaagtgctactctccccatacccacgcccctccccacacaatagtctatgcacaggcatcatttcccttgaggaaacagcaaagcagggaaaaggcagaaggaaaatcgactccatcacatatgttctgatcctcaattatcatatacatgtctgtcacccacccattcctgccacacatacaagagaaaggatacactacaaggtcctggggcacactttgggcaaatgactgagaaagcgaagttctgagaaatcttaattcacatcaagaaaagcactctactgtactgacatttctggtaggcgctgttttcactcttctgctacaaaagagcatgctccatatttgaaaggaatcaacagaaacaggtcttacattcccacaaggaaaacacagaagtcaggaccattctcacatgtgccgagaagacaagaccacgtttcctagggtttttgtgtgagctttaaataggagaaaagtgccatgtcaagaattcctcattcaatatctatagctcagttttttgttcacatgcattattttattttattattatttttgagatggagtctcactctttcacaccagctagagtaaagtactgcgatcttggctcactgcaacctccacctcctgggttcaagagattctagtgccccagcctcccgagtagctgggattacaggcacgtgccaccatgtccagctaatttttgtatttttagtagggatggggcttcaccatgttgtccaggctggtctcgaactcccaacctcaagtgatccacctgccttggcctcccaaagtgctggggctacaggcatgagccactgcacctggccacataattttataatgtagcagcaggtactctgtggtttctagcctataatgtaacagttattggtttgatatgttacatttatttaattttgaatctgtggtgtttttttaaagcaatttaacaatgaaaatctcgtcaatgcagcagggatgagatcaaactgactgatgggtaaatcaccagcctaaagggacacgccaggtattagacagtctggcatgtgtagctggagaagtactcaaaaatgtataaaagtcaatgagcacatatacggagaattacacagaaaataataagcagcactagaaagagatgatgtgtgttttttgtactgtccctgtcacatagcatcaaacatccacattcctgctttctgagatgagagggttggacaagtaccctcaagaagctttctggtatacggtacacagtatcttattgttttataaatagaaaaaagagaatacagaggaaaaaattaaaatacatcacctagagttcagaggcattggaggaatttggctttcatcagcaattttgcattaaaagcaagtatctgtcggccaggcgtggtggctcacgcctgtaatcccaacactttgagaggccatggtgggcggatcatgaggtcgggtgttcgagaccagcctggccaacatggcgaaaccccgtctctactaaaaatacaaaagttagccgggcatggtggtgcagcctgtaatcccaactactcagaaggctaaggcaggagaattgcttgagcccaggaggtggagattgcagtgagccgagattgcggcattgcactccaggctgggtgaagaacaagactgtctcaaacaaacaaacaaataaaaaagtgagtatctgtcctaagcaacacattgtcaagtgcggcctatatgatttcctggtggtcagataatgttgcattcatgctttctgtaggaagtggggtttcatgaaacagcatgaactatgaactttgaacgaagagtcacgggcttatccctgactctaggacttagtagcgtggttaatcacagccgcattattaatgtctccagttctccaaaatacggtaaatgacaccataacagatcttttgtaaagctatggtggatatttttaaaggattatttattcatagtaggtgtctgataagagctacttttagacttttggacttgtagataacttcttttaatttcctattaaaatacccaggaaggtacagaatccagtgttggggctcataaaccaataccctaaaatacagcgctttgacatcctgaactgaagaagcctccaggtctctctggccttccactttacccactgtctctcaatcttctctctctcccaagcagacgatgaacttgttcattggagttcccttatctgcccaaactcccagacctgccaaagaagaaaacaatcacctctggctctttccctgcgtcttcagtaactgaactcctatcccaggaacaaagactgaaatctgtcaacacacctgaacagactcctatctgctttgcgggcccaacagatggtcccaggccatggtatgttcttcaagcccactgaattccctaaaaatcagttcctaccccgttaaaatcatccacacttccccatctccctttcccctaagaagaagggtgtatacatctgtcccccagggcgtggtaggtcatcactgtgactctccctcatgcacattaacaaacgtgtatgcttttttatgcctttagcagctgattttcagcaaaacttcagaggaaaaaggggacattttcccttggccactccactagccacagtcctataagctaaagataacagaagttcccctatccaacaatctcaggaaagtttcctttaagttcagcattaatcactgaatgttctaccatctaacaactgtatggcattttaaaaaatgtttaactgaggttaaatatatataatgtaaaatttaacattttaagtattcacttcaggggctacaaagtacatttatattgttgcacaaccatcacgaccatccatctccagaactttcttcatcttctaaacctgaaactctgtgcccattaacaataacgctccattcccgaccctctcccctcagatcctggtacccgccattccgtctctatgaatttcaaacatgaggtgcctcacagaggtgaaatcatgcaatatttgcccttttgtaactaccttatttcacttagcatgtcttcaaggttcacccatgttatagcatgtgtcaaagtttcctttctaaggctgaattccattttatatgtggcacacattttgtagatccatacatctgttgatagacacgtgggttgctctcaccaaatgtgtacaaatatctgttcgagtacctgctggattccaattttggggggtgtatacctagaaagagaactgctggatcatataataattttatttctaatgttctaaggaagtagagagcattttgaaatgtgagatcgaggcctaagcagtcattcttgctaactggaatgctggagtgctgagctggtcatggctaggctgatcccgtcagtggcggacagaaaagcattgacatgaggtctataaaaaaataagtatcagccaggcactctggctcacgcctgtagtcccagctacttgggaggcggaggtgggaggattgcttgagcccaggagttcaaggccagcctgggccacacagtgaaaccccatcacttaaaaaaaaaaaaaaaatagaatagtaaaagggaaaggaaacatcatgctaaagaaacagaactggctgggcgcggtggctcatgcctgtaatcccaacattttgggaggccgaggcaggtggatcacctgaggtcaggagttcaggaccagcttggtcaacgtggtgaaacccagtctctactaaaaatacaaaaattagccaggcgtggtggcatgtgcctgtaatcccagctactcgggaggctgaggcaggagaattgcttgaacccaggaggtggaggttgcagtgagccgagatcatgccactgctctccagcctgggtgacaatagcaaaattcagtctcaaaaaagaagaaaaaaaaagaaaaagaaacagaacaacagcattacctgtgaaaaatctttcaacacagcaaacacaagaaatcttgctctcagtaggacaaaggcaggcagaagcactgtggaagaggggccaggaggggctgagatgagggcagaatgagggagcacagcgagctaactaaggtcaaagaaaaagaaaacaaggaagctggaattatgttaccgagaataaaatagacattggaaagaaataatggaaaaacagttcagccaatgtgtggccattcagaagcatcctgccttgtcggtctaatgctaagaatgatgggagaaggggcttccaatctttttctatgattttttttttgtacctagttaaaaacccactgcatttacagttatcaatgaaactgttctgcttaataccataatacaagtgtctttccaaagttttttgttccctgaggacagaataacaaatgtcagaacatgaacatttttagggcttctgatacatactgttgccaaaagtatcagcaaggtatgaggccatcagcactgccaccattaatttttattctttttttttattttgaaagaatcttaaacttagagaacagtgcaagaatagaatagtataacttattttttcttagctatttgaaagttagttgccaacacaatggcccatcacctccaaattgtgtatttcttatgcacaatgacattgtcctacacctatgaaaaccaggaagttaacattgatacattactaccatccaatcctaggttcaccaatcattccaccatgatccttttcacagcaaaaggttccagttcagaatcaaggcttctgtttgcttgactttcatgagcttgacacttttgaagactagaggccagttattttgttgtataatgcgtctcagtttggggttgcttgatgtttcttcacgaatagattgaggttctgcatctttggcaggagcatcacagtcatgatgctgagttctcatatcctatcacgtggtacataacttcaatcagtcttattactgatgttattaattttgatcactaggttaaagtgttatctgtcagacttctccactgtgaagtttctcattttctctttgaattcctaagaatttgggagtggggagagttactctgagagaatgcatatatgacattcctcagcaaacttaggactttaagcactgaactcacaaattcctattttattcagtgagttataacctattactaccgttattttgatgctgaaattgccacagatttggctagcaggagcctcttcaagctgactcctatgtccttctgctatatcctcatctttggacatttccttactttatgaaacaagaagacatcccaggctcatcttctacttctctgtcccagccctggaatcagccattcttccaaagagcacctttaagtagcgaacagtatttagaagccaaagtcccagactaggtgtgcactaggtgttacagttcccaggtcctctcagtggacacagccgggaaatatacgtatgtggaacacacagacacaaagatctgcatctatgtttatttctacacagctctttctctctgtggaataccaagagttcacaccagtctctctaatgaacagagttttattccagttccttccctttccaaaacaaccagccgtgtctctgttgccctctcctgcccggctgccaggtttccacgtgaatgctctcactcccctgagttcagacactcagctttgagccaaagtggcttccctctctcccaggaccccacgctccacagtcaaggcactcaacttgctctgcctcatctcatgacttttgaactgagctttagagaaacagtaagaacaagacattatcaatttcatagatgagtctgaatattttaaatgtttgccatcatatttctgtaaaaattgtgcttcacgtgctttgtctatttacctatacacacctcattgattttaaactttttttctttgtttacagatggggtcttgctctgtcatttaggctggagtacagtggcaaaaatcacagctcactgcagcttcaaattccggggctcatgcaatcttcctgccacagcctcccaagtagctaggaccacaggtgtgcaccaccatgctggcttttttttttttttcctgtagagatggattttgctatttttcccagactggtctcaaactcctgtgctcaagcaatcctcctgccttggcctcccaaagcactgagattacaggcatgagccaccatgcccagcagatttcttcttgattagtttacgctgtatgtgtgttaaaggtatcaatgctttggcttaaatgttgcagataatttcttgatatcttatttggttcttgacttattttttttaatagaaaattgtattttgttgatttagaaagcctgaaccccttgctacttttctatttcctctgagccccatttttctctgagctttttgcatttctgaacttctccattactctccactccagtgattctcaatcagggctgattttgctcctccccctggaagtctggcaatgtttggagacatttctgagtctgaagactgggtaggaaagtatgattagcatctagtggcaaaggcctaggatactgctacacaccctacaatgcacaagacagcccccacgaccaaaggttatccagcccaaaatgtcactagtgtcaaacgctgctctggagtctctcaaacgctttacagctattcttttgatttcttccaaaacaagacattagaaaagaaaggctaaaagaggaatatttttcatgtaggcaatgactttttctaaatcctaggtctgagttacaaatactggtcatagaaccttatagaatccaaaagcattgtcaaaaagaccaaccaaaaaaaccctatctttgttatttccacaaaagatgatcgtagctgtgttcttgacataaagggactcacctaattcataaagttttaaatctgtgtttgtcatgtggtcaagaattcatatctagattacctaggtccatctgtgctatcttaaatgccaatgaaagaaaaatgtaattattaatttaattttttcaaatcctataaggccagtaccaaggtactaaatgtaaatatatacatacatatatataaatgtacatatataaaatacatagttttaaaaataaagaacagtattacaaataaaattgttgctttcttggaactcaggcctttgaaagaaaatacatatatagcagcatggcatgaagcaatttaacaagatatgtaagatatattagaaagaaaggagatttttctcttcacaaacacaatatatatcttcttggttatagacttgttacttgcctgccagaagagtttactatcatcttcacaagtattcaattctcagaaccaagggatttcacagcctcctctacccaatcaaagcagtgtcttatggggtccgtctgaacgtaatcctgtcctactgacggatttgacatctatttctgccaccattgcacaagaacacagcagactgctgactgcaataagacttatctagaggctaacaggcaagcaaaatctatactgatttccttttcttcagcacaataccttttaaaaagtaccataaataaaacagtgttctcaagacctgtgattttcaacgagaaattactaaacacattggggaggcttcttgtggtcttgatttcctaatgagctatgggaaattacataatgaagagaattcttcttggcttcttaggtttcaaaagcctacaaagtctgtaaattctgtttcctttccaacaaacactaaacctaacttggtattcgaaactttaacctctccatttcaaatgctttagttttggtcctgactcattacaagaaaggaggctgttagaatagcaaaataataattatgatgaaatcataacaataataacagtagctaacacttattgaactgagcgctatatgtcagatagtattctaaatgctctatcggtgtaaactcacatcattctatgataagctacaaagtagatactcatcataataatcagtcgcattttatagataagaaaactgaagcccaggagtgtgaataggtttttctaggttagaagcagaattgaagtcagaaagcctgactgtaaactcatggtcttaaccacttttctggctctctgattcccaccctctcaacttttaacgtgactgaatctgaaactcatcattcattatagcatcaaacctacatctccctcttcttaaggcctacctgcatgagcatgtacctgttcatacagctcccagaacaaacgtgtataggtttgtctaagtaaacagcaaatttgattgtaaacataaaaactaaagagaatatcattgctttgtaaaggtaacggtgaatgattctcaacgccaataccagaaacatgtgacaatcacaaggcagtcaccaatttaacagagagaaggaaagtatgaagtgtatctctcagtctctgatagaagttcctttcttcacctcgggtgaaggtcaggagttccacttctactgcccttgctgtcaccaaacagcaaagttcaaggaagacagaggagctttgaagccttctgacatgggtacagaattctactatgtctttttgtttgagtacaaaatatagctctagcctgaagaaagacttagagttaatcttcctgtggtacagatggtatattctgattcctgatcacccacactgcgccacagagcccctgacacagaattgtctgtagttaagtaatgggaggtgaggaagtggcctcagagaaggactaacgtccacagacttgagttcgtacaaccacaaaaatacctgcctggccaactagccacccagtctagcataaagattggtcatgcagatttgtggaaagaaagaggtccaggaaatgcttcttggaaggcagaacatttacttattcatcattatattattgatcagcctccctacaccctgattaattatcactccattgatgaaaagctatctcaattcaattctattgctttctcagcaatacaggcaaaaattttacatagcaagttttttgtttgtatatttttattcatttttcagcaaatcaaaacccattcaaatggaaaatggaaagatggaaaaatgaaactgtgcatttcaatgtgatattgagcataggatatcagcagctcacttcgtgggttctgtgttgcttcgacattctgtctgtgacctcttggaaggtttgactggtaggggcacagcacttcaaactgtgacataatcagcgtttcctctcctaggttaagagggacactgatcgctggaaacatgaacatccacagcaactaagagtgagcactgctgaacacagccacagactgtggtccttcgttaaacaaatgaaagtctaaatcaaatgacgagagaacgcaaattcatgatcattatgaagcaaatgcattgctgtacttaagacatcagtccctctacagagaggccatcacctctttgcacaagtcaatatgggcaaaaattgttttcaaaaaccaggttggttctcaaacattaaaatgcacatatcagagaaaaatgctctctcaagcatctctatacgaagatgttcattacagaaatgtttgttatggtggaaaatgagggccaatgtctatcaataggagattgagtatgagaactacagtgcacagcgagggggtaagaacgtgggttctggagccacgcagccttgctttaaatcctgactttgacacacactaacagtgcgacctgaggcaacttacataacctctgtaaatcttggtttcctcgtctgtatataaagagtttagtaaaacacttgacatatacgagctcaataaatgttagcaattattattatgctacattatgtatatggacattttaaaaagatagggctgtatctatcagcgtagaaagatggcctgtgtcattgttaagaaaatgtttccagcaaattgtagatgggtataactaatataactctgcatgtgcaaatattgtgtggatacacatggaaagtattctgggacacataccaaattgttacaataaatccctttcaaaaattaggagtggctgggaggagaaggctttcacttcgcactttccatggtgccagggtaataccacctcacaacagtaaatagcaaaaatagcaaccttaactctagattttcttatctaaattttaattctgtgaagaattttccatttccctttttcaaatcaggatataggatgcaatttagaaagagtgagatcacttgttagactgtacgatttttaagcatcaataaagtataccaccgaacttctctaccaatccattctctaaacttcccaatcaggtgtgcctctccatttaggacacaggcaggtttttgttccaactcacagtgtaactgccctggtttcagtatccacggtgaatgagaacagctaagagacacaagtgctgggaattaaagaagcatctacttaaaaaccaagctcttgctaatcagtgagaagagtctcaagagatgatatgctgaaggcaccgagggagagctgtgttggaatgtctgtctgtgcataactgtggtccttcaaaacgagcaattagaaaacagagatgagataatatagctagctctcgcagattaatcaaatgtgtcttgttactagattagagaattcaaagatatgacagagaatattaaatgtctgaaaatgaccaagtgtagctgcttgaatcatttcccccacagttttcagtagaaaagagttgttctttcccattttccaaaatcattactattttagcattgtcaaggaaaaaaaaaggacttatgttttgtacttttcacagtgtagaggatgatgctcagaataaattgtttcactttgggagttatatttactagaagaatgaagctcttgctttccactttaagacaaagagagggacatacaacaaaaaagacggcacgttcaggggctacaggggcgtgagttcaaatcctggatttccaatttccagctatgtatctttggtgagtcatttaacctcagaacccacttcacaggactattacaaaactgtgtgtgtgtgtgtgtgtgtgtgtgtgtgtgtgtgttactgaaaaatatcacccagtacttagtacacacctagtagttgttagctactatttcagagagacttctgtggatggcatatactgatgatttggttaaaaaaataaagaataaagacagttaattctttcaaaattattatatgactatcactgttaggtgggaggggataaaatgaggaactacagagatcactgaatttacagcaaatgtcctggccaggtaacctagaggtcaaattgagatgaaaatcaggttgcttctatcatagtccaatattttttcatactccatcagattctgctttctgcaatataatatggaagcgagaaaacaagaaatattccaggatacagtcacagatgtactatatagcttacattttatctttttcccaaaaaagaggaacctcattctgcctgaacaacaaaaggttaaagatgtattggtggacagcatctaggaagagagatacaggaagtggacagcatctaggaaggagatacaggaagtggacagcatctaggaagggagatacaggaagtggacagcatctaggaaggagatacaggaagtggacagcatctaggaagagagatacagcaagtggacagcatctaggaagggagatacagcaagtggacagcatctaggaagacagatacagcaagtggacagcatctaggaagggagatccaggaagtggacagcatctaggaaggagatacaggaagtgggcagcatctaggaagagagatacagcaagtggacagcatctaggaagggagatacagcaagtggacagcatctaggaaggcagatacagcaagtggacagcatctaggaagggagatacagcaagtggacagcatctaggaagggagatacaggaagtggacagcatctaggaaggagatacaggaagtggacagcatctaggaagacagatacagcaagtggacagcatctaggaagggagatacagcaagtggacagcatctaggaagggagatacagcaagtggacagcatctaggaagggagatacaggaagtggacagcatctaggaaggagatacaggaagtggacagcatctaggaagagagatacagcaagtggacagcatctaggaagggagatacagcaagtggacagcatctaggaagacagatacagcaagtggacagcatctaggaagagagatacagcaagtggacagcatctaggaagggagatacaggaagtggacagcatctaggaaggagatacaggaagtggacagcatctaggaagggagatacagcaagtggacagcatctaggaaggagatacaggaagtagacagcatctaggaagacagatacagcaagtgaacagcatctaggaagggagatacagcaagtggacagcatctaggaagggagatacagcaagtggacagcatctaggaagggagatacagcaagtggacagcatctaggaaggaagatacagcaaatctaattcagaagaaaagaaacagattgccctgaatatgacagtggccatcagaaagggagctgtaccctccacccaaatgtgtcccaaacacaaagacgtctcacatccctctaaaaaccgaaaagaggtaccagtactgtgacggtcattttctggaattcattaattgaatcatgaagagaattatgtaaggtcaaaacactcatacctcagaaaaagctgcgtcctatacactaggctagcccacaccaaccacaaagaaagcacagacagaaatttccaggacttggtgtctttgcaaagacagagactccagccataagcttagcaatgtaccctcttgatgaaggaagtgagcatgatctctccctttgtcatctgagtgatgtatgattaagctcaatagaggtatagattcagtgatgttactgagaggaagcaacagaattttcagtgacctaaggtgctatatgtgagagtcccaagtgttctaaagaaaaacctggcccagcacagtggctcatgcctgtaatcccagcaatttgggaggccgaggcaggtggattacctgaggccaggagtttaagaccagcctggccaatatggtaaaacactgtctctactaaaaatacaaaaattagacacacgtgctggtgggaagtcccagctacttgggaggctgaggcaagagaatcgcttgaacccaggaggtaggttgcagtgaaggcagagattgcagtgagccaagatcgtgccactgcactccagcccatgtgacagagtgagtgagacttcatcccccacccgccaaaaaaaagaaaagaaaatgaaaacccataccagaaaaaaagtttctctttcttcaaaaacagtccttcttttgaccttccctaggtcttgcagaagagagcataaagaagtcttagatcaaatactcatttatatcagtgacttctaagtaattacctgcatctataggatatacagagtttaatcacatacccttgaaagacgcactccactaaacaaaattataagtacacctcattgcgtgtactgagcttcactctgctgtgcttcatggatcttgtgtttactagatagaaggtttgtgaatcctttgttgaacaagtctattagcaccatttgtccaatagcatgtgtgcacttcatgtgtctgttgtcacattttggtaattctcacaataattcaaactttttcactgttctatctgtgatgcttatcagtgttctttgacattactactgtaattgttttggggcaccatgaacagtgcccatatgagacagttaacttaatccatgaatgtgtgcattctgacagcttcaccaacttcattcctgtctctctccctctcctcaggcctccatatccctgagacacaataatactgaaattagcccagttagtaaccttacaatggcctctaagtgttcacgtgaaaggaggagttgcacatctctcgctgtgattcaagagctagaaatgatgaagctcagtgaggaagacatgtcgagaactaagataaactgaaagacacatgtgttgcacaaaacagttagccaacttgtaaatgcaaaagaaacactcttgagggaaattaaaagtgctactccagtgaacacacaaataatcagaaagtgagacagccttattgctgatagggagaaagtctgagtgatctggacagaagatcaaataagccacaatattcccttaagccaaagcctaatccagaggaaagccctaacttgcttaaattctataaaggctgagagaggtgagaaacgacagaagaaacggtggaaagtagcagaggttggttcatgaggtttaaggaaagaagccatctccgtaacttaaaactgcaaggtgacgttgcagcaagttatcaagaagatctagctgagatgactgatgagggtggcaacaaggaaaagcagactttcagtgtagatgaaaccgccttatattgggatgagataccatctaagacttccataactagaggagaggtcaatgctttgcttcaaaacttcaaaagacagaatgactctcttgttagggtctaatgccagctggtgactttaagttgaagcaaatgttcatttaccatttaaaaaatcctacagcccttaagaactgtggtaaatctgtactgcccatgttctaccaatgtaataacaaagcctgggtgacagcatatctgtttttaagcatagtttactgaatatctgaagtccattcttgtgacctactgctcaggaataagattgctttgaaaacattactgttgattgacaacgcacctagtcatccaagagctccgatggagatgtacaagaagacgaatgctgttttcttgcctactaacacaaaatctagtcttcagcccatggatcaaggagtaattcaactttcaagtcttattatttaagaaatacattttgtaaggctatagctgccatcaatattgattcttctgatggatctggggacagtaaattgaaaaccttctggaaaggattcactattccagacaccattaggaacactcatacttcatagaaggagatcaaaatatcaacattaacaagagtttggaaggttgattccaatcctcatggatgactttgagggggtcaaatcttcagtgaagaaagtaatcagaaatgaaaaacaaggcattacaactgataccacagaaatacaaaggatcattagagactgttacgaacaacaatcttgacaatgctgacaaactgaaaaacctaaaggaaataaatcctagacatacacaacctaccaaaattgaattaggaagaaggagaaaacctgaaaaaatcaataatgagtagtggaagtcctagtcagagcaaccaggcaagagaaagaaacaaagggcatccaaattggaaaaaaggaagtcaaattgtccctctttgtgaatgacataatcctatatacagaaaaatctaaagactccaccaaaaaactctttgaactgataaatgaattcagtaaagttgcaagatacaaaatcaatatacaaaactatacatcaataacgaagtagtgaaaaaagaaattagaaaagcaattccacttacaacagctacaaaaacataaataaagtatctaacaataaatttattgaaggaggagagagaactctagaaggacaactatgaaacactgatggtagaaactgaagagaatacaaacaaatggagatgtcccatgcttataaattggaagaattaatattgttaagatgaccatgctacccaaagcaatctacagatgtaatgtaatacctgtcaaaataccaaaccacatgtttcacagaaatatttttttaaatcctaaaatttgtatggaaacacaaaagaccatgaatagccaaagcaataatgagcaaaaataacaaaacaggaagtatcacactacctgacttcaaaatatgctacaaagctataggaaccaaaaccatatggtactggtataaaaacaaacacacaaaccattagcatagaatagagaacctagagataaattcacatatttacagccaaccaattgtaaaatgtgtcaagaaaacagactgaggaaaagacaccctgttcaataaatggtgttgggaagattccatatccaaagcagaagagtgaaaggagaccattatcactgtatacaaaagtaaactcaaaatgaattaaagatttgaacataggacccaaaactataaaactactagaagaaaacacttcaggacattggtctaggcaaatattttatggctaagacctcaaaagtacagccaacaaaaatagacaaatggcactatattaaactaaaaggtttctgtacagcaaagaaaacaatcaagagactgaagagacaatctgtagcaataaatatttgcaaattacatgttcagcaaggaattaatatccaaaatataatccagttaaaaagtgggcaaatgatatgaatagaaatgtctcaaaagaaaatatgcaggccaggcacggtggctcatgcctgtaatcccagcaccttgggagacagaggcgggcagatcacctgaggtcaggagttcagaccagcctggccaaaatggtgaaaccccatctctactaaaaatacaaaaaattagccaggcgtggtgacacacgcctgtaatcccagctacccaggaggctgaagcaggagaattgcttgagcccgggagacagaggttgcagtgagccaagatcctaccactgcactccagcctggctgacagagtgagactctgtctcagaaaaaaaaaaaaaaaaagaaagaaaaagaaaaagaaaatatgcaaatggccagcaaatatatgaaaaaatgttcaacatcactaatcaccagggaaatacgaatcaaaaccacaatgaaatatcatcttaccacagttaggatggctgttatcaaaaaaagaaaagataacatgctggtgaaaatgcagagaaaagggaactcacacactgttggtgggaatgcaaataggtacagccactgtagaaaagagcacagcatttccacaaaaaaactaaaagagaactaccataggatccagcaatcccagcactgggtttcctttctttctttcttttttttttttttttttacaaaagaaaggaaatcaaagggatacgcacacccccaatgcgtattgcagcactattcacaatagctaagatactgaatcaacctaaatatccatcagtggatatttaactccataaaagacatacaagtaacaccactctactttcacgcatgaagcattaatggataaagaaaacatagatacagacatgatggagtactattcagccatagaaaagaatggaatcctgtcatttgcagcaacaggaatgagcccgaaggacattatgttaagtgaaatatgtcaagcacagaaaaacagatatcacatattctggctcttatgtgggagcaaaaaagatgttgttttgtgctcatcaaagtagaacttgtgggtattggaggctgggaaatggaagaatgggagggaggttgtttgatggatacaaaattacagttacatagagaggatggagtttgcgtgttctgcagcattgtacgctgaatatgctcaactgtattatatttttcaaaaagttagaggagagtattttttaatgttcacaacacaaataaatatttgaggtgatggtatagtgatcactctgatttgatcattacatattatatacacatatgaaaatatcactctgtatcccataaatgtgtacaattattatgtgtcaactaaaaaggaaaaaaggagttgcaccatcgccacacctgtcacatagatcataaatacaaacccgcacacaaattacgttatttactatgtatcattgatgtcagagccctaaaaagccttattaagcctcttgactacagttttcaaacttttttttgcagtggaacgcttacatcaaacaatgttacgtaaatcccaaaatagaatcccccagtaacagtgatctcatgaaatcaaggcaaggcatgtggacgtgtttagtgggggtgcacaagcatgcctgtgcttgtagggagaggacagggctgcttccccaaaacactgtttgaaaaaatcactgatgtattacaagcttcttattcccagacaaacttagtatggaatcacctgccaggtaaggaacttgcttatacataaagtgagggctatagactagaccttttatctgtatgtttctagcaatgttttatgacactattatacagggttttcataggaaatcacataaagaaaggaccattgatacgataatcattataataaatcatactaaatgatcttggtagcaaactagttgtcaagcaaagaaggattatgggtttattcagaccaacttctggaatcttatttaggtattaaatatatattaaatatcaaggtcagaaaccaaatgaagtattaactggcaaaatccattattacaatagaaataacattgatccctggaaataaaaattatttcagattaaaaagaagttatggggccaggcgcagtggctcacggctataatcccagcactctgggaggccgaggcaggcagatcacgaagtcaggagatcaaaaccatcctggctaacgtggtgaaaccccatctctactaaaaatataaaaaattagccaggcgtggtggcgggcgcctgtagtcccagctactcgggaggctgaggcaggagaatcgcttgaaccagggaggcggaggatgcagtgagcagagatcgcgccactgcactccagcctgggcgacagagcgagactttgtctcgaaaaaaaaaaaaaaagttagtgaagaagctgatttcaaagggttttactgctatgaagataaaattaggttggtttcattctagctttattgtagtctgcagagactaaattgaaatcagccattttaattcagaaacaatatttaggctgtagaaagcagagtgataaccaccctgcctttgtttaaaatctctgagacagaagggatatttcctgtagcagcataaattacagagactctaaagttacgttgaaacgacccttacaccctcgaagcaacgtgcaattttgtggctgtaattttctcaaactgcttaataaaaccttctcctttttatcagaaaaaaagaataaacaaaataccaagaactccataaaaggcatacaaggaacattactccactttcagccatgaagtattaataattaactgttgggcaggcaaactgagttagcagtcttttcccacaggacatcttcctgtcaaaatgtcacccagaaataaccctgtagattacaggaaggggctgcaattccccacagtgcatctcataaccataaatggcctcagagtttcagtacctgtcatgatcaggtcacctaacacctgggaatctctcactctccccctcctctacccacatatttgccgctaacacaccaataattgatagtatctgcatttctgagcattaccagccatgagctgcctgccctagcactgaaggagagacagatggcagccagacagaacgggatggagagctcatatccgagtcctggctctgcccttgattcactgagcaacaacctctcaccaaagatgggatcataaagctccattccctcgcattcaaatgctaggaatcctaatttgataatttctaccatgaactttggtgtcttctgtactcatatttgctttctgctcttttgaggaaaaaaatcagatacaatattgtgactatgaaatcatcttctcatttttagtgattcaaggtcaggtgaaaacagaaccgttagtttccattccaaacactgatacatgtaaaaggttatatactttagcagagtcctcactggaaaagatgtagatttggagagttcaggcagacatgggttcaagtactggctccactacttaactagttatgtaattttgggtatgtgaactaactactctaggctttaatttcctcaaatgtatataataagaatgataatcatgaatgctttagggatcgctgcaagttgcaagctaaacctgctaaatatgcaactagcatacaaccgagcaatttgcattcctgagcatttatcccaaagacatgaaaaaccatgttcccataaaaccagtgcatgaatgtttacagcaactttatttatagtaataaaaaactggaagcaacacagatgtccttcaaagggtgaaaggttaaactgtggtccatccacaccatggaatactaattggtaataaaaaaaaaactagggataagggcaacaacctggataaatctctggagagttattatcctaagtgaaaaaaaaacccagaaggttacacactgcattttctatttatacaactttcttgaaatggcaacattagagaaatggagtacagattagtagctctacaggttaaagagcggttgggatgtaaggaaagtgaatgtatctataaaagggcaacgtgaggaattcttgtggtgatagaaatgccctgtttcttgaccatatcaaatgtcaaaacatcaatgttctggccgggtgctggctcacacctgtaatcccagcactttgggaggccgaggcaggcggatcacgtgaggtcaggagttcaagaccagcctggccaaccatggtgaaaccccatctccattaaaaatacaaaaattagccaggcgtggtggcgcgtgcctgtaatctcacctactcgtgaggctgaggcacgagaatcgcttgaacccaggaggtggaagttgcagtgagccaagatcacgctaccgcactccagcctgggcaacagagtgagactctgcctcaaaaaaattaattaattaattaaaaaataaattaaaaatttttttaaatgtcagtgttctggttgtgatagttttacagttttgcaagatgttgccatctgaggaaactagataaaggttacaaagtcctctctgtgttctatcttacaactgtatatgaatctataattatctcaaaaataaaaggtttacttcaaagaaattaaaataatcatatttcagaatatcactgcaaagattaaatatatagaattgagcaataatttaaaaattattacgtatatgaaaaattgcctagcacagacagttcttggcaataacagaagctcattaaatgttaatttctttcctctaagaagttgtacatagacagaatgcatcctagtagatttttatttgtggatcaaatgaagacgtaactccatgaaagggtctgatcataacatacacactttttggaacatttagcctttttttccctatgaatctgaactttgaggaagtattatttcacgctaaataacattcatccacattcctacagcaaaactgtacaactcaggtgccaactaatttcttccatcaaaaaatatgaccagtggagcaggttgtaggggattatgatccagttggttaagagtcacagtcaaaaaagatgaatcaaggccaaaaattaattggcatgctcttttacagacaatgaagaaagaacatgaaaagaataaagcttggtttcatgtgctcaagagttcacagctagttaagacaggaaaagtctcatatatgaagactcagagaacaagtggagaacagaccatcagtgcaaaaaatctgcagaagaggtggaggtgagcatggctgggggcaaatgagtgcagaagagggaggtgagaggtgagcaaggctggggcaaataagggaattgggggctgctggctccacacagcactgtcggactgcgtgaagaactgatggcagacgcacgaccttggccttctggaggaccgcggcaatccttagtactttgccgacgctgcaatgtaatcccacctttcccagagttctccatcccctgctgccagatccctgccgcacaaattcgcttgtatgaagctcctggctactttataagtatactttataagagaaaatacagacacacagacaccttcctcccccaatatatgcagacagtatgaagcgtcatagtgttccggcctcaaaaataaaattaggaggaaagcctgtggcacagcaaacgtctccccagcctcccacctgaccctacccttccaggtcactgcctcaggagataaaatcacccaggaggccctgtttaaactcaattctaagttaaggcctgaaaggatccatacactgtccaactctttttcatgccaaaattaatatagtaaacatatctttgtttcagcaatcaaaacctggcaatttgccatgtcaacccccattccacagccacgtgtctgaagaacatatgctttcagaatggcgtttatgatctcaatgccatcttgctgcaagccttccagctaggatgttccctgtagttgaaataaacggaaaggaagtttctgagttgaagtaaaccgaaaggaaggagggtcacagccccgcggcacagttcccaggatgactgctgtgccactcacaaaatgagccttttgactgactccagcagcaggacgggactgtcgtttcacgaggtgagctacgggcagacagatgtatccgaatcgcattaattggaacatcttgtcacaggataagagaatttccatttctctgcggatgcctgtatgctacacatggtatctggcaggtgtgagaacctcgtctttgattgcctatattcccaatctcctttctttgcctattttcctgctgcaaagcaattacggctgaaaatcagtctgcaacatgcgctcatccatattcaactctttccacttcaggcaaatcttgcccagaaaaaaaataataaaagagagagacttataaatccagatttgtcttttattttgatcctctgattgtccaggtgtttacttgttgataatccaccattttctccacatcaaaataaatattctaaagatgcagctctaaacaactaaagcatgtacctgtcttaagtgacaaggagggatgacacacctacaaaactttcaataaatcgaaccaacagatgggagcagccagaaccagttgaaagtgcaaatgacggagcatttaaaaaatatacagtgtcattgattttaagtatgttgaagaaaaaaatttaagaaacagtacctgggacttataccaacaggccaaggttaaaattgggttgaagaggagacagggcttcctcctggaagtccttcaagttatcatttcacattggatttgccaatcagcttttcagatcttatctgataattattgaaagccacaggcagggactagaattttgagatgtttctcaaattttcagatgaaagctgtttacctggcccttaaggagattttaaacttattttaatcagtattcaaaagacacaacaggatgaccatccccccatccacccccgcagtctccttctccagaggcatccaatttcatcatttcttgggatgttattttatacatacacaagaacatgctttatatcttccttttcttcattttttacacaaataaccataaactacacatcctattttattttctctgtactcttctttctctcttttttttttttttgttttgttttgtttttttgagacggagtctcgctttgttgcccaggctggagtgcagtggtgcgatctcggctcactgcaagctccacctcccgggtttacgccattctcctgcctcagcctcctgagtagctgggactacaggcgcctgccactaagcccggctaatttttttttttttttttgtacttttagtagagatggggtttcaccatcttagccaggatggtctcaatctcctgacctcgtgatccgcccgcctcggcctcccaaagtgctgggattataggcatgagccaccacgcctcgccttttattttattatcatcatttagttatgaaagccaaagctgagacaaattctctgtactcttaatggcataactgagcgttgatttcatatgaggacacaaagagcttcctcatcgttttttatggcttcagagaattcccttgaatggatgtagcataatttatataaccagttccctacagatagacatttaggttatctccattgtattcctattacaaacaaggttgcaataaataaccttacacataggtcatttcatgtattagctaaagtatcatgtattagctaaattcctataaatgtaattgctgagtcaaaggatatatgaatttataattttgaaagatattaccttcatatatacatatctgtatctatatagtacctgtttccctatacccttgccaatacaaggtgttaacattctgctgtttgccaatctgataggttaaaagtgacatttcagtatcatattcatttgcactgctcttattatgaatgagctgaggagcttttcatctgtgtcataggaagctcacccctgaggacagcatcacctggactccctcctctgataacttctgggaggcactagcaggaggttagcaggtggaaggagagatatctttcccatttccatcctgcttcaaggacatatttctcacagtggctacatcctccatgatcacagccttcttcggatgacccatctttcctgctccggcaatgccgttctctctctttgtccctgccttcaatcccagggatagtaatagcttcccacatttgcaggtctccgagcgtcacaatgtcattccctttttgtccccaaaatcctgccctcacctctgtaagttgccccatttggggagaagaagcatttgtggagaaacctgtttgctattgctttgttttcctgagacactaacaaacatatctcctgcctatttttctactggtttgttggtcttttcatattgatttgtagttgtagcaactccttattcatcagagcaagagttggcaaacttttctgtgaagtgccagataataaatactgttggttttgtggaccataaggtccctgttgcagctattcaattctgccaccatagggtgaaagcagccacaaacaatatgcaaacaaatgagtgtggctgtgttctaataaaacttgattgataaaaacaggcagcaggccagatatgggccttgggctgtagttcccaaccccagcattagggaaattatcttttctctgagatataagctgcaactatttttctcccagtttagttttttacttgtcttatagtggctttgccatgcagagttttaaagatctcttattttacgtagtggaatttatccgtaatttatggcttctagtttttatgtcagagggaaagcaaagagttagtaaaaccacaggaaactcaaagaggaaagactgtaccttaagctagtcagaccatgctaccaccaagagtcttcttaatgagacaactactcatccttctaagacagaattatcaaaaactctttcttaaaaagcaaacgaacaaatgaaaactttcgacggaaggctgagacacaaaatggagcgagcatcctggtgggagccaggacgtacctatccacatgtgcctcgggtaactctcaggccactgtattctagacgttaaaaaacacttctcgacacaaatacgaatcctatcaaaagaaaattagaaaagtgttttctaggtgatcgctgtataaaaatttcacaaatcacccattctatcaggctttgcctagctccaacatctttccgacatcagtgacatgggggcatctgttagagttcttacaactaggggatctctcgggatttccacttcatactcattcttctgttcctgcatgactgtgctccagggtctaaaggctcctagccttagtttgtaatgaatttagtttttgcattctataaatttaaaacaaatatctttgtggaaattttgtaagtagaaacagggaaagtaaaatgttgccaattaaaatacatgttatttgcataaaataggcaagactttcaggaaaaaaacactggggaaaggatgggaaaaagaacaaacaaataaacaaaaattggccgttcaagtctctaccagagtttaatattttaaagtcacaatttcctttccttgttttctcctaccatggagaagcagacacagttataagtgaaggaacaaaacatagaccgtggaaatttggaggtttcagcatggatttgcatcctaaaaaatacaaatagcaatgtgtaataacaatttaaaatctctcttgttgaattacaaaaattatcctggcaattgtagtcggttgctctgtcctgaccaaaacaaagttattcatatttatatgccctcatccccatatacatgcatattgagatgtatattttatttatatgttcatctagatgtaaacataggtatatgcagatatgcacccaccacacttcactatactgtctacaacatgcatattagaaaatgtgtatttaccgaaaccaacatataaaaccaaagtggcaaaggctttggggaataagaaagacacagctctgtaataagtctaacacctgtgaatgatctgtagcagccttcgaaatgtgggattgctgtatccctcaaactgatactacaaactgagatttcatgtctccatttacacaaattgattccataaattctactaagcgccaatgggtaagactcacagcatgtgagatcaaaagagtaggagtaactggcgacagtttagttgagccacaagatgacaaacatcagtcacagggtagtaaggaggggagaatcatccagagaaaagccgtggagaggcgttttctcaattgattaggtcatgctgtaatggagccaagggcgcaggttcagtactctctgccaatgacctatattgtatttcaaagacacagaccaggcccaatagttctcaacatcttgccactagatcaaaagggatatgagaagaagagtggctaagcccaagcttatttcaagtactagaaaagtaacaacattaacgcagcattgattagtaccattgtcttagcgtaagttacagttaacgtccgacatgatctgtgatgtaatagaattaagtaagacatttctcccggctagtattaaactgtatttattcagtcaaccttacaagatcctatcatgaaacagaaatagcattcacttttcaaatagctgtattctaacacgtggtttgcaattaatattgggctgttttggatatttcctgtattacatatacaaccgggatattaataacaacaaagatgaaaacagaagaggatttatgtagctccggaggggttcaataagtaggaacatgacccggattcaagcttcctggcacagacaccccaccatcacagcttattcagaaattaaatacttgtgcttcgccaccacaaacgcaagtgctgccgcttatcttttttctcacgaaaatgtgaccttgggctcagaatggtgctgacccaacgtctcacttctcttagaagaagtatctcaatgaagctgatgctgccgtctgagcactgctttctcgtaggaatttgccaaattaacccaaaatgcagccagccaccaaacagagaaacaatttaagtttagccacgtggggataaatccttctggatgtcaaggtcctcagctggggcttatattaaaccagtagttaccgactccattccccagaacaaaatgactcatggggctcccgtatctcctttcatttgaaaaggtgctgaggtggtaaaatattctgaaaactcctgtagtcattgattcctcagttcttatagagcgctagaattttgtggtctacatgtcactgattgtaacacatcttaatatttgctgcttagaaatatgtttgaaaatcatgtaaaatatcgcacaaatagcaaataactagaagatagatggttgtgtctttttccctctctgatatatataaattctccaagaaccacatggtagaaaaaagacagatatatagtcacgcactgcataatgacatttcagtcaaggacagaacacacatacaatggtggtcccataagattataatactgtatttttactattccttttctatgtttagatacacaaatacttaaccttgtgttaaaattgcctcagcattcagtacagtaacatgctgttcgggtttatagcccaggagcaagagacgatacttcacagcccaggtgtatagtgggctataccatccaggtctgtgtaggtacctctatgatgtttgctcagctatgaagttgcctgaagatgcacttcccagaaaatattcccacccttaagcaacacacgctggacccaccatcctgagggtggaaagaagctctttagagtccccacagagtgaaatgacttcatgtttctcactctctctcctcagtgcggacttcaaaataaaaatactaatcatcaaaagacaaaattctgcatatgctgaaacctacataacagcattctgaagtttctaatagtaagtttcttattagcttgtcccaagttaaacttcttttgtgaaaggaaagtctctgtgtgtgtgtgcctgggcatgtatcccagtgttgccagggccctacgtcgtatgcacacgataagtccaagacctgtagtgggtaaactcagcaatgttcatactctctaagtaggtaacgctaaaggaagagagagaaaaacattcatagcctgagtgatcacataaactgggtatatcagaaaaatcatgacttctggttctggaagagaattggagggggtataacctctcttccaatggacggactcagagttatacctagctcaatctagatggtatgtaatctttattgggaaaaaaaaaaagggtgactaaatacatacgctttaatcataatttgtattcctagatgaaactaccaataaaaattgctacctgcgtatttcctgggcccttatgaggtacactctgaaacactttttctaacactctccaccacaaaattggttttattgctttcatttcatagttgagaaaatgatggattcaaaaagattaagcaatttgttcaaggtcttatgactgataagtcacattttgaggatgggaccccaagtccatttgatttgaatgcccataatcctctaactgcagaaagcttcaagttttctgtgtgttctggaaggcacagctacaaagaaaagctaatatttccctctaaattctacctttatatagctcatcatttgaatttataacactctccagcagtaacaaatacttacgtttctctggattcacagatatatactaaatattttaagaatggagagaaactaagattggaaacaaattaatatgacaggaaaaaaactgtggaggaaaatccatgggaacgtataagaatataactgtaattcaagagccacatactcagggtttgtaaaaattcctaactgcagattaagcagtgaggagctcagcaccttccacaggttcacactccaagccacggagcactcagtggcaccggtctgctctttgggaacaccgttcaattacctctctccatgtaaggacttcgcattattagtgaaccgattctaacacaggaacctcctatgatgtcttaagttcagaatatttctccctgatcaccccagaagaaatcagagctgcgttaatcaatcattctcttacacggtttcctttgtatagaaccactttgcaccctttttggtaagttacctccttcttaatcttcaggactaagctcaacacacacttcaaagcctttctgaacccattctagtatggctgccctgttttgtcttcccccaaccccagaaaccctgtatttaccttcaacaaagctttgaccacacattctctgctatgttttttactggagattaattttttactcattttgttgaggctatttccaggggctctgaatagtggctactcttaataaatacgtaaatatactcttagggataaatgaaaaatcaaatggtccgagtggcctaacacaatttccagaacacactgggaaatgtttgtctcttttttcagccattgtcactacttctttatccccacctctatctacacataaataaacacatgccaacacctgcacttaagtatgcacatgtacacatatacacagcatcgattactccatggattaactctgcttcatctactacctttcatgtaaaaacaagacaaaggaagaaatttaagaatttatgatattcacacaaaatcacataatctaccaaagtctcctcatgcattgcctttattcagactaatatttactgagcacacagtactatgtaaagcagtagaagccaatcaattaaaatgctcatatgttctgaacataaaatgcttcaacacccactacagacattcagaaagatccaaaaaagcaaaattaagtcctgcccatattgaaactatatcttgagatagaaccaacacaaccaaaacaaggtgactattttaagatgaggaatggctgggaacacaggaaataacccaatgggacatgagtgtggctctcagcctttggacagatcatgtgacaacaaataaacacacacgttctcctgcagggcataggtttctggtgaagaatcagtggtgacttggagcaagacaccagatgataatttgataaatgctgtttacctttaaaatgtgattaaacagcatttatgatgaacatgctcagccaatgatgaataatatgtgcagtcaagcacaacagaaagtaattgtctgaggaggtagttcttccctggcagcttcccaaagctctcacagcgtgccttccccttcctcccaaacactggagttggagttagagccctgccagaggagaaaacctggctacagagagtggactggataatgactcgcaccaacagtttcggggatctccaggtacagggaagcctgttcgcacattcacctttaggaatattcaggactcgctctacctgctgcagtgtccgcacgtggttcctggtgtggtttatttttctctcacacctcagtgaggttctttcacagcctctttagtctaagatttcaatttttaaaacggagagagatcattccacaaaatattatatattccagttttcttctaattcaacagttctacgaataaagaccaacttgaactgattcacagtgcatttttataaattaagaggagtttctgtgcaaaaaaaaattcattacctcaatttagttctcagtgcaaattataatgattcctggttcaatttatagaaaatagtttaaacaactccatgtccatacacaccaaaataacatgttctgggtaagatacacaggtgttcatacagtaaacatgagaactccatgtcaaatggagatatcgcatgatgtctattttaccttcagagaaatgtgcacaaactgggtaatgatgatgccagtacaagaacttgcaaataaatgggttgtttgggcaagaaattttgtaggtacgtaaaaccagaactaatttatagatcagtcaggctccgtctcatgcttggcagagaggctagaggtcactggtcactgaggaaaaaaatgcttacaaactgatttccagcccagttagcaattttaccagaactctttattctatcaaggctgcagaagagaggtaatgaggtcccatatgtacaggtgtgcaacaaattaggtcaataaatatgtctgttaaaaatacttaaataggaaaggtaaaaattacttaaacatgataagaaccattcagcaaaattcaatagcagacttaatgctcagtggtgaagtgttaaagccatttttattaaaatgacaaactggactaggataaccattattgactctttataaaatattgctttgagagtataaaatacctaggaatccaacttacaagggatgtgaaggacctcttcaaggagaactacaaaccactgctcaacgaaataaaagaggacacaaacaaatggaagagcattccatgctcatggataggaagactcaatattgtgaaaacggacatactgcccaaggtaatttatacattcaatgccatccccatcaagctaccaatgactttcttcacagaattggaaaaaactactttgaagttcatatggaaccaaaaaagagcccgcatcaccaagtcaatcctaagccaaaagaacaaagctggaggcatcatgctacctgacttcaaactatattataaggctatagtaaacaaaacagcatggtactggtaccaaaacagagagatagaccaatggaacagaacagagccctcagaaataatgctgcatatctacaactatctcatctttgacaaacctcacaaaaagaagaaatggggaaaggattccctatttaataaatggtgctgggaaaactggctagccatatgtagaaagctgaaactggatcccttccttacactttatacaaaaattaattcaagatggattaaagacttacatgtcagacctaaaaccataaaaaccctagaagaaaacccaggcaataccattcaggacataggcatgggcaagacttcatgtctaaaacaccaaaagcaatggcaacaaaagccaaaattgacaaatgggatctaattaaactaaagagcttctgcacagcaaaagaaaccaccatcagaatgaacaggcaacctacagaatgggagaaaatttttataatctacccatttgacaaagggctaatatccagaaactatgaagaacttaaatttacaagaaaaaaatcaaccccatcaaaaagtgggcaaaggatatgaacagacacttctcaaaagaagacatttatgcagccaacagacacatgaaaaaatgctcatcaccactggccatcagagaactgcaaatcaaaaccacaatgagataccatctcacaccagttagaatggcgatcattaaaaagtcaggaaacaacaggtgctggagaggatgtggagaaataggaacacttttacattgttggtgggactgtaaactagttcaaccattgcggaagacagtgtggcaattcctcagggatctagaactagaaataccatatgacccagcaatcccattactgggtatatacccaaaggattataaatcatgctgctataaagacacatgcatacgtatgtttattgcggcactattcacaatagcaaagacttggaaccaacccaaatgtccatcaatgatagactagattaagaaaatgtggcacatatacaccatggaatactatgcagccataaaaaaggatgagttcatgtcctttgtagggacatggatgaagctggaaaccatcattctcagcaaactatcgcaaggacagaaaatcaaacacagcatgttctcactcataggtgggaattgaacaatgagaacacttggacacaggaaggggaacatcacacaccggggcctgtcatggggcggtgggagtggggagggatagcattaggagatatatctaatgtgaatgatgagttaatgggtgcagcacaccaacatggcacatgtatacatatgtaacaaacctgcacgttgtgtgcaggtaccttagaacttaaaatgcaataaaatatatatatataaaatatatatattttatatatttttttaatatatatattttgctgatgtaagaagaaattttatatacatatatgtagcaggtgatctttatttacagataagattacataatttgaaaatccaactttaataaaaaatccaactctaataagagaatgtacttagatacaaagatgtaagacaaatatacaaagaaatcattagttttctctgtaccagagataaacagctagaaaatcaaatgaaaaatattttataaaaagtagcaacttatatcaaatgccacacagtataaatttaacaacaaaatatatataaactctatataacaaacagaaaatattattgaaagatataaaataccatatgaacaaaaagataaacatatgttcctgaagaggaggttactttcttaaaatgtcatgctttctaaacttaatacatacatttaattccatatattccaattagaatccagtggtattttttcttctccaacttggtaaagtaagtttaaagctcatttgcaataatgtccatacagaacagtaaagaaaagtgtgcaaaagaatagtgggagtggaattgtcttgccagataccaaacttactacaaaccatggggaaaaagaaaagaaaagagaatgattctagaacagggacagaaaagttgaacaattaaccagatagcacagaaaaaagccaagtgttatgataactttaagccaagtgttaaatcactcaattgtgacttttcaattgagtggggaaaagaaccatttgtataataaaaaggcattagcatatgtgcatctccacctgtggaaaaaagaaagctggattgtattacctcaaagcatacacaaaagaatttctagatagactaaatatctcaatcttaaaaattattcaccagcctgggcacagtggctcatgcctgtaatcccagcattttgggaggctgagggagtagatcatttgagcctatgagttcaagaccatcctgggcaacatgatgaaactacatctctacaaaaaacacaaaaaaatcagccaggcatggtggtgtgtgcctataatcctaactactcagaaggctgagacaggaggatcgcctgagtcaagggaggtcaaggctacagtgagccatgatcctaccactgtactccagcctggcaacagagtgagaccctgtagcagaaggaaaaaaaaaaaaatgtgaaaataattatatagctttgatataagcaaagatacccacgacaggaaacccacagggcattttttaaaaaaacctacatagtcatattccagtgtaaaaaatgtaaaatttgttagtaactgaagtcaagagacaagtgacatcctagcgaaaatatccgtaaaatgttgaacaaagtgttgatgtcacaaagaacacctataaatcgataaggaaaagaccaaaaattcaccatgaaaatgaaaaaatgaatagtacacgtgaatcacaaaaaaggaattgcaaataaccagtatataaaatggtcttcaacctcaagaacatgcaaactcacgttagttaacactatttacccagtagattggaaaaatatttcatttcaagcatttcactggtaaaatacattgtgggtgaaattataatccattacaaacaatatttcttggggaaatttggcaacaccttctagaatataaaattcacgtggccttgaagaaaagaaaattctactttgaagagccttttcagtcaaaataaaagggccagtgtgcaaagctgtatgcactagaatgtctatcgcatattttagtgacaaaaaagtaaaaatactgggtccattaatggggcatgactgaatatatcacattacagccatttctacggaacataatgcacacattatgcaaaaaaactgtattttgctgcagtgagatgtaatatagtatacagtagtaagggctctagaggatggaagcccgacagcccattccaagtctgggcttcaccacttcctaaccttgtgaacttcagcagcctccttaagttctctggacccgtttcctcatcagcaaacagggagaatgatagcaacttcacaaggttattgtaaggctcaaatgagataaagtatttaaagcaaaaaaaaaaaagtgttcttaaaatcaatttcaagaaaattaagtcacaaagtaatgtctgttgtgggattccttttttgtcaagataacagatcttatctcacttaccattgcctgaacaaaccaggacattgtccatctgggatggtttttgtccaaacaggaggcgatagttattaattaaggaagcgagactgggtttggactgtggcatacgacgagaggatttggctagttcttagtaaaaggagaccatagcaggcatgcagcattatgtacagatgccctaagagactgagaaacaaggaaaatggggttggaggcattttgaggggaggagcaagtgtgagcatgagcccaaccctgagatccttcaagagcccagttctagttgcaggccacaagtatcctgacaataaacgactctgtgcttcttagactctgcaaggggaagacttatcaaagccacctcacaaaaaacagagtcgttaaatatatactatgtgttttttttgtttgtttgtttgtttgttttgagatggagtctcgctctgtcgcccaggctggagtgcaggggtgcaacctcagctcactgcaagctctgcctcccgggttcacgccattctcctgcctcagcctccccagtagctaggactacaggcgcccgccaccacgcctggctaatttttttttttttttgtatttttagtagagacggggtttcaccgtgttagccaggatgatctcgatctcctgacctcgtgatccgcccatctcggcctcccaaagtgctgggattacaggcgtgagccaccgcgtccggcccatactatgtgttttaaacacaaaaaacacagtatgtatttaacagacgtcaactgcgctgtgccagttcagctaggctaggcttctgcctgtaactgaaaaacaaactagcatttcaagtaaaatgagtaaaaaatataaaaacacattgtaaattatcattttctaatacttaagtcagcttatgagattcctcccacacctactcagtggctcacaaaccctcggaaggaagaagcactgcataacccatctcaatgtttcagtcattacttaccacttcaatagcccactaataaacagtggtttccaccaagataaaatatacaaatttttcaatagacgtagtaaatactgaacaaaagtaaacagaagttgactataatatcaaaaagcagtaccatttagtattagtctgaaagcaactagtgaacgcattaatataaccaacaaacaacctttcacgaaatacttagagattagggccataaactacaagctagtgttcttttcactttgaaatgaaagatcagaggttccatataggccttaattagactcatagtctagaatttttctttctttctctaattaagaggatcacgcaaaaacactgaagtagtagtgccaagatgattccagccaggtagcccagtgcaacacacacaaaaatagttcacagagataatgttacccaattatgaattcagagagactcaatgtacaacatatttcttaagacacagctacaagacagagagtagggcatcatccataaaaggttgggcaaaagatgagggcctcaaagccaggccaaactgggtggtttttcacctagaataatataaggtagtctgcctagaggaacaatctctatcactgttgaggaagaaagccaaggtatataaatgaagaagaggttctaagtgtcaggtccaacgtaaatggtgaggtcataaaaagcaaaaggaatttctaggccagacatgatgaagatgagaaattaaggggtatgaagataacaaattgggtctttgtaagcaggttagaactaaaatggtgaacgctgagactgccggaagatttttgttgtgttgtaccagttggatagtgtgtttgtttgattatgcaggtgcacacatgtatataaacaagctgggaggtagcgagctcctcccaagaggaggtgtaagtttcatggcttaaaggagtcaggcaaaaccaatgttccacctaatattaactatcaaattatattttaatattgtcccttactgaataacaattcaggattgcttgggaccaatagtaaactgattgaaaaaattatccaaatggggataagctatgaatgttactaggatcatatgatgagaggtaaaaggatgggcaaattcaaggctacagacacaacttgattcagaaaatatgaaattacgaagaggaagacataccaagtactattctttggaaagatgagatgtttgttaagcagagcttaatattaacttctttttttttcttactcctttttttttttttttgagacaaggtcccactctgccacccaggctggagtataatggcgcagtcacagttcactgcagcctccacctcccaggctcatcacctcaacctcctgagtagctgggaccacaggtgtctcccactatacccagctaatttttatatgttttgcagagacagggtttcaccacattgcacaggatggtctcgaactcctgagctcaagcaatccacaagcctctgcttctgaaagtgctgggattatagacatgagccacctcacccagccaatattaacttattttttaatataacagactagggagtaacacagaagttggtcctcatatctaaaacagagtaaaaatactcttgactatttacattcaaataatgtaactaagactaacatgagtcactttccgttttccaatcaatttatagattaaatgcttatacctgacaccagaaaaaaatagcaattaaactgtaggccataaaattaatttcttctgcagtacaaaaaaaaaaaagaaaaatgtaatttcatttctttttgacctagattatgccaattgcattagatgttttatttcccatatgtatcagaatgttcaaatagtatataggctactaaaaagaatcattcccaaatggtactctccccaaacaacaaacttctcttattaatcatgctgaaactgtatgcttacaaaaaaagtgagcaaaattggaagcaagagccttccaaaattaaatgaccaactaaatcagataggcagatttgaatgttttttaatcaggcactgctggcatgatcacaacatttaaaatacccaaatgattctacataaatctaactcatcatctttcttacaaaaagtccagagctctaatgaagtccataatgatctggataaaatacacttaattagattataaactgcaacataaaacggctgcatcatgccttttaacatttttctctctgaagatcagaggattgaaagggggttataaaacagcccattcatttttcttgtcttttaaaggaaggaaaaaaccattaggcagaactaaagttccagacaacttttaacaagtgacatccaagtaggtcacattcttagacctcctcagagatgcagggaacgatgatggggtcaggtgaccaacacatcaatgggacggcatgtgatcagacaactctggggaatgctaatgatttcctatgtgatgctgatagtacaagatgtactttatgcttgatgatatctagatgagatagataacaggaaaaaaaaaccaaggctaattaaaatgcatttcaaagataatcctaacatgattttctaatagtacgcaagtccactgtgagtttgagatggtgaattaaagacgaatctattcatccacagatacatctatccactcatacaatttatgtgtttatttttggttgagggagacaggaggtgagaaacaagcatgcaacaattgctaaaaatgtctttaaatatttatctacagaattctcaaatgtgttatcttgactactagagactaagagcatggcctttggagtgaccagatctcctttgaatcccagttccaacatttgttggctctgtaacgctcaggtgcagttatgacatctgaacacagtgagaacaatccatgttcaggaagtaattatgggagattaagtgtaaggcactttgtactttgcctgtcctagaataggtgttgcatacattaaatcacaatcaaaacagacaagcacatttgggataaactaaataagatctctaaataaatgaaagggccagcctcagtggctcacgcctataatcccagtactttgtgaggctgaggcaggaagatcgcttgataccaggagttgaagaccagtctgggcaacatggcaagactccatctctaaaaaataaaaataataataataattagccaggcacggtggtatgcacctatagtcccagctactggggaggctgagatgggaggatcgcttgagccctggaggtcaaagtgagaccctgtcttaaaaaaaatttttttaaaaaaagggacataccatgttcacgattcaatattaagatgtcaaatctcccctaagtgatctacatttcacaccatttcaatcaaaatagcaggctttttaaaaagctaacaagctgattaaaaaatgtttatgaaaaggcaagtgaaaatagccaaatcaattttaaagagagaaaaaaaaaagttagagggcatacactacctgatttcaagatttactaaaaagctatactaatcagaatggtgtggtactgaagaaaggatagaatagtgagtccagaaacaggcctacacaaacatgggcaattgatctccaacaaagatgaaaaggcaatttaatggagaaaggaaagtctcttcaaaaaaatgatgcaggaacaactgtatatttgtgtggagaatcaagaaaacccttatgccataacatattcaaaagttaattaaaaatggattatagttgggcatggtggcaaatgcctgtattcctgctactcgagaggctgagacaagaggatcgctttagcctgggagttggaatccagcctgcataatgtagtgagacccgatctctatggaaaaaaaaaaaagattataaattgaaatgtaaatgctaaaacagaaaactcctagaaaatatttgtgactttccctaagaaaatatttcttaaataaaagaagaaaacacaaactataaaagtaaaaattgatcaaatgaactttattaaaattaaaaacttcggctcttcaaaagatgccattaagaaaacaaaaagacaagtcacaagtaaggagataatatttgcaatgcatatctgacccaggacttgtatccatgtcatataaagaactcttacaactcaacaacatgaaaacaacccaaaataatataggcaaaagattgaacaaatacttctcaaaagaaaagatacaaatggcaaaaaagcacttaaaaagataagcagtagcattaactaattagaaatgggaattaaaaccacactggactgccaccgagcacgtattagaatggctgaaattaaaaagactgacactaccaggtcttggtgatgatgcagagcaactggaactctcatatactactggggggaacacgaaaagtcacgactacttcagaaagcagtcttgtagttttttataaagttagatataatactaaccatataacgtagccactgtgaccacagatattttcctaagagaaaacgtatgtcatacaaagatttgtacatgaatgttcacagtgaatgtccatcaggaggttaatggataaataaaatgtggtatgtctacacaacacaacactattcataaacagaaaggaatgaattactgataggtccaataatatgaatacatctcaacaccattatgctaagcgaaaacagttggatgtaagggtacatactgatttcactttatgtaaaatgcaagttgatgtacagtgacaaaaaggagatcactaatcagctggggctgggggtgggtgagggatagactgaaaaagggtacaggtacaaagaagatatatagatggccatttttatgcacataaaaagatacttaacattagtaatcattaggaaaatgcaaattcaaaaccatgataaaataccaccttaacactcattaggatgactataaaaaaaaaaaaaaaaaaaaggccaggtgcggcggctcacgcctgtaatcccagcactttgggaggccgaggcgggcggatcacgaggtcaggagatcgtgaccatcctggctaacatggtgaaatcccgtctctactaaaaatacaaaaaaattagccgggcgtggtggtgggcacctgtagtcccagctactcagtaggctgaggcaggagaatggagtgaacccgggtggcagagcttgcagtgagccgagatggtgccactgcactccagcctgggtgacagagcaagactctgtctcagaaaaaaacaaaaaaaaaaacaaatgttggcaaggatgtagagaaactggaagccttgtgcgttactggtaggaatgcaaaacggtgcagctattgtggaaaacagtctggcagttccttaaaagactaaacacgagctgggtgcagtgatacatctgcagccccaggtactcctactctgcaggctgaggcaggagactcatttgagaccaggagttcaaagccagcctaggcaacatagcaagacctagtctttaaaaataaaagaagacaagaaaaaattttaaaaaataattactatatgatccagcaattccacttctgggtatataacctgaagagctgaaagcacagattcaaataggtattggcacacctttgctcgctgcagtactattcacaatagccagaaggtggacataacccaaatatgcatcaacagatgaatggagaaatcaaatgtggtatatacatacaatgcaatattattcagccttaaaaaggaagggaattctgatcaatactatcatattggtgaactttgaagacattatgctaaattaaagaagttagacacagaaggacaaatattgtacgattcaacctatagaagtacctagaattgtcaaaatcagagagacaggaagtagaatggtggttgccagaggctggggcaaaaggggaatggggagttatcatttaatgggttcaaagtttcagttctggatgatgaaaaagagttctggagctggacagtggtaacgggtgcagaacaacatgaatgcacttaatgctactggattgtatacctaaaagtggtcataatggaaaatttcattatatatacattttactacaataaggaaatagtaaagaaaaaagtggcacagaaatattttggaagtaatggaaatgttctctatcttgattgtgactgtggcttcatgggtatataaaactgtcaaaattcatccaattaaatagattcatttaactgcataaaattattgctcaataaagttgatgaggggaaaaaaagacactagcaaattagcaagaatatattttatgcctctcctccctgcctttcctcatttcatcctgcaatgcctaccagttttctatttcataggaagcaggagaaaaagaaaaaaacggagggagtgcgggcagggggacattcattcaacaaatacttagataacctccatttcatatgttactccaataagcctgagtgttacaggtttatggatgaggaaactatatgaagtttggtatgaagtcgtttatccaggtcacacgagattaagtggcaaagctcagtttgtaaccaccgtgtttctaagccttcacaaatgtgcattgtaaaaatgttctccctacgtgtgatttcaccagacctacatacatgaggggaaataacaagaggcaaagccatgaaaattgtgcactatcaacaagataaaaagtgtggcaaaaatgataaatgttcaagctgatggatatgctaattaccctgatttgatcattatgcattatatacatgtatcgaaatatcactctgtagcccataaatacatgtaaactaaaaagaaaaaaaaaggacataaaatgtgtggaaaataggtacttctgttcacatttaaggacttcttgcaaagagttattgaaacctttgtcttttgtaatttctccttacttaacaattgggcacacagattaagaacacacactccacagtcacacttcccaggtcccgtcctactgctgtgacctgacgtgatctccctttgcctcagttttctcaactgcaaaatgcggattataattgtaactatctgggcacagtagcacctgcctgtggtcccagctactccggaagctgtggtagaaagatctgactccaagttcaagtccatcctcggcaacacagtaagacattgtctataaaaataacaataataataattgcatctacctcaaagggcttttgtgatgattaaataatggatgtgaagtgcttaacatagcgttagaggcatacgaaattctcaataaatattagccttcctcttccatatagtctacctataacagctatggtctatctgtaatagctaggtacaggtagagttacatgcagaactgaaaaagaaaaagctacttttacaggtagtggtttgaattcactaatgttgtccttccttccttctttcctccctcccactctctctcccttaaaatgcattgctgttcctcaaatatagtttttgcattaaaaatgtatgatggatacagatggcaaatacgcatatgaaaagatgctccacatcacatgtcatcagggaaatgcaaattaaaataacaagaagataccactacgcacatattagaatggccaaatccggaacactgataacaccaaatgctggcaaggatgtggaataacaggaactctcgttcactgctgatgggaacgcaaaatggtacagccacttgggaagacagtttggcaatttcttacagaactaaacatactcatcacacaatccagaaatcttactccttgttatttacccaaaggagttaaaaacttatgtccacacaaaaatctgcatgtggatactgacagcagctttattcataactccccaaacttggaagtaacccagatggccttcagaaggtgaatggataatcaaattgttgcacatccagacaatggacaattatttagcactaaaagtaagtgatgttatcaagccatgaaaaggcacggagcaatcttaaatgcatactactaagcgaaagaaggcagtgtgaaaaggctgtatgatcccgattatatagcattctggaaaagataaagctatggaaacggtaaaaagatcagcggttgccagggatgagagttgagagagagatgaacaggtgaggcacagagcacctctgtataatgccataaaggtaaatacatatcagtattcatctgtccaaacacggaatgtacaacaccaagagtgaacgctaacagaagctgaactttggtgataatgaagagtccatggaggttcatcagctgtcacaaatgtcccactctggtagaggatgctgagaatgagggaggctgtgtgttttgtgttggaggtgggggaggagggcaggagggatatgagaaaactctgtaccttcctctcaattatgctgtgaacctaaatttgctcttcaaaaatcatctttttaaaaaacatgtatggtggaaactatgaatgatgaaagaaaaccccattcagtaacctgaagcagcacgttatcttacgaaataataaatgattcatttatctttggcagaatcgggtcattttcctgcctttctctttctagggaaataaaaattttacactttctcaaacatttggaagattgtctttcaaaagccagtacaaggaagcttgaggaaagctttttatagccaagtataacagctggcagtctagaagccatatacaacattttgctgttctacagaacttatagcagctcacaaaagcaaaaccatttttattgaggaaacaataaaaattgttggaaattttcaaaattaaatagtatagaaggacttttattgtaataaaagtaatctatagataatgtttctcatagttaacaaaggtgcccatttacctactcaaatccacatttcttttttttttttttgagacggagtctctgtcgcccaggctggagtgcagtggcatgatctccgctcactgccagctccgcctcccgggttcacaccattctcctgcctcagcctcccgagtagctggaactgcaggcgtccgccaccatgcccggctaaatttttttgtatttttagtagagacagggtttcaccgtgttagccaggatggtctcaatctcctgaccttgtgatccgcctgcctcggcctcccaaagtgctgggattaaaggcgtgagccaccgcacccggcccacaactccacatttctaatggactgcaaattcaccagcggtaaaagtaaacgagggaggcaatagatcctttgggtctgatgttacagccaactcaagtggcaggcttttgctagattttctaagccagcagaggcagggataataaaacacatttacctagagaaaaaaaaaaatcaaattaagatgactttaagtattctatactaacagaagaactattaaaagtagttaaatccattgttctgaaaaactgaacagagatatgaccaactggaggtgttttgtctctctcgactccactggcactaggacctttttctcctattttattatcaagcatggtgagccagccattgccatgcccaagtgctgcatatcttgtgagtctaaactgaaaacaacatatctcagacgttatcttagacttgaggctgaggaacagatggatttaagaaaaaaaaccattcctttccttttaaaaggtcttaaaaacttttgagaagcttcaggaaaaaggcaagtaagatacgattattttgtggcataataagatttcattttctgaaactcaatcaggagaactaatgaagaagaaatgtgccccttgcttgtggaagccagcttaaactggtaagagcccaatcactcacagtatttgttaagcaaaatccatttatgttggaacagtaggcatttaagcattaatatgaaagttaaaatagagaagacagtacagaatacttaagttacaatttcaaattcgacagtgttgacagagctactccagagaccactaaatatattgctttaaaaaaaaaagttggcggggcataatggctcacacctgtaataatcccagcatattaggaggccgaagtggaaggatcacttgagctcagactcaggatagaccagcctgggcaacattacaagaccttgtctctactaaaagaaaaaaacttagccaggcatggtggcacacatctgtagtcccagctacttaggaggctgagatgggaggatggcttgagctcaagaagttgaggctacagtgagccacgattatgccactgcactccagcctgggcaacagagcgagactgtctcaaaaaataaaaataaaggttgcgtttttttttttaaacattatatatctgagaagatctccatatataaatatttcattttaaacagctaattgaaaagttccatacatttatatgtgagaacatttcataaggttttaccttatcctaatcatatcttaactctaaatattccgtttaacgacaaaaatggcataacattcccaaagcagcaaaatgtctttcttgatttctgaagataaaaaaggaaaaaaatagaaaaagcagaaaagcaataaactgttattcattttaataaatttttatgatccctcagtcattactaaattggatcatatgataatttctcctttggttatcatttttattgacaagttttcagctgttttttcttcatttgcaaaatgagtcctagatctcatgtctggcataatcactcagctcccataaagaaagacatccaggacccactttatcttcatgttacttttctaagccagcccatcaaaagtctgaggagacagtcactcttactgctactgacaataccaactggtttagtgtacactaactggctgactacacacatctattccttttcattcctaacagaatgctgattttattcacatattcattctcattagaaataaatgttttaggccaggcatggtggctcacgcctctaatctcagcactttgggaggccgaggcgggcggatcatgaggtcaggggtttgagaccagcctggccaacctggtgaaaccccagctctacaagtacaaaaattagccaggcgtgctggcaggcacccataatcccagctactcgggaggctgaggcaggagaacggcatgaacccaggaggcggagcttgcagtgagtcgagatggcaccactgcactccagcctgggtgacagagcaagactccgtcacacgcacacacacaaaaaagaaatgtctcaagtgcttaaattcttgtaaaaataactgcaaaaagatatatgagtaaggactggtaggtaccatatgactatttcagcaaacacatatcacctggaaaaaatgtgctgatagagtttctttaggatcaaatgcgtggtagggaaatccacatcaagtccaataaaatggtaaaagaaaaaaagaaaaagccaggcacagagactcgtgcctataatctcagcactttgggaggctgaggtgggaggatcacttgaacacaattcaagaccagcctgggcaacacagcaagacgccatctctacttaaaaaaaaaaaaagaaaagaaaaattagctagtcatggtagtgcatgcctgtagttccagctactcaggaggctgaactgggaggatcgcttgagcgaggctgaggctgctgtgagccacgatcacatgactgcacccagcctgggcgacagagtgagaccctgtctcaaaaataaaataattttaaaagttaaagctaacaaaatatacacaaaaacccagaaacagtgatgtgaaagaagcttttgattcgttagtgatgaaatgagagctgccttgatagaccggcactattacaaagacgtgcattgcctgatcaagaggtggtgcttctcagagtttctaaaccaaagattgaattcttatttttcttcatggagggaaaaaaggccacaacgttacaatataaaaatctgaaaaagggaagtgaattgatttttcatctaacttaataaaatgacttatttggctgatatttccttaggatctcaacaacctcaagccaaaacttcatagtttttcagggcagcacaaacgaatcccacaggttaaatgaagagctgctcattaggactgagaatcaggaaagagccttagttcatccacatgtgattcattcacatcattgacttaaagatcgtcaccattcattgttcctgagtggggagaaaaaaatccacagaatatttccccgagatcataaagaggttagtcactgatttggggatctttatagtctaccatttgacaatgacttggcctttctgcgagaaaaaacatccatcaggagtaccactgaaaatgtgctgaatttagagcacctctccacagtgactgcaattacagaactcctaaatcactgaaaacactctgaatcttggttttaaacatcttgtgacaccagaagaggacaaaaattgtcctagtgatgatgaacctaatatgtggtgtgtctgttttggattacaattttcccaattacaaatgctagtcatttggaccactaacccaagaatgccttggttaatttctcaaggacaaaatgtttacatattgatatattttaacatttcatttttgaaatgaatgctattttatttttcaaaggcagatgatgtcttacctacccagtgtatttataacccctttgaacacttgacccatattcctaagcatccttatggcacttaaaatgcctaaccagttccaaatgttcaataacgtttcagcaaatgcttgctgaatgaattaattaatgagcgaaggtatgttgaaaaaaattagattttcctggtaacttaattttgaaatagaaaacatataataataaatgctagctcaaaataaccctagtaaagcaatataagtgactaccttggaaaacttacagcagaatgcatcactgctcccactcccaaacctgctaccacttttgcgttctttatgctatgagaggtaccactacatccacagctgactgcatcaggaagagcccaagaccaccttcagtttcagttatctactaggcagactctcagggctcggcacacagtcgtactcacagctgcagtttattacagggaaacaacaccaagcgaagtcagcaaggggaaaggcacatggggagaagtctgtggaaacagagtgggagcctccaagggccttcccccagggagtcacaagggaggcacttcactcctcctacaaaaagctgtgataacgtgagaaatgtcccagtcagggaaacccattagagactcagtacccagggtctttattggagttcaatcgcctgtaggcagcctctaattttggactcctggaaggacagcaggggatcagcataaaccataatgttgacacaaacagtttaggcactgtcagccactcttaccagataagggggaaacacttgctgaaatctcagttgctaaatgtcagccaagggccaaacttgtgggcctgcccttccttcctttcctccttccttcccttccttcccttccttccttccctccctcactcccattccctcccctcccctcctctcccctccctctccttcccttcctccctctctccctccctttctctctctctctcttaacagtcttcctctgctgcccagactagagtgcagtggtatggtatcagctcactgcaagttccacctcccaggttcaagcaattctcctgcctcagcctcccgagtagctgggattacaggcgcatgccaccatgcctggctaatttttgcatttttagtagagacagggttttgctatgttccctacgccagtctcgaactcctgacttcaagtgatccacccgcttcaacctcccaaagtgctgggattagaggcgtaagccaccacgcccagcccaggtcttttcaaggataagcagtttaggcctgctaggttaactcttttctgcacagcgactaggccagaaaccaagaaataatcccaattcctacttcttcactgtccctcatctcttctaggccaaatcctgtcaattttgctcctgagtaacttccctgtactcccttcttcctgtcctcactatcgggctttaatggaggcctctgttctctcttgctcgcatcactgccggaactcctaccttgtctcctgcctatccttccatccattctccacaggctctttgccgggaaggctgcccactgccctcaacctcccgagcatagtggaaaacagggcctttttctgatgtgcccaagttttctctctaatttctcaacactttctcccttttgtactctctgttctagtcaaactgaactattaaatgcagttctcagaaagcatggcactttcttacctttgtcactttgttctggctacttgtcctctacctagaatgcatttccacttttgcctgggttaagaagtatgtaggctttagaagtcagctgaggcaccaacacaaatcttccccagatatccccgtctcccagtctaatacctcatgcctactcccctccacggcatttatcccactgcactgcaatttcagtctattttattgatctatcccctatactgtgtgtccttaaaggtgggactgcgtatccccagtgtctagcatggtcactgacaaattgttcatgtccaataaatacttcttgactgaataaatgtcacaacttcagcagggttcccctgaggtcagctccatcccccggccttctagaccggactgaacttagacgattttggcacagacactgggaaccgtgcatcgttcatgttatcctctttgcattggctttgttcaaaagctaacagccaaatatgtggtggtcttcctgtgaccgtgtaggtctgcagagcctataatctgtatactaattacacttttggtttcgacttaccttccccaacctcttactctgattacttcacttacactttatttgtatctttgtgtgtgtgcatggttttttccaaagctgaaattccttctggactaaagcaggatataaatagatatgtatatagtcccaaagagatgagaacactgtcccattgtttagaggaggtgaaacctcagtttttctcagtatcccattcctagctaaatccaaagtctcctaaagcacaacttacaaaaagagctattttcctcctagttcttcagctcaacttcatgcaatgaagttactctaaataaaggaatgcatacgtgcacccatattttcttcacaagacttaggagcaagactcaaaaaagtgaggacagatgcgcgccttactttatccagtcaatgtgctgctgaaaaactgggtaaaatgagttgtttaaatagaatcaaaatgtcagtttactagagatgctcactacttacagaaacaccacggcaaatccatgaagtaattatggggtgaaagaagtaatcaccctaaaacttatctgccttgtaatcccagatttacaggctgaggcaatgttaaagtatgcttattagaaaaccctcaagttctactgtgtataaacatgcaatcctcttcgtttgtttcatcacctataaacgtaactcaagttaataaccagccagaaaattcaaattaatattaaatactgaaacactgttatcaccaaattcacaccagaaattattagcacttcaaatgtgagaatgttctcaaagccctgttaattccttccttctacccctacttgacagacattccttgacaacctcctaagtaaaacattccttctctacatgtcaatagattccacctaagaaaggcaaagtccttgctgtcaaggaacttatagccacgtagagttcactctttttgttatatctgttactaacatgagacttttttcttctttaatccaaattttcatttcatttttttctcctttacatctgtttttgttgtaaactgccactcaggagataactttcattaatttgccttataaaatttctaccaaaaccaactaaaaggacaagagaacatagaagaaggacagtacatgcagagttttaaaaaccttaaggaagattaaaagctcgtcaccacataaatgtctaaagttattactaggccctaccaatttgaactttgggatgaaaactccttatgaattcattacagatttgaatttttaaggcaattcagttcaactcatctcaagtacgaacacagtcattcaaaccgggctaataaaaggcagcttagtggacatcctaaaaggttgaattttcatgaattaacagattggcaacgagcttctcaacaatttggatgtaaacaagacatttagaaagctgctgaaaactgtttcttcatgtaggttaagaattagtcttccaatattttttacattacaattcttatttttcaaatttttttttacaaacagtgaaaaggtagtgtgtctaaaattctctgcactgctaaataagtacagattgaaactatcttataaatgaatttgacaatgacctgtgacctagaggcaaaagcagacagtgctgtttaagctgctcagtaaaatttgagctaaactcgaaatgtagaagcaaatactttctagaacacctgatagatcaatgttttaaaatccttgctaattgcttaagttttcattcttttgtaatctgctccttgtgtgtacttaacctactcacaggtatttatgttaattcattagatccctcagggtgggccgggcagactattatctgaaagcactggtgcatagcttcctgggtcagggacaaataaatcttttcatataattgcatgtcgttttatgtgttgctgtcttcccactgggaaaaatgttaaaatatttaaggcttactatctggtgtgattgtgattttataattaaagtctgggacaggaggagagagtggcagaattcagtactttatctcagtaggaacagtctttctttgaagcggtaaacttttagatagtcaataaaagtaaaaattccggtgaataagagctggtagagtccttttgaagtcacgtaccaccatttgatgacaatctagtttaataaagatagagctaaaagaataagaaggactgtatatgtcacaaagatcgtgattctcttcagtgataaaatcaagtaaatattgtcatcaagctaaaatatacccaattctaatacagcaactgtttacctatttccaaatttgtctacataccagacagccagtgggggagaatggttttattttgttcttaattagaacagtatttggagctggaactatctaatgggcaagtaagccaagcattctctcatccactcactcccttcagcattcttctcttacccctatcttctggaccaaaaaataaaaagtctagtcaggaagtggggagtgggagttgcgggacaaggtatgagttggggagagcatctgggttttatcaccaggtgtgtcaggatttgcagtttcttgaaaatctaaatcttcaggttgctgtgcagacttgtgcctcctggtacaaataatagctgcgcccacacacactaatgcccccccacagcccacagccttggggcgctccaaggagagtgagttcaataccagcagtaagggcgactcgctcctggacgtgaatctagcatgcaagatcattttcattaaacacgtaactgcacagcgacgatttacatctcctcttatttcctttgaatgagaagcagacgcataacagcaatctggaatagaaagtggagcttttacaggctgttgtatgtgcaccaaggccgggagaggctgaggtccgtcagcatcatgtggcaggaaaaccgcaaatagttcgaaaggccacactctccggcaccgactgagtagctgctgcaggaagggggacaaatggtcctcagcaagaccctcttcagaaggaacaagagaccgtgtggagggcccatgagaatgaatttgtggtttgcaactggtttgtcatgtctcaaaataagtaaatccagtatgtgtgactgtttagaaaagcagttaagggcggttgagtctttcttggttaattaagtgattttcatctggaggtatgtttggaggaaggagcctcctggaaagtaggatcagaaagaagtgtttagtgtgaaaaaatcagttccagatgattttgtgtatatgcctcgtgtttaaattcagactgttaagtctagacactggaaatcaaactacaggtcagcaaaaaaaaaaaaaaaagaacacccacgcagcaaaaagctgtcatttcactgccacctctgttaaaagggtacaaatatgctatgcttgcttcaaatctatgttttataattctcttctttataacaaaaagtcttctgacaacacaatcaaaaacgaatagtcagaagtaatgatgatctaaacctaaatggttaaagtctttgctgatggatgcagagctcaggagggaggctatgactgggagggggcagaaaggctgagggaagaacaagaacatagagacggagcgcagggtgcctgcaacctgctaccagtcaaacccctaccacagtttcctcatctcgacaaaaagcataatcaggtacatgagtttactgttcataataatgaactacagaagcatttgttattgttacactaataaaaaccacaataaaaaatactactcttattagtaacaaatcaaagaacctccttaatatgaagtcagtgtgaatggttcttggaggggagccagttccgcaggcataacagccatccttttgcaaagccatcaatccagaattaccagtcatacctccaacttatgccttaccttaccccttatgtcttaccttatgcttctgctgaaaaagcgaatgaaaagctggtctcccttttcaaaaatgaaaccatcaaaaaccaacatgggaaggagaagaatcactgactaggatatgtctgtgcagaaaacaaggtggctctcatctgaaaatataacatgacaaaggcgaccaactacatagaacatcatttagattctctccaattttgagatgctgtagctggagcacagagataaccgcccccagtcacacagcctgtctgcttctggactctgtattcttagtcatgaccttgtagctgccttatcatgttctaccataaaaatgaaaattgtgaaacagaaaatctaaatcaaaatgttttaatttgtaataaaagaaaacaaactgagaatctgcaaaagttgtgaaaattttcttctgtgtgaggaaagcttcgtgccagatatcttaaactcaacataaatatccaacacatttcacataaaacagaacaatactgccatggtaatgacgctcctcagttagacaaaaatctcaagagcaggcctgtctgctgatgttcatcactaacctacagtgtatgtgcatttgtttttgccaataaactatgctgttgccagagattaaacataagttcctaaatgcatgtatgattgtttgtaattacttaatattaataagccgaactgataaacacaatcccaaatcaagaaagaaagccaacataaaacagaaagatggcattgctaaatcccggaagacatcacctcgagcttttcatcatgccactttgaagttcacccccatccaaaccctttgtggcttcctctgaagaatcctgaggcagaggcagcagcaggctcactcctccagctgcctgcgaaggctgaattccatttattccatttggggttggtggtgggcaggacgaatgagactgttgtcattcttcccaggaatgcttagatggacagtgagctattggactgccccagataccatcatctcccccacatccctcctacgtggagccttagtttggggggaagtgaatctcaattgcccccttccctctccccgtcaatgaggcaggcttgtggaggtgctggccacttcttaggcctaaatctgtgttcagagagtggatccatgctttgagagatggttgccctgcccgtcctagactatcttgaagggtgagaggcacaggaacttagagagtcaaagactaccaagagacacaccgaaaactagtgaggtgggaactggcaatttctaaacctacggcaacagcagtctctggtccttcttttcatttcccgggacctccatcctgagggctgaactgataacattcatcttacttttatggatgatgaggaaaatgccacaagtgagtttaattctcaaaggagaaagagaaagtggtatctaatatcgattaggtccaaatatactctcttggtgttttagccagaaatacatctgggcatttctgcagcaatctgtaagagactttatacacgtatccatctcaaaataatgcgcttttagttattagcttttattcatttccattttgtctttttaaagtgacatccaaaatgatgaaaagcttcagggtactacaacaccataagataatcttcctgtattcacttccccaaagtacccagagatgggccccaagaggagtcctcctcacgaagaggtgaagcaccgacctgaggatctgtcagaaccctgatcaaaaagcaacagaacaaagtgaatggcgagataaagtggagagggagccattgtgtttacgttcacctaagcaaagtcctaattagtgcccagtcctactggaggatggttttaatggcatgcaccttttatcgcctgcaaatgcttaagggtcagcagaacaagccactgccttgttagataatgaaacacagataaaaatttatgtgtaattggtatgttttaaactggtatttaaaagctatttatctcttagtggggacaaatattcttttaagtcattaattggcaaccataaattttaattctattctaggcataattattacagatttcaagtaagtaggctccaaaacaatgaggctttactggttcgatcagaaatacttgttgaagggtttcctaagaagattacaataggataaattaattctatcagcagaagcactggagtatagaatgtcaaatacagtaaatccatatgtaataaacatagatatctaagatgtgtaagtaagtaaaaataaggatgttgcagatatatatacaatatggtgctgcttatcaaaacaacacaaaacaattttttgtgtgtgtctgtaaaaaaaaattgtgggagtggggatgtgtaatgctgaaggtgaggtgccaaaatgccagcagtggctacttctaggaaggagggtaggacggtgggagaaaacagggattaaggacaatgatgaaggggaattttgcctttgttataaaatgttttaaattatttaaaataaagttattgcatttatacattatttgtgcaattaaaatatttcaaaatttcagacttatttatccccactataatcacaagtagtgattactgagtatgggaagagcctagtacctaggggtggtgccattataatcccaaaggacacaatcctgaatgccatcatccctgaaaatattggtatacaggcctttaaaaacaaaaaaggcctgagagtaaaaattagcctgaagtcgaaatctctgaaatcgaaaatcctgaaaatcataatccccaaacactgaaaccccaaatgctgcaatcctgaaagccaagttctggggagggattcgagtgctttccgctgtgctcactgtcgctgcatcctgtagttctggggagggattcgtgtgctttccactgtgctcactgtggatgcttcctgttagttctggggagggattcgtgtgctttccgctgtgctcactgtcgctgcatcgtgttagttctggggagggattcgtgtgctttccactgtgctcactgtggatgcttcctgttagttctggggagggattcgtgtgctttccactgtgctcactgtggatgcatcgtgtagttctggggagggattcgtgtgctttccgctgtgctcactgtggatgcatcgtgtagttctggggagggattcgtgtgctttccgctgtgctcactgtggatgcatcgtgttagttctggggagggattcgtgtgctttccactgtgctcactgtctttgcatcctgttagttcgggggagggattcatgtgctttccactgtgctcactgtggatgcttcctgttagttctggggagggattcgtgtgctttccactgtgctcactgtggatgcatcgtgttagttctggggagggattcgtgtgctttccactgtgctcactgtcgctgcatcgtgttagttctggggagggattcgtgtgccttccactgtgctcactgtggctgcatcctgttagttctggggagggattcgtgtgctttccgctgtgctcagtgtggatgaatcgtgttagttctatcatgttagacaggactcttatcttgtggttgtcttcatctggaaattagctatggtttaagatgtgtacaggtgccagattcacaaggggtagacttgtagacttaattttcggtgtcagcttgactggattaaagagttatctagtaacttggtaaagcattatttcagatatgtctgtaagggtgtttccagaggagattagtacatgactctgaatggagtaggtggagatctgcctaaaatgttggcgggcaccatccaatcagccttgggtccagagggaacaaacacagatggtaaactgctttctctctgagagatgagacagacttttcttctgccttggacgtaagaaacattattccaagtacacgcattatcacaatgctgctttgtgtataagcatggtgcatgtacataaaaacactgaaacttcttccataaatgaagaactgccttttttctgtgtctccatttgtgaaagataaaatttcttgagaccttggctctttgagtgactgtatttgtggcagtgaccagaggtttttgatccatctcatcaaaacatgtctgtcagggtatttttgatgactgcagttacaacgatggatgcatacaatttccaaccatagtaataagcgttcacacatttcactttctgacctatttctttataaatacagtttgtctgttcatagctataatagctgagtgactcccattagtatatctgtgtgttgatgcttgcaaagagaacatgtatggtattgttgcctattttactgtgtaaagtggcctataatgtgttcagtcatgtatttatatgtctctaaagtcttcttttaaaattgtaacaaatgtattttaaatatttttaaaactttattccacaattatatttttgaaattttggtctctcagaattgtgatttggggattttagaatttagggattttaggctggagctagtgaatcacacctataatctcagcactttgggaggccaaggcgggcagatcgcttgagcccaggagttcaagaccagcctgggcaacatggcaaaacccgatctctacaaaaaatacaaaaattagccgggcatgatggctcctacctgcagccccagctactcgggaggctgaggtggaaagattgctggagacccggaggcagaggttgcagcaagccaagatcacgccacggtactccagcctaggtgacagggcaagactctgtctcaaaataaataaataaataaaactagactttagggattttaatctttcaaaatttcaacatttggaattatggcattcaagatagtgtctctcaagattatggtccaaacctccatagaggtactggaaagcacaacgccagatactacagaagttccgtatgactccattctggcgcaaccatatgcccatgtgtcaggcacaatttcctaagaagaaatcaagtgtaatagatggcaaattggtctcggcctaggtcaagcttgtccaacctgtggcccagcatggctttgaatgtggccaaacgcaaacttgcaaactttcttaaaacataagtttttttgtgtgatttttgttcttttagctcatcagctatcattcatgttagtgtattttatgtatggctcaagacaatttgtctccttccagtgtggcccagggaagccaaaagattagacacccctggcccaggtcagtagcaccagaaggatatctagataagatcaaactaaattaataagcagtctgcagctccaaagcattgactttgaccagtacttttgagaatccttaggctaattcctagtaaagcatgttttgcaaataaaaaaaaattatcttccttttttattggtttgccaaaaaaaattaaaaaaaaaaaacaaactgtgaacatacactagaagcaacaaccataataaaacttctggtaataataaggcagctcctcccatatataacataccaaatataacaactataagctctggattcgacatttaaaaaaactaactgaaggtactagagagtggccaaaagcagacagaaactggaagggagttaacacttgaaaataaatgaaaaacactagatgagtttcttgtttataaagctttttaaattgaagccagaaattttctggctgtgccagctggggcaactgcaagttggatagaaatctgcagcttcttaaagaaacaaaaggaaagtgacaggaaaaaaatcccagtgagggccagagtctagtgcataaaatgcctgaatctctgggtgacccctactatccacatgcattgaggagaggcccagcagtccggaaaagtctaaaagaactgaaaagtgatttcagttgctgcccttcacaggggtaacaaagttggagcacacatctgccaatataatagcatgctaaagcaatacacacacacacacacacacacacacacacacacacacttcagaggaatataagagaatccagaaacctataacatattaaaaatgttctgaataaaacccaaaattactagacatatgagggaagaggacagggtgacccattctcaagaaaaaaaaattcaatcaatgaaaaccaacccaaaatggcccaactgcctcaaaaactaggtaagaatgtttatagtcagctttcattactatgcccaagaaaagacaggaaaatatgcttgtaatgaacaaataggaaatatcaacaaagaatcttaaaaatgtgatatgaataaaatgtgaaatgaatgaaaaataatccaataaaaatggaagaggaagagaaagacacaaataaaagaaccagagagacggcagtgataagaactcagtcttacatggtaagaactcagcatgatattgttgcctgtgaagacaaaaggaattttccattttcttatgccactaagtttgtggtactttcttacaacagcaataagaaacagaaatgtgctgaaagagaaggagaagagaagctgccaatctagaatcctctatccagcaaaaaattgtctgcaagaataaaggcaaaataaagacattttcatataaaagaaaactaaaataatttattaccagcagacctgtactaccggaggtgctaaaggaagtccttcaggctgcaggacaatgagactagatggaaggctgaaatttcatgaaagaatgaagggtgctggaaatggtaaatacgtagggaagtataaaagactctttctctgaatttcttcaaaatatatatggctacttaaagaagtaaaatgttgtattgagggagctttaaaatatgcaaatataatatatatgacatctgtaagactgaggagttcatattttacatgaaatgggacaatgttaactttagactgtgaaaatttaattatctgttttataatcctagagaaaccattgaaaaagaacacagagacatatagcaagaaaaaaaaaaaaaaaagctcagccaaaagaactttggcaaaagaaccgaaagataatatacaataaaaatttttttcatggaaaatagttttggaaatgctactatgaaatctcagcaaattctatttcttgccaatgtattcatctgcataagaaatggtaagggatacatctgtagatttaaacacgcacataaacacataagtccactaaaatggtcagattttctactcctcattcaattaaaaaagaaactatataaagaaagcaccaaaagacaaaataccaaacccgtctctacttcagttctctgttccattcacaattctcacccaggaaagagaaattcaaagaaaagacagagctggaacttcatttcctatatatagttagccagcattcttcagtgttgtctacacattcacccacatccaaatgtactgccaacagaccaacacagagaagtgctgagttaggtttcagtgtgtttctaatatatcccattttattcaagacagaataaaattttgtttcaatgtgactcctctgggtttaaaaaaaaatccaaaatcttagacttaactatatagtcaatcaactagtacataaacaaatgacttcagtacactaatgctgatagccaaaatagtaaaaaataagtctaaggcatgtcacttacttgctctttctggctcatttattttaactgctcccactagcattctgtctggttttgttttttttttctagattaattcaattctcttccctttggatgagatagaaaacagaacaaaaaaaatgaaaaaaaatgctttgcttcacaatcagtcagtatttattgaatgtctttattgtcacacagtatttattgaaatactatcatttgccaggcatagaagaagacgagataaataagatggccccttatcgtctaagacttaagtaaaatacataggatatatatacataatagatataaaacaaagctgactgtttcatgaaagcagaaaggagagagacaatcttttcagttggagaatcaggaaaagtttgtccttgcaggatgaggttttcagaggtaagctgggggtggggaaccagaagcagaaataggagaccagggaagtgtaggacaattcagggaaaggtgactggctcagtatggctggagcatacaggctacactggtggaagctgtgagagaaaacatggcatgtctaattatggtggctcttgaagccaagctaaaggtcttgagcctcatttgataggcagtgaggttcacagaagatttttttaaattgtggagtgacatttttcatcatttaacaataaacagcctttggaagtattatgtgccaaaaacatgcaaacaagtaatagtacatcaaggaatcccacaaaatccaacctcaggcagactgcagttgagtagggagctaactatgtaaagagaacaacaagttagaaagccttagtgaggattatgctattgttctgtctaagccaagatggcaagcctgggattgccttaccaaattcaagctcccagactacatatgacacatacatgaaagaataatttaaaatttaaaaaaaagagagaagaggaatcttttttttttctgtaatcagaatacctatcatccaggaaaaggtcataaaacagtgcaaaataacaccacaggactaaaaaaagatttttttttaatgtggcaaaaattaatacaggatttcctttgcaaattatccaggctttttcccattctggcgtagatgccactactctatgtgcccataatgtcctgattcttcctctctgtaatgacagttctcatcccacaggattcaagttgcctgtttatgtatctgacacctctgctattttatcaactctttaagggaaggaattgtgttttatgaatgacattctcatttttaaaaagaaaacaatcgtttgtcaaataaaaacaaaatctgtcttcctttctttagactttcaaaattagctcaaataaaaatatattattgttgacattcagtaaagtacatgttggcagcctcttttaaagtgcctttcataaaacaagcagaagatatacacacagatacacacatacactttttaaaatttgaaataatataagtgctcttactgtaaaatgtcagacaacttttatctgaagcattcaaaaatttctcccctgccccaaacactccttattgggctattgttatcccagtttcactcttagaagacttaaggagaaaaagcattaaatagaatttatgggaggtcattgatttggactaagctcctacactaggccccgagacacgaagccaacatggagttattgagactaaagttccaaactgaaaccaacttgtttaacctgagaaagtaggagagagataatagtctaatccccaaccaggccacttttaggcaccgtgataaggaaggcttcttctgttttaatcttctatgaaaaagtaactttgaaatgaccggccttcttgttccacttctgcttcttcagccgtcttctgcctatctagaccatctcctcctgcgaggatgtgaagtccatccatctttcaaggtcaagaagtttagactttattaggaggcaatggagagtcgaagaagaatagttcaattcactttctgtagaagtgactgaaggaagggtacttccacaactgcaagcacagaagccattaagaggttgattcagcgacccatataatggtggcctcaattaagggactggcagtgtggctgaagaaaaacacctagctaaaagagaacaggaagcagaactaaccagatgtattgactgactgaatgtaaagataagggagagggaaaagtcaacgatgatctataggtttcctctaaacagtcattaaacaattatttactgagcaccaagtatctaccatggttccaggtaccagagatacatcatcagacagaagaatgtctcatttttatggaggttatagtttagcagaagatagacagtaaacaaataagatgtctacaaaaccttctctcatcattctttttttttttttagagtaaagtgaaagcaactttattaagaaagtaaaggaataaatggcttctccataggcagagcagccaatgtgatcattctggccaataggcttcttttgtcttaggtgtgccagagtacaccacgcattttggaactagatggcacagagcagattcacatcatatgtacagcttcactgggaatccttcatcccaatgaagctgataaagtctgaaataggacatacacgttaaaagaatgtctgaatgattgtaaggatttttctggcttctagcaaaaaagtaaaatattgtttgtacttctgaacaatttaaggaattttgaaaagaactctgactctacttttttcccatcacataatgaagattgatgtatttattacttggtggtgtgaattagaaatatgataaatttaaagtctaacttgtttcccatccaaacttcccaactagactgcactgtattttttatttttctctaattgttgtacatgggtaagtaaaactcgtgtaagtttccgcatagttcacactcatgggaaacaaaaactgcgccttgtatatcatcatcccccgactgtctgtcactcacagaattcaaggcacatatgaagtgctcaataaacaagagcttagaggaaatcaatgaggcttagtgcatagccttattgcaaactgtggtctccaatgcaaaaacaaaataaaacaaaaaccccacaactaaaaacaaagtaggggatgttaacaagagaacaaggatatgaaacctatctcatgaaagaataaacatttcacacagaaatcataaatgttggtattaattttaaatgacatttgtcagccatagaaagtgatctctaataactcacgatagagcagtttaatgcccaaataattgaaaaaagaattggagaggtaacctaacggcagataagattaagtaaggaaaatttcaatctgtgtgaagaagagaaggctttaatttttcaaccctttgggacaatttggaacatcagggctctacaccaaaactcgactttatttatcctatatatatcctttatttaggatccctaaatttattttttactttcttcatgaactcgtaagtcagtctcctagggcaggggtccccagggctgcggactggtactggtccatggcctgttaggaactgggtcacacggcaggaggcgagtggcgggtgagcaggcatgaccaccggagctcagagcagtggcagcactggattctcatggagggtgagcaggcatgaccactggagctcagaaaagtggcagcattcgattctcatgagggcgtgaaccctattgtgaactgggcatgtgagggatctaggttgtgtgctccttatgagactctaactaatgcctgatgatctgaggtggaacagtttcatcctaaaaccatccatcccctcctcaccgccccatccatgaaaaactgtcttccacgaaactggttcctggtgccagaaaggttgggaaccactgtcctagggcaaccttgcttgtgtgggtaaagttctttaagaaaacgggagactctaggagaaaaaagaactattattattgtaaaaagaaagattaccaaggactcttcttttaccatacaaaggaggaaatccttactacaccttagtgtccaagttcagtatacctttttgatataaaatacacagaaaagcttaatatttgatttatcttagtgtattatctatctcccccctctagaatgcgaactctataaaggcagaaattttttatctgtgttgttaactgctgtctccccaatatctacaacaatggttaacaacactaggtagtcaacagtagctaagaatggacgaaagaatcaaggcttggataacaaaacagctcgtttatggaatgcatgtatattttcataaggataattagtgtgtgtaatcaaaagcaaagcccttctgaaagaagtccatcaccaatacagataagttaccactttgtttgattatcataaactatcaaacaatgcaacccactgaaaggaaaatgtgagacaaatttaactcctatgaccttagcgttgaggaaggaaagatttacatagcgtccattgattcgctctgggaagagtgtggttaccttcaaaatctaaagtcaaaatctaaatccctaagtcaaaacctaaaacctaagagctgaaagacttctctgtgtttaagcaggcatcctgttttcactctgtggtatctaaatagaagcttcaaaaggagactctgtgcttgtgtttacaaactgtgagactgctcaaatatagaaacggaagactttttgttgttgtttgtttctagtttttctttttttcttttttttgagacagagtctcactctgtcacccatactggagtgcagtggtgtgatctttgctcaccacaacccctgcctcccaagctcaagcaattctcatgcctcagcctcctgagcagctgacactacaggcctgcaccatgtcacctggctaatttgttgcatttttagtagagacaaagtttcgccatgttggccaggctggtctcaaactcctgccctcaagtgacctgcctgccttggcctctgaaagtgctgggattacaggcatgagccactgcacccagcccctagcttctattttttttaattactagtgtaccagctcaggattgaatacatctctcctcctgctagaaaaaatttaaaataacctgagcaatgtagctcatacctgtaatcctggcactttgggatgccaagggagaatgattgcttgaggcctggattaacactccaagacctcatctctacaaaaaaacttttttaaagaaagaatttaaaatagaagtatttatttctttcaagttagcctaaaggccaaatcgagctcctggatatttgaggagttctgaaaccacgtttgccaagatcatgacggtgagaggaatctggcgtgactaactttatcttgcttctagtctcacaggctggctgcccttgctcattcctaggcacaggccaagctaaccatgggagacaggaaggatggtcatagtccctccctaaaactaaacccctctttgctcagggaccagagccgcttttgtaaaactaatgaaaggccataagattagggttatgggaggggcctgcaatttgttaaaatgtaggcgtagtttctataatcccttactgctcaggagtcatgtggccagaggtcacaagatttgtgacttcctcaattgctcctacagataacattactattgtagtacctaagattggtctttcgaaacgtttttcagacgttagcatgctggcaaccaactcacccccctggacctgtgacttatgactcagttggtcccatggcccccgcccagaggcatactcagcatagcaggaccgtttcctaccctcctatgattttatccacaaccaatcagcagcacacattccctagccccttgcccgccaaactgtccataaaaaccccagcttctgagttcttggtgagactggtttgagtaataactccagtctttccacttggctagctctgcattaattaaactctttctttactgcaatatcgtgggcttggcgaaatggttttgtgtggggaaaagaaagagagatcagactgttactgtgtctatgtagagagaagtagacataagagactccattttgttctgtactaagaaaaattcttctgccttgggatgctgttaatctgtgaccttacccccaaccctgtgctccctgaaacatgtgctgtgtcaactcagggttaaatggattaagggcggtgcaagatgtgctttgttaaacagatgcttgaaggcagcatgctccttaagagtcatcaccactccctaatctcaagtacccaggggcacaaacactgcggaaggctgcagggacctctgcctacgaaagccaggtattgtccaaggtttctccccatgtgacagtctgaaatatggcctcctgggaagggaaagacctgaccgtcccccagcccgacacccgtaaagggtctgtgctgaggaggattagtaaaagaggaaggaatgcctctttgcagttgagataagaggaaggcatctgtctcctgctcgtccctgggcaatggaatgtctccgtgtaaaacccgattgtatattccatctactgagacaggggaaaaccgccttagggctggaggtgggacatgcgggcagcaatactgctctttaaggcattgagatgtttatgtatatgcacatcaaaagcacagcacttttttctctaacttgtttatgatgcagagacatttgttcacatgttttcctgcagaccctctccccactattaccctattgtcctgccacatcccgctctcccagaaatgcccgataatgatcgataaatactgagggaactcagaggctggtgccggcgcgggtcccctgcgcccacttttccttctctatactttgtctctgtgtatctttcttttctcaagtctctcgttccacccaacaagaaacgcccacaagtgtggaggggcaggccaccccttcagttttgtctgtgcagcagacaggaagagccagttgggtgactacagttcccttcacacagaataaaagttcctaaacaataacacagctaatctcacctacaattcaggtaagtcaaaactatgagccctttcccttactgagtcccaagtaagggggattctggtccaaacaaacaaaaaacccacacaatacacacataaaggtcacaatttgtatttgctcaagaatcatataactcattataaaccgaaaccaaacgaaatgaaagactttattagtaaaaattatgaaaaatttgaaaatatgtcaaaaggttacctttatattcttttaaatattggaccacagtctaaacaggcccacccaaggatttttttttaatactgtagtattgtttggcttactacttattatctatcagcataaggactgctaagtaacatattaacttgcagatttttgtccaaaaggatgtaaatgatttttgtgtgatagaaagatagccccaaagacaacagttttattgccctgtaagacattaaccaactgacaattcctttttttttttttttttcttttttcttttctggagacaagagctcactctgtcacccaggctgaggctacagtgcagtggcatgatcacagcccactgcagtctcaacattctgggctcaaacgatccttccacctcagcctcccaagtagctgggactacaggcatgcaccatcatgcccagctattttttgtattttttgtagagatggagttttgacatgttgcccaggctggtcttcaactcctgggttcaagtgatcctcttgtctcagcctctcaaactgctagggttacaggccactgcacccagcccaatttactgatcttacaatcttattctagcattctatcagtgcctatatataatttatctgtggaattttctgggaatcagcatcaccattatgttgattccctcattcatcaggcaaataaatttatgacacgcacttactatgtatttacgagggtcattgttttacctctgaaaaatatattttgatatcttaaagttttggtatattttcttcttagatgcctacagaatataggaaaggtaagctgttactggtctatcaatggcaacaaaagaatgtaaattgattgcattattcattcttcagcaggctgattactgatactatagtcataccattgaattatttagtaacaaaaaatctagtaaataattacaaattatcagtgactaccatattctttagagcacattattttacccctaaagatgcgcattaacattttgtgattagagtacctagaagactacagaaaagagcagaaatgatcactaaatgctgcatgtacctcctgtgttttactcctaatgcagctttaaagctgtacatcctaaagaatattgcattttctcttttaacaacataaattttatctccagcaaagaaagtgttacactatctatagtaaattttaaacacttcaatatagaagtatttccagtgtgatttatgtgtatctgggttagtttccactcacaccctaatggtattagttaacatctgaagtaccctaatgaggaattaatccagaggtggatgtttatcatctgacacatggtgaccatctgccacaatgccagaggtagctactgatggggtccaagacatcctaccccaaaatatggtactttggcatattagatattttaagctgaaggatttgagaaaacagaccttccccctccccttctcccctgaaaaaggttataaaatctttcctacgttttatgaccttccccgaagcaggtcaaaggaccctaatgtgtgaggtgccctccctatacccagaagaaaggggcatccttatctccaaacatgcagtgacatagagacctgaacaaataggtcttactaagcatcctccagtttataacattcagctcatcccccgctttgtcctatcacatttctctaagactctccactcttcatcaaacctactatgaaacaagctcacgtttaactgcttcttcgggtcttcatttccttatgaagtctcccatgtcacataaaacttgaataaatttctaataaaataaattttattagagggggtcccagctacccaaaataagtagcaggaaagatacttttcctcccctttgctacaaaacattttcaaatatctttgtttctgatcaaccttaaaggatttgataatttgcattatagataaaaatatttttccttggtgaaacaaggggtgtttaagatatgtggatggctaaaaacagtagaaaaagaataattagtttatttccttttgcctttgcttgaacaatgtacaagaatctagcatgccgaatgactagaattaccataggttgcaatttgcctgttacagtcccagtttacatttcttatcccaacataattattaagaatgccctctttggttctcaaagcattctgctttggaccacaaattatatggacaccccaccacagcatacctttcttaaaggccccctaggcttaatactaggatggaccctgtatggatttttgtcagcgaactgctactaggttagctgaattccgaagctaacgcactgtttcacctgcttcaagtgaatctttctgtgataaatttatagaacaactggtgtgacagtttttgcgcctgcctaataaatgtttgtatctgtgcatgagtcagtctgagacttgcttttattacaacacactgcctgggactgtgcttgcaggtgagaagaccttcagttttcatttgctcctatctactagaggctacggatatattttctttttttttttttctacacttcacttattagatttattactaagtacttgatgctttttatttttatttttagatttcagtaaaatagtttaatcaagtcactaaacaagcaaatgacaacaacaacaaaaaagcctcagagagagagaagggaaatcaatatctagttgctaccatatgacacctaaaatgccaaattttctttttttttaatttttttaatttttatttttattttaagttctgggatacatgtgcgggacctgcaggtttgttatgtaggtaaatgtgtgccatggtggtttgctgtacctatcaatccatcacctaggtattaagcccaacacacattagcaatttttcctgatgctctccctcccctcgcccttccgacaggcccagtgtgtgttgttcccctccctgtgtccatgtgttttcaccgttcagctcccacttatgagtgagaacatgcggtgtttggttttctgtctctgcgttagtttgctgaggataatggcttccagctccatccatgtccatgcaaagggcatgatctcattcatttttatggctgcatagtattccatggtgtgtatgtgccaccaaagctcctctatctggcagttccttgcagatgaaagctccccccatgattcagaataagtagagcttttggccagaagagttttcaaattcttgcccttatagctacaaacccatgagcctatttctagatccttcctgttattcttattatagagggaataagcatctcttgctactttttatcactagaccaacatctttcttccctactagacataagttccatgaagccaagaccgttgacttccttaatcatctctagaaccctgggttctagcacatttggtactcatcagttagtcaatatctgctgaatgagtaaattttaaaaagtgtccttgatttctcctccagaccattagttgttcttttcctgttcaaatagtcggaaagcaaaggcaaggaaaaaaaatctcagaggctcacacaaaaaaagctacaaggaaaaacaagttcagttagttgttttccgtggtatctatgaaacttttttctaaacaaataatgtgttctgtccaaaacactttagcctaccaacatagcaactctacgtgcaataacggcatgactgcactgattctgtgtcttgattttaactttcaacaagtaaaacaaacacaatttgcaaagcagaattccaacactgctgtcattacggctttagataaagcaccactgacaaggccccctctagattctacatgaagacttacgcggactgaaacccgtcctcagtactccaactgttaaccaaaccgcctcccaactctaaccaactacatcatagcaagcaaatctttatatgtaaacatagaaaattattatttttatctagttgcacaatgactttctaactaagcttttattgaaaaaacatacatctcactaataaggaaaaaaaagagcaatcacttgtttagaataaatgagatgctcttcgtcctctgtgagcccctttgactcatgaattggtttaacttctgaaacctccagtgtagactgtccctatctacagcgagcgccatgcacttatgagcaggaaacacccatgtgacaaagctcagaactgtcacggaaaggtaacccaggtaaaagcgcatcaaaacaaggacacacacacactctctctctctttctctctctctctccctctctccttctttctctttctttctctctctctctattcaggagttctcaatttcccatttctcccggcttaaaagttaagagtaatcacgcctgtaatcccagcactttgggaggctgaggcgggcggatcatgaggtcaggagatcgagaccatcctggctaacacggtgaaaccccgtctctactaaaaatacaaaaaaattagccgggcgtggtgacaggcgcctgtagtcccagctactcgggaggctgaggcaggagaatggcgtgaacccaggaggcggagcttgcagtgagccgagatcatgccactgcactccagcctgggcgacagggcgagactccgtctcaaagaaaaaaaaaagttaagagtaatgagggaaattccatgaagtagtccaactaaaattttattttatcctagaggtaagtctgaggacattgattagtgcttatttttgttttcagtacaatatccccaaaagtttgaaaaattagctttgtcacaatacacttcctatattacatccccttctaataatttcagacagcttataatttgtataggaagatggcaaatgtttttatctttatgaaatttatgtgtacatacacacacatatatattttatatccagaaaagttttagctacatttttagtttcagaggctttgaattcattgattattgtgtaggtaattacttgaccttatatttatttgagatgatcttttattttttgagacagggtactgcactgtcactcaggctggagtgcagtggcgtaaacacggctcactgtggcctcctgggttcaagagatcctcctacctcaacctcccaagtacctgggaccacaggcatgcaccaccatgcccagctaatttttgtacttttttgtagagatggggtctcaccatgttgcccaggctggtctcaaactcctgggctcaagtaatcctcccgcctcagcctcccaaagcgctgggattacatgtgtgagccactaagcccagccactcgaccctacttttagaaaattcaatacataaagatgacatttccctggaacattctttctcctataaccaaaacattaggcatgagttacattttccatgtccatgagtagcacttcatgttattatatttcctaagaactattttaattataaattttagatgcagtgaattattttgggaaaggtgcatatccaacccatccctatttcgagccagaatagcttagattcctgaaatcacttcagttgctcctttaagaccgtgagaaaggaacatatgaatcttcacaaaccttcacagaagcttgttgaagattttggtttctaaaaatatttctatttcacttgatccagattttcatgttatatttcttttgcacaccatgaaaacaagttttcaactactcaaccaaaagtctcgggtagaaaactgcccctttatctcatgatggtatgaacaggagatgagtagacaaaacttttagacctttaccggctgttcctaccccaaatgccagccactcacatgttttctcgccctccaaattgctcagttttcatgatgctgcatttaaaacctatgtctgaaattggtagtttgctttttttttttttttctgggggaggggtgtttttacaagggagatttgggggaaatgtgggtatggagaaattttctttccattttccactggctggcactagaagaatccagtcagtttttctctgttctttttctccctctgtcctcttggtaccaaagcagtcaccatcacaaattccctttctttctattagtggatatggaattatctagcattattaagaataaggtgaaactgtctcagacccaggcttaaattgcaaaatgacaaaatatattaaaatactagagtacaaaagaaaagatacagaaaaattctacaaaggtatatatgaatggccaaactgtccaacatacataatccttgcataagcacccagtatgtcctaacagagaaagaaaccagttccagaaaaattaagtcaaaataatcacatataagagcttctctcttttagcccttcagtgacagctgaacgttggtcattaaatgggcatggaagaaacagagagaacaccatcttctgtttgaacaaaatcctgatctccaccaagaactgaaattgggtcttctccacttggaagactcctctctctatagagaaagagagagagctgtttttctttctctctctcttttttttttttttagatggagtctagctctatcacccaggatggaatgcagtggctggatctctgtctgctgcaacccccatctcccaggttcaagtggttctcctgcctcagcctcctgagtagctgggatcatgggcgtgccccaccacatctggctaatttttgtatttttagtagagatggggttttgctatgttggtcaggctggtctcgaactcctgacctcaggatacacccgccctccgcctcccaaagcgctgggattacaggcatgagctaccacacccggctctttctcttttcttttgcctcttaactccgcttctaaactcctcttgtgtgttcatgtcctaaattttgctgacgcgaaatgacgaagcccaggtacgtaccccagacaacgtagccacttcatactgggaacctcgtcggggaaaccaaggtacagcagtcaccgaaatggtgagcagaggaacggactccaactctgccctttcatttcaaggctctcggcctaaatgttagaaccatatcaaatcagtaacaggcatccgtcagccagttagaaacgcggttagcacggctgctgttcaaagactgggatgccaggcgtactggggaaaacatggagaatctcccagcacccatgggttgctgggcatgttggccacgtgtgaacaagcttcctttcatgaaggacttagccatcgcttgaagctggaagaggttctggagcaactgaggatttctggctggggctaccgcccagtattacccaaaccctcctggactgaccccagcctccaccgctggatgggttgtgggcaacaggattccaactttcctatgtagtttcctcctttcctgtctgcacccaccatacctcctgtcttttccactcggaagacccctctctatagagagagagctggttttctttattcttctgcctattaaacctcagcacaaaaaaaaaaaaaaaagaactgaagtcggttctggactcatccagggaaaatgtgctttaaatttggctgtggtgttctccagtggtcaaggagaatatgctattgatttgtgctctggcattaccactgcacactgacaggcagttcttttaaacacatacttgcgtggtttagacaatgtctgtgtatgactgaagcttcacttgaaatcctagtagttcttggaaatatgtgagctcaatgagctaaatatagtgccgacaggtatgagtgattagcatggtgctaactctgcatcaggaatatcaactttgtgtttccaatgctactttcaactttaaactcaaaggttttttatataaacgtttaataatacctatagcctttctattgggcatgaattcaaaacagacaagaaaataggtgtcttaaccacattatcactgctgatcaccaacaaaactgttaataatcatagacacagaaatctggatatgtcctctagtcatttaacacaatttttttttaaaaagtatatgtagcttttactaataaatattatataagattctgttatccattcaaatcttactttaagaaaaaagtcaatttagactaaaggccatgtatgtggtattatacttcacttttgataaaatctgattaattataaggcataatcttactttttcaggctgagggtcattttaagtgcttattttttccaaagaagtgaggaaaaaatgctgaaatgatttcaaaattcttacatgcacagtgcaaatttaaattgctgttcgaaattacccaagacccatcagaaaagaggaaaccacaggagaactagaaataaacctatttccattcttggaaaaccatcctgtacattaaaaaatgtcacgcttctcataaaaactggcaaataggccagtggaatagaacagagaatccaaaaacaaatctgcacatttacggtcaacccatttttgacaaaggcaccaagaacatacattggggtaaggacaccctcatcaataaacggtgctgagaaaactggatatccatatatagaagaatgcaagtagaccccacctctcaccacatacaaaaatccaatcaaaatggatcaaggacaaatgtacaacccaaagctatgaagctactagaagaaaacattggagaaatgcttcagggtattggcccggcaaagatgtcttttgagaagaccacaaaagcacaggtaacaaaaccaaaaatagacaaatgagattatatcaagctaaaaagcttttgcatagcaaacaaaacaatcaacagagtaaagagacagaatgggagaagatatttgcaaactctccatctgacaagtgattaataatgagactatataaggaactcaactcaatagcaaaaaaaccaccaaaagcaggaaaaaaaaaacaaaaaatgggcaaattaactgaataaactgaatagacatttttcagaagacaaatgcccaacacatatatgaaaaaattctcaacatcattaatcattatgaaatgcaaatcaaaaccataatgagatatcatctcaccccagttaaaatggccattttaaaaaagacgaaaaagaacagatgcttgcaaggatgtagagaagggggaactctcatatcctgttggtgagaatgtaaattagttgagctgttatgcaaaagaaaacattatgaatgttcagtgaaaaactaaaactagaactaccacgtgacccagcaatctcacaggtgggtatgtatccaaaagaaaggaactcagtgcctcaaagagatacctgcactctcatgtttatcacagcactattcacaacagtcaagatacgtaaccaacctgtgcccatcaacagataaatgcataaagaaaatataatgcatatatgtgtggtggaatattactcagccataaaaaagaataaagtcctgtcatttgcagcaacatggataagcctggaggacattatgttaagtgaaataatccaggcacagaaaggcaaatatgttatgttctcactcacatgtgggagctaaaacaatttgaggtagagagtagaggggtggttatcagcggctgcgaacagtagtgggggatgaagagagcttacttaatgggtacaaaaatataattattacgtacaattattatgtatcaataaaactaataaattgaaaatgatttaagttcctaaaacttgataacaaaacctcagagtaataatttttcagtttatttttttttaattccaatagaaattctattagcagaagataaaattttaaaatggtaacaaagggttctgtgcatatttggatacatttaatatataaaaacaatcccattcattggcagtccccttcttacccgccaaatacttttttagaaacagaaccacacagcccatacaaattcctggtttactagaagtcggtgtagcgtgtgtttcactatcctgcatatatcccctatgcggacaggggcagagctgtgtctaactaccaaaaacccacttggccataagggaggtggggccgaacatgtcctaggaacacagctgtattctcactacaaggactactccagccgctgtcatgggggcagctgcctgcgggagaccaccaagatgatgcagtgtttgtgatattcatgttatttctaatcaaaggaaaaaacactaccatgagggctggtgataatgttacactgaaactaacaaagacagggaaaggtacctcatgtgccaggtcctgtgccggggactttccatacactgcgtcctttaatccacacaccaactccgtgtgggaaacacagcagtctacccagcagtatactaccctaggagggctctgataggttaagtaactttcttaaacttagaagagaggactgaaccataagcccagtccttgcacttccgcctgctgtgaaagactacaggatttaagttttgtatcattatgacttagtgtatctggatacttggggctctctcagactgatcttccagagagcatgtcccccgcctcgccaccaacagtccataactttccagacttttaaagccctctgggttgtaacaaggtcaaagaattgccgttcaatgcccaggcagatacacaaaggtccagagccactgctttttctatagcaaaacgcacaggatcactcctggctgtccctcaggattttaaagtgacatatcacatgagccatacttcatttcttcacggctaatgtccctccagaaataccagaaatcagtatcataacaaacctaacacacatcacagttcccacttttcatatctaacctgcatctaaatctgctgagcgtatctcggagcctctctccagtttgcctccttgccattccctccctccatggcggactttcctcttctgtggccctgagtgtttacggcaagccccgcattggtatctctattagaccctctgcccctcccagtgacgtcttgatcctcttctgctcgggcaccatcttcttcaaacagccttctctggtcccctcagctgaactgcaggctcctcttctgggcttccaaagccccgtgcacatatcatcgcatcaatgatgcccagcactggaatgtgtttgtctgtctctccccacaccatgggcttgcgggtggctagcacaaatacaacttcatacttctttccttcacaggaagcaaaacaattcgaaacaggagttaagactgtccaggagaaaggggaaggagcccatggccatttcgtatctcttcatagctactcaatcattaatttaacaaataacttatcgaacttatactgtatgccagataatgtgctaggcactccaagggcagaagtgagtgcacacaggggcaaacaacacagcagaggagtcagcacgcaaatgtaatatgcaacgataaggtgcagacaagcttctttgggagcacagattaggaagacaaatcatgtctaaaggattcaaagaagactgcacaaaacctggacatctgagcttgggactgatgcatctgtgggagttaaccagtaaaagacacaaggaaagggcaggctgacatcaaaaacaccagtcaaatcaatcaagccataaccaggccttaaacccagctgctttctttcaaaggagaaaagcagcccgagcaacacagtgagactctgtctgtacaaaaactcaaaactaagcctagcatggcggcacgtgccacagtcccagctactcaggaagccaaggcaggagcatcgcctgagctcaggagcttgaggctgcagggatccgtgattatgtcattacaccccagcctaagcaacaggcaagaccctgtgtcaaaaaaatacaagaacagtaaataaaggagaaatggcctgaacatcaacttcaactcctatttttcatagagcagggccattactaaaactcccttgaaatatccatacaaagacaccttctatcaagccatgattatagtattttcttcaatatttattggaaattacataaaatatttcccccatgaacagcacacgtgcaattctgtgagaacagagtaaataaaaccgatatatatcaaacagtaccttttctgcagttgagaggtaagcaaaagcatcctctgtttaataaacaagaaaaaaatgttaaggaagaatgtagaataggttgccaccaaatatgcaaatgcattcacgcttaatacctattcttagctgaagtgtctagaggttgctttgtgtcttgcgcatcaatctcagagcaagcagaatagatgatctgaaatattaatcctaaacgggtcttgccagtgggcagctgtgggctcgcagaacctctgtgtagacagtctcattacctacttgttcaggcctctttgctggcaaaaagtatagctgaataaacagaaagacaagatctgcaatgcctcagcgctcagaaaattatgacgatgggaagaatgaagctctgaggtcaaaatcttttaaacagcaataatctttgcactacatcagacacctggcaatctcagtccattgtacttatgggaatgctttttagatgttctgattaatacgggtacttgggagcctaaacacaaagacctaactagaatacattgcaattctgagcctcaggcaatgtatatgaaaaagataccagaactaacttttgttgaataaaaggattcacggttcttgcaaatggttatgattgtaacaaatgtttatcattgtaacaaatggttatcattgtaactctaattccagttacgtgacaacaagtacagtttatgggaaaagacatgtgcaacaaccaccaaatgatctgtccatcttaccaaagacaatgaaatgatgagtccctgctagtttctagatattatttatccaagttgttgatttgtaggtgctcattccattttctcctacataatccagtaatctataatccagtaagaaactcacaacatagacatgcaatttacagtttctgcatagggtcattaaaaattctttcattacaaagtatttcttggattcttaaatatttggaaaatgcacaaaacacgtgaaaaatatagttgttcagacaaagaaacgtcattctgatctcatgttttctccccaggaacagacttcacagcaatccattccctttacatttattgtttccttaacttgcaccaagcctgaggaggtcagtgcttggcacacattaagaaaacaataaatagggagggggttacaaactatgctgattccctgttctatgcctcactctgggtgaattcaaccgtctgaagggatagcaaagtcagaagtatgtggcaagcagcaggatgccgagatggttccagctcagacaaggttccaggagagagagcctacccatctttcccaggccaaaatgttttccatgtaataaaggtcaccagtggttgccaatatgcgtatacgaactatattggcttggtcagagttagctggaaaagcaaaagctctgtagtactccagagttctcagatagacctgtccaaaacctctcattcctttgttccaacctttaatttccaacccccacaatcccaccccagtttccaaccagtactttcaccgagagggctgtaccactgcctgagaagtcacacaataccttctgcttcgtgaccaactcagacttggatatctacctgctacctatcatatcaatatgatgtagaggagtgtccggggccctagacctaaatcactttgtgtggcacctgcatcagccttccttagtgacaatcttaaatctagttggttttctttgagaatttatttccttcccaagtatatttctgtgattaaaattatgtggtgtcagaagtttagtttcaattatattttacagacacccgtctacattaaatttaccttcttgcttttccaccatccttagttttgtcgtagtgtttttgttgcaaccctgttcttccttcctgtgtctaattatttaaaaattaccactaaactgatttttatattttatttccatcaagataaacaagatacaaatagatgccctcaaaaaagttaatgatcaattgggtaaaactatatctatacccgcacccaaaaagacaacataattcaatgcacacatgcaaatcaagaacaagaaagatgatggaattagctccaaaactactaaccttcacattaatctgcctcttgcatgtcaatagtttatttcaaatattcggtccctgtcaatctaagaaagtcctaaatccaaagccctgcgggaatgacatgagtttcctggtgtccagcacacgttcgaaatcctgctgtgtgaagagggttcagagaggccaaaaggcaccattcatggactttaggagaaaatattttgtattttgtgcatttagaaaaaggctacaatttgaatgtttaaatatttaaagccaataaacaaggagctattatttaatttttaaaaaatcttttttcaaatttccctggaatattttatttcatttacaaaataaatgtatgaagatgacaaaatcttagaacttttttgaggctgagtgacacactttatctatactgttctaaattttacattaacaaaattatgttcatcacttagaatgtgacattgtatttagaaagtcagcttcccttgtcctattaaaatggtatttagattgtaagtattttattatactcaacttttcaaaaacataattattatataaagaaagatatgtgtagttatatgtacatgtatatacactcacacacacacatttgtaatcctttcaggcttacacataaacacatgttaaaatattgaaaagcagctccaaaaataactaaaatgtcatttgccaaactacttctaggctatctctgggaatagtagaatttttggtcataaaaggaacaaaacatttcctattttgcttttctcccacccttttccagccaacctcttctaaccagtctccatctttaaataatgctagagacctacaatagttttcaactatcagatttaatctctttggttgtatcagactgataagttgaaaataaatggtaatagccagtttgtgtcgggcctatcgggcaagttgtttcttcagaataatattcaatttgatacgtattttgaaacaaacatttactttgtttcatggccggctgtgaataaacagttctctaagttattagtgaagggacagcaaaatttgaccattctatctacccatctgcttctctgtggcaacaaactgatttccatgggacgcttgaataaagcaaggctgtctgtccaaaagaagtagaactatgtcctcaataggcaatggaacaatgactgacactgagtcctagcactgtcaccaatatcccgaacaatcaagcttcaaacccaaaaaggtgcaaataaaatttaagactagtttgggtttggtcccaatggggctaagaaaaactagtgattgttgaacactggattcactgacaactggagagaaaaaattaaaattccaacattatgatgtcaataataatttcatctgcagcaacattcaggaagctgatgagatgatcctaacgggtgatttaaagtgaaagggaaaaaaaacacccttggcataatttaataagatcttcagactgaagcatattcaagggtttcatgaaagaccttctcatggccttttaatagctctttccaattccaattaactggttaaatgccaattctcattacctcatcagaaatccaaagccagtcttttctgattaaatcattaaataactgttaacagtacaatgactagtaagtatttatggacagcccagcactgatatgcagctttcagttctccgtgccaaaggaaaaactggagtgggcgatttaaaatcataataaattctattcatcttcggaatgtgctaggatatatttatctaatatattcactcttcttaattgttttactggcactaatacatagattgggaagacaggcatgatggctcatgctggtagtcccagctactttggaggctgaggtaagaggatcccttgagcccaggagttcaaggccgtggtgagctatggttgcgccattgcactctagcctggtgacagagcaagacttcaacgcattaaaacaaaaaaaagtttattttagattagtataagcttttcatactctctaaatagactgcagaaatgatgattaaaagggagttcatttttgtggaaaagccaggtaggtagtgaagaaatgggaaaacatgtcaactgtgacctgccgctgcctggcagcatgacgagtcagatggccccactcaggagtcactccaaggcctgtggacgtctccactgggcaattaccacaccaacaggcaatgcctatgtcaactcataccaaagctcactttttccacagatctgcctgcaacccttgctttccctcctccctgactgcttgctgacgctcaggactggacaaacatggctcaagagaccagggttctggttccaagtccaagcttgtcaccatcctcccaagacagaagatattcaccctcagagttggaaaaggtcggctctgccacgtcctctttccttttgcacttttattttttatattcctgagcatcctgggacagagctcctctgagaaaatgaatgcgactctccagaggacgatccacagcaaacccaaagcctcctttgcttacaagttatagaaagatcccacgaacactctattctctatgcaacttcttgtccatgcagtcttaccatgaggaggatattatcatggagaaaaacaggctttgacttaaaaaacaaaataaaataaagcataatcaactaaaactaccatttaacttatgctgtaggtcactgcagcaaagaaatgatcaagtttcagtatcttccagaaactagataaatcgtcatagcttgtttaaatgaatacatcactagtaatatgtatttttaggggttttttgtttttttttttttttttttttttttttttacagagtaagacgcttataatatgtgaagttctgtccacagttacctgagatgttagggttagttgagcttaaaatagatacttccaattagaagcagccaaatataattttttatgtgagaaaataactgcaatgctagtatgaccctttattttcctagggctaaagtcagaaaacagaaacaaatataaaagtatcacattcatgtcaatggcttagtgaagacaggaccttattatcctttaaatgctgcttaaaatgctcccagactcgcccgtttatctgctcctcttccagcagagtgtctggcacaaaatggctgttccttcaatctctgccaatccccatccacatctttcaactggcaggaatttccctaattaaatgctacctgcagtatttttatcacactctcaatcatcactgtacttaaaagcttagctcataactgtcttttaatactttaaaaaatatggcttatgtaaattttataaaaatcatttaattgtacattgaaaatggtattttatggcatgtaaattatgttcatatgcggttaggttcttgttctcaagttatttcattttgcttctttttctttaaaatttattcaacacaacagttcaaggaatgaaaagattccctctttttctttaacatcttttcactcttcccggtaggcaagcgtaagataaacattaagtgacacataaattgcctctttctgtcttttgagctcaatgccctgaaagcagcccaatctcctaccttttatgtttgttggtaaatttaaactgaagaattaaacaggatgcaggtgtttgaaattctctttgttcggcctacgtaaatacctccattatccattttaacaatctattcctaaatgctgatgattcccaaagttctatccggctttaatttctccacagacctttgcatctgagtacataactgcctgctaaagatctccaggcacctcatatggtttctggagctgaactcatcatccttcttcccagcacgcacaggctcttagcaatgcttccactatgtacgtagctcaagcttgaacctgtgtcacctcgaactccttgcctctctcctactttctgacttgaatccacctcgatgtcctaccaattttactttctatttattaactctttagtctgtccccaatattgctgctctagttcagattccaaatatttctcacctgaaccactgcaccgtctctcaggtgtctcccttcttctctacatctcagatccccttctccataatggccagcacaatcccactgaaactccatttggttgcttacttctccattaaagggtaaaccctttaatcgctgttcctctctttctcactcaaccacaaattctcacatgccatatagaacccagcctctgagaatctggccccagccatctcttcctctaaaccctacagtcccttcttggaatgtctctcttgttttcaccggctagcacgttctcatctcctaacagtattctaggccaggcatggtggctcacacctgtaatcccagtgctttgggaggctgaggcaggaggattgcttgaggccatgagttggagactggcctggccaacaaagtgagaccttggctctcaaaaaaaaaaaaaataataataataataatcctacctactccggaggctgaggtggtattaaacccaagtgtttaaagcagcagtgagctatgatcatacaagtgcaccccagcctgggtaacagaaggggaccctgtctctatcaaaacaaaaaacaaaaactattctccttcactgacattcatggccccacattctcagcaagatttgctaattttgctacggctcctgtgagcctatccactccaaccacactgctgtatttaagtgcctgtcctccactttaaaacgtgagctacctgagggcaggatttatgtcttgtatttctatccacaactcataatacaatgattcttacaaggtaagctgtcaataaatattgaagaatgaacaaatgaatatagggagttcaaacatgagaactaaaggtctatatcagaaaactgtcagtcaagattctagctgttataatacagaaggccccatcacattccccaagacaaatttatattttcccactgtccttaattttatttcttatactctcattcctgaaataatgttgattattttgagaacagaatattaaggctatcgagagtgatgcttctctctcctcttggatgcaaaaattatctgtatcttcatccacaggaaaacatgtccctccctgtgattcagtttgtccatgtaaaaagaaaaaaaaaaaagctcgtgctcctcacctggccccccatctcttcccaaaccccactcattcactttcacctctgagacagccctcagatttattccctcctctaaattcccagagccactgctatagttgaggtcgttatcatctcttatttagactgttttgacaacctcttaactaatctctccccttctagtctctccctttcataacccactctttatgcgcctgggctctaaccaaaactgatcatgccttaaaatcttctcatgtgaataagaaaaagctcaaaattattagtgtgaaaatcaaagccttatactgtcttgcttcattctacctttctaacctcacctccctgggtgcattctagaacccacccatctgctgatcacttctcagcaggtgctgtgtgccatctctcctcatttgtgctcatgcttttttcctttgactttatccctctgtcaccctgaaaactccctactcatccttgaagaaaaccttgttcagatgggccattcttctataaaacctttcaacctgcccaattacaaatcatgactcttttcagggtttctgtagcatttatcttatacgcctggtatggaacacaaactattagttctagctccactctaaaatgggagctcctttgaaagaaaagtctatgaattacacatctttgaatattcactggctgagataaggcaagaacaagtcttaccactgaattttcaggagcacctaacaaagctccaagatggagataaatttgtggaataaaagaatcacccacttgtaagagcgaatatgcagaactgggtaaatgagttaacataaaatactttgaaaacataaatatgtccaaaatgatttaaacatttactgtgaaacatccctggtatacaaagactagaacggtgctactcagagcatgctgttcaccagagactgttgtggatccactgtgaaataagaaacaaaataaaaagaataagtatttagaaatttctacagcaatgtgacacggctgatccatcaaaatgcaggctgagtgggctcgtctcctgggagaaggtactggctggttcgggtcttgtcgaacttgtgtataaaagtgacacatggggcaagagctgcaggctggtcatgttgcaataggacgatattcgtctgggacagactggaaatggggggaaaaataacacaagcctttcgcgagacagtttaaaaagcaaagggagtaaaataagaaactccagtgtaccagaaccaatttcctcatgtttaccttccatattcgcttgagacctttcctccccatgataaaaaaaaaattatagatacagttgaaaccacctctatgtccttccccaacccttgcgttccccctcctgctcctatatcattttttaaataggctactgtcaaaggaaaagcagagctggagagcagagcaatgaaaatattttttatcaggactacagcaacagggggaaagagatctcagtcaagaccccaggctgaatccaaacacagcatcggcaagtgggaatttatagccaaagaggagggtggcagtcggtgaatgaaaaattattaagaggcaaaatcacaggtaagaggacattctggccacaccatcctaacaggattcttgccaaagacaggccaagatgatgacacatcacccgatgggggatgaggaagccgatcagacactgagactgatcagatatgaaggactggggttctggctaaattgacttagcagggtccttgctaaaatgcacagatgggccctggtggggacagagttcaggaacctgactaaagtttagaaaagcaaagaatctttgtcagcaccaaatcccgtttaggaggatgaaattttcctgttgaggattagggtcatgttttatttcaccaaaaaaaaagcactaaaaatgaacaatgatcaatgttattgtacagactctagcctgctaaatattatgtgaaaaggtgctgtgcccccttgtctgtgacccttcagccacaactcatacaactcaactcctgaactccaagtgaaaggccctgtgctgccccaacctgcagagggagaaacaccttactgaaatgtctacaatttggaaagaaagactaaagagcatgttgtatggctgtagaaagaataacacagacaacggatttattgctaataaaacagactaagaacaatgggctgatgagacttaactaaaaagatgtttattccaatgttagaggttacctcagagaagacacacagagaaaagaaatgcccgaaatgccaggtggaaagtaatgggctttccacggttaatcaaatgggcactgccatgccaacgtgcctcctgaaattcaaaccctctatttttgcatggctgccaactcatttccaaaacatccactgctaatcaaacttgtttggctgcctccttatcgaaactttacaaaactttaatttcagcctcatgagccctgcagctgtaaattaattgaatgaaattgacaaacattatgcagtgagataaagcactttcaaagtcttttccctattcagttgacttagctgcccagcatgccagttttgcttgacatgagttcagaatccctggaaaccttcctaatcctactctctaggccttgtgcctattcatggaaccatgttaacccatatccggaaaattaataaacctcggatgggtttaagcactcaaaatactcctgatacttcttgccattcattacattgtagacatcctttgcaacaggagaatcctcctcaaaagaccacgacggcagcagataaaatccctgaggttataagcatacaacaaaatgtctcatttaagattactgcagtctgaagccaggaattaaatttgctgaaggtgcagtcacttatgccttagttaaataaagatagtcccaaaactgatttctgaacttacccatttctcaaagggagtgcaaaattatcatgatttttaaacagcaaggcgagtaaactgatcgcctctgtatctgccaactgaacaaatgagtcagctaatcagtggttacatacatcacactgacagagaggagagaagaccattaactttctgaaatgagaagtcctaatataccgaggtgccacaagtcacttaggatttccgtggttatgaaagaagaattgaaacgtctcttccctctggtgggttttcacagcacaactgccacagcttccaactgaggtctagtctctgaccttccctcttcatcaatgttatcagcatctggaagccctctggcctatgtggagccatggggacaatggaggcagtttcaaagcttctgtcttatgacagaaaacctgggtgtaaaacaacctctgatatgaactactaagggacttgtatagattccttaaactctccgaaacactgttctcaacagcaaagtgaggagaaaaacagctctcaagtagggttggtgtgaacgtgaaaaaagagaaagtaatacaagagttgggcatataataggctcttaaaaagaattttgaaggccgggcacggtggctcacgcctgtaatcccagcactttgggaggctgaggcgggcggatcacaaggtcaggagatcgagaccacggtgaaaccccgtctctactaaaaatacaaaaaattagccaggcgtggtggcaggcgcctgtagtcccagctactcgggaggttgaggcaggagaatggtgtgaacctgggaggcggagcttgcagtgagccgagattgcgccactgcactccagcctgggtgacagagcaagattccatcgcaaaaaaagaaaaaaaaaaagaattttgaaatggaaatgtatctatttttcctttctttagaaaacaaacagaaaatgaagccaacatatctcatcacagattgctctttaaatatgcgaccttataccaaaagcagacaagttcacaaagagattatttttataatttaatcacagaaaagactagactatcaggtagttggtggctacagaagtgactgctccccactgaagcaaggaatggatagaataagtccttgaaataaatgctcaggtcttcccttagtaattctggacagtggggaaattagctcattcaaacaaagtttattaaataaataaaatcccagcacttgtctctttagacaaaaaccacatggaaacaatacaaaagattgctaatgctttggcaaatgaatcactcttccaaatgccatttacaaaagcccaccagacctccagctgtgctgatgccatgggaacccctagggcaattataagtggatttaactcaagaccagaaacacaggagtaatttttaaagacccaaaaacttccaaataaataaatctggaaaggaattactgtttacaccacagagccacaggttcaaatagccaaacttaaagaagaaaaaacacacatgtatatatctacttcatcatgtaatctctgaacaataggaactttactgagttgtcactaaggaaagagcaaaatctaagataggtagtttctggaaaatgaaagtccagagaaacttggccataaaatgaaaattataacggacttacagagctcgtcttctttgggttaagaaacaaaggtcttcttgtgcaaaggaagaattcgaaagaggaattcttaagtagatggctgatgcatccacgtctaaacatccaaaatctaccaagcacctattacataactaagccctgtgtcagaggctgtggaacaagaaccactaaaacttatctctgacctcaagaagtttatagttcagggaagtgactgacaatcataatacagaggcataagggctatccaaatagggtcacaggttacgctatgaatacaggtatcacatcagaaaattaccgtacttaaaatctcagcaaagagatcacaccctcacacaattaatgttatcaacatccatccagtctctcaagctcaccctcttcaacaatctttgctttactgagttccgggtggactatttaaatatcatacaaattgattctgacatcacaatcactgcctgcttcctaaaacttgccctccaccgtctattataaatgctttccaatcagtgctcccattcttcattctattcaccacttagttactagaatgtttttctcaactatgaatctgacttcactccctttcttgaaaacctcctgtagttcctgttgtgtacgggataaaggtcagacaacttagtatagcccagctcagtccagctagcaaagcaaatactagctttattccctgcaagcaacgtaagacaaagacaaccacactaaactcagtattagcagaccaccatcctccctgaggcctccactgctttgcacacactcttctctttctcagaaggtcctttcccctcctcctgttggtgcagccaattctttctcttccttctaatgcaccatcttctgtgtagtcttctttgacactaggtagggttacatctttgctctgtgtttctataacactcttcatatgccatggaactgcattcattatattggtataattttatttgtcttttttcttcctagactgtgagcccctggagttcagggaccatttcttaatcatattccagaacctatcacaatgaatgacacgaagaatatatttgataaaaatctgatgaatgaaccactctaaaatgcaactctaataaagaaaattactgcctattcagttggaactgtaccatgttacaaacgtaaaattatgtatagtctgataaagaaatactataatagccttggaaacagctcacatacaattttttttataaatggattcattaccatataactggaccagcttactgaagagtagccctacagcagtcacttcgcagtttgcaattcatttgaggttcaaagctagctcaagggaaaacaacgttagtattaacaaacttatttttaagcttaaggtcagaatttaagggaaaataaataaatatagtatgttctaagaatccaaaggaatttttaaaaattgccccctgcagctgtaatttctgcatggatgagaaaaccttaattgcttgctggcttccaagaaagccattaacctgcatttaaaaattcagctttcatcaagaacaacctcacatatccagctctcatggaaaaaggaatagaagcctctgacctagttttcaattattaccaaactactgataattgatctcctggtctccaggtttgtttgttttactaaaataaattccctctggagctgcaggtgcttaccatggggctgcgcaggtggaaagcagcccagtcttactatgaggatgtccgtttgccatctgggaacaaggaggaagaagcagagacctgggcaagacctcagagtaagtgtcctttttggcggctcccaggggtccccatcatgtgttataggaaggcagaattatttgagataaggataggagctgaaataagcagtgctaatactggttaaaagttggtgcttcagctgcagtcacaacagataatgtctcttcagttatatttccaagctatttctcatttggcaatgtacacttacaccaaaactgtgaaactctcggaagtggcagaccttggcaacaagtgaatggaaactgtgaattacagtacatgccactgagtaaggggtgcacatctagaaaccagaaatcaggttctgtcttggctcagcgtctaactagatgtgtggacttagacaagtcatttaaccattggggattcagtctcttcatctgtaaagagttcatttagatgatctcttaagtccctaagatccccattgttaggtccagggtcaggttccagcccatgctgaggccggaagggagtgggtagatgaatggcagacagctgaaagaacactcagggggctacgggtaggtgaaatacaattttattcagcagctctcttacactgtgtgtctcggctgcttgttccagccactcccaagcacagatctctgctggctctctctccctttggggtcaacagcttaactctttccctctgagcgcaagcaagctgagctgtgtcctggctccccgctgcaagacagacagatctggtgctctctctctttctttgggtgcaagcacgcctgcacagtgtcaccagggcaattataccttttaaagacaacagtggcaaagagccaagtgatggccctcccatgttatggctacatagctgtttatattacacatggagttgcgcgcctgcgctacagacttgctgagtcacccgggatgtttacctcagcccatcctgcctggctgcagtgcagccatgttccttacacctaccaatttaaaagtactgtaattccattttaagggttctaaaccatgaaccatgttcatggtttaggattttagatatttctcatttaaacttaggagcgaactctgcattaggacatttctcctttcattgtccataagataactcaccaaatccttgcgcaaagagaaacaaatataaactacataagaaatgacaggtgagccttaccaaggaccctgacccatgcataacatcttagtatagcatatatatatatagtatatgatagaaacatgccgtgggctttcataccctctacaatagttcattataagtttcatcccccaaagaaggcaacttacatacttaagtttttctaaatagaatccaggtgctttcaccagtgatgctctccaagggatcccatcatagtaatcagtctagccagtgccaacttcagttctactaaatttaatgccctcttattttgactcaggaataaattatctcaatggctacttacatggtccagcatagcagaaaaaaaagccacactgagcaagcagtggtcctttccatgctacacaagcaagaaatgcctataaagacagacttgagtgcagtctaaagaatcttttgctttgccttaacactctacttctggatatccttgctcaaaaagaagtctactcaaggtgtgtatctttcctctttataagccctctggcctcaggaagactggtttcattcatgtggtcatgtttttgcacagcttaagactaaactgtatgatccttccttctgggctcctacaagggcatgccaaagtcccctcaaataaccaaaacggtgcacatcccctttgcgtcccacagcagtctgctagtttatgtaataccataatgacagctatctggagtggaacagtgacactgctttttcccagactacttcaccatgtgaggtaaacggtagaggcagcaataggtctgctcagtctatggctaatacaagaccttgcttatgatagacttcaagagcttcttattagccagctgttaattcatacaaactgcacagaaattcattctggagcaatattatttgtttcacattatacttaaccttgaaaaggttagtttttcaatgggggatgattatcctggatagatgcataccccctacaaacatgaaactggcaagttcactaaagatttctcaagagccaccaagctagcaaaagtcgcaaccaaataatattatatactctgcccttcagagcaaccttcttcatgctgaagtcttcagttcacagaatgactgacttattttcaaaagaggaaggctgtattgcatattgtaactctctccaaatctatacttatgagctaattcttcaaaaggtaagatcaattaccacacagaaggagaagccatccattttcttgaagctgtcaaaatttgagctgtctcccataggatttccactgacagttaatgaaaaaaatcagtatctgtcaattttggaagaaatttaaaagtggtaagatattcttataaatcgatgttaaaattttggtataattattgtatatttggattactttatttgctttcctccaaatcatttctttactaaatttccctaagttagcttaataatgaggttttcttaaggagaaatctgttggttatacacataaattgctaacaaaaaagggatcagagctaaatggatccaatttttcctccttcatatgctacaatacaaggctactgcagaatttacaccgtgaataatgtgtattttgaaaacccaagcttagaatagtagtattttgtttcactatcaaaagacaaagcaaaaaaataaaaaataggctacactaatgtacttttaaaaatatacttggaaaagaaacgaaactatttcatttaatgctgtcttatagaacagaaatgccaatatatttacacagaaataattcagcatcttgaagtataagtaaaaacactaatgaagaccaaatttttagagttatttcatacaaatagaataaatttaggcggggcacagtggctcacgcctgtaatcccagcactttgggaggctgtggcaggcggatcatgaggccaggagttcgagaccagcctggccaacatggtgaaaccccaactctactaaaaatacaaaaaagttagccaggtgtggtggtatgagcctgtaatctcagatactcaggaggctgaggcaggagaatcgcttgaacccaggaggcggagcttgcagtgagccgagatcacgccactgccctccagcctgggcaacagagtaagactctgtctcaaaaaataaataaataaataaataaataaataaataaataaataaataaaatttaataaaaagagactacccattgtttccactagaattgctgccaagggaaatataccttttaaggatcaaggcttagaattgcttttcgcttattagaataaaatctatcagcaatctgaagaaatacataaacaatcagcaaattctagttagatggctacaaactaggtaaattactaaaatgtgccacatgaagataaagttagtcttggtaagaacaaaggtttcaaataatttttgctcttagatgtttgctgacagataaaatagagaacttcattttcaccaagtaacgcaaagtataaaaaggcatcggtatagtgctgtgctgcttttgttaaaatggtacaaggaggaaaagagagtatcttctaaagtccttgaatgggaaagccgtagtttatcacgtcgtattatcactttctatttacacagcatttgtttctcccacagacagggaggttcctgtggacagaaacatctgcttcctgcttatcctgtatctcagcatctgaatggtcatgactggaacacaggcagacttcagaaataaatacataaatatctcatactcctcgaatcttttagaaaaagagtgtgggtaacaataaacatatctgctgagaaatgaccacctcactctactcttctgcagacttcccattctgtgccgagtcaccctcagtaggcctaagtgtgacgatcctctcagcactccctgtaaacctatttaggaatccgcgaaagaaagagaagaccaccaggcagactggtgatgatatttcttggggaggctgtgcagtttttcatagtgaagcctacaacttagattttcagcactaatagaaccccattatcaggaggagagaaaagcactaatttcagatgggctctgacaggggacagttttaagaatttatagagagacatttccgtgtccagccaggatgtaatcatggaaattggatttaccttcccatccatgtgtaacaccaacatccagtggtttttcatgatactgaacaaaggcagcaatcactgagagactgggaaataaacaaaaggactgccccaatttattaagaaagcttccagaccacaatgaaggtaggtggtgtggagtcctgacaaggtaagttagcaccaacaaggaagaggccagcccccgatgggggagaacaattgttctgagagacagctaatcacaaacaacctgcttgtacaacatcctgttcccaaataccttgctctgcatataccccagcagcacaatcctctctgcacataacccctccagcatggccctagaaaacttcctttcagcccctgcctcttggcagacagcctcttctctgctgtgccggccattgcttcccgctaataaacttgttctcgtttttgttgttgttgtttcgagatgaagtttcactctgtcgccaggctggagtgctgtggtgtgatctcggctcactgcaacctctgcctaccaggttcaagcaaatcttgtgcctccgtttcccgaggagcttgggattacaggcgcccgccaccacgcccggctcatttttgtatttttagtagagacggggtttcaccatgttggccaggctggtctcgatctcttgacctcgtgatctgcccacctcggcctcccaaagtactaggattacaggcgtgagcctccgcacccggcctaaacttggttttaactcgcacctgtttcagtaaattatttacttcccgtgaagccagccttagccagtcacgctcacaacaagtagaagccaggcggagcctgaaggaggccctgagttaaggtgacaaagttgagagtatagggagaccaaaaaaggctagagtttacaggacagaataccagagaggaaagaagtgtacagggagagaaatcaacaaatctgcagaaggtcagccttaaatattccacggagtactaatcagcccatgcacatgaacatactgcctgaagctgggacaggaccagctgaaagagttagaggtaacagtagcaggtgctcaaataagaccacgaatactgcctgctcccatcaaccagagtagaaaacctcaaggttcaaggggtattgaatagaagacccaaagagccttgcctcagtgacttgccctacactaaatactgctctggtcccacctaagaaagattaaaagcaagaccccttcccctacacacactaaataaaactgtttccaaataacttcactgtgttacagggggaaaaaaagctcaagaataatttgagggatacaaaaatagctagtacccaaaaagataaaataacaacatctggcattcagtcaaaagtcgcagcttcaagaggacaaatacacgtgcagggaaaaagcagcatggtttcactggacggcagtgcattttcactggacagttgtccccagtgtcatagatgaggtcactgatgacagaaaagaaaaacatttcttgaagaaatcagacatattacttttatacaactagtgctcatcaaataacaactaccatacagagagagaatgagatgactagcactggaaagagataatagatgagccactgagtactttcaataagaattaattgtaatcatggctgggcgtagtggctcacacctgtaatcccagcacttccggaggccaaggcgggcagatcacctgaggtcaggagttcgagatcagcctggccaacatggtgaaaccccatctctactaaaaatacaaaaattagctgggcgtggtggcacatgcctgtaatcccaagctacttgggaggctgaggtacaagaattgcttgaacctgggaggcagaggttgcagtgagccgagatcataccactgcgctccagcctgggcgacaagggcgaaactctgtctaaaaaagaaaaaaagaaaaaaagaattaactgtaatcctatacctcaagcaccctgagatggacacacacacacacacacacacacacacacacacacacacacacacattctgctaaatactgtaccatgctataaatcctaaccagtagagtacagctaacacttcacttctcactttgtaaatcacattgaggaggtttctttcacagcttatcttatgaaatggggctgaaacaagtcaacagattaaatttatcaaaatataaaacacacataatggatttggaacagaactgcagctgtatcttcactggctctcctgcagaggaagataccatataactcaatgactccttcttttaacttgtaagtcagtgaaaagaggcactagtttcctgttaaccactaaaccttgtccattatcttaaacatagaatacatcaaaacacctgataggttttcagtgagaagccctcagctatgctatcttactgtcctgaatcacaggaaaagaaatatagaatattaatgagaaatagaacagctttcatacatagcacatataactagttagccaggcccatcaacatgacttggccatcatttacagaaaaatagtattgctttaattaattaccacattttcaaaggttaagggcatgaaaccaatcagtcagcttaaaccttgttcctttcaacaaacgggaaaattttcacaggcaatactttaaaaataaaacaaaaaaattagactgctaactgactccaaaaccaaaattcagtcaaaaggcattaactcccctgaattttaacaagaaatgaaatggttttccttaaaaactcttactccagtggataaattataaatattagaatgaactgcaaaaacccactagagcatctgcttttctataaacacatagaatgtctactggaaaacaagccccactgaaagctgtactgaattacaaataatccactctacacttgcttgtcagatcttagaacaaaacacacaaatatatccacttcgcagtatctgtataaatggacaagtagaaatccgaatcatgttatctgaaaatgttttgcaatcatttttagaatttaataaataaaagataggactttccactttcatttccttgtagtgtatttacattgcacagcaccttccgttagaaggaaccaacacagatgtgggctttctagttggtttctctgctgcccccttctgcttcaacaaaacacagtaggcaggcaacccagatgccaaaaatacctctcgaagccaggtttcgcagaataaacaaatccaggatgactgattatctcattttttaaaagcattttcatattacaattgaaattatttcacgtgctttctgaaatctgatccaggtgtctggttatacaaactcagtaatgacaaggtaaggtttccctcccactcctgaccccagtgctcgctcttgcgcactctctctctctcccttcaacttagaaacccactatgtcatgcaggcagccagaaacttcaagaaccttttttatttcaagttccagggtacatgtgcaggatgtgcaggtttgttacgtaggtaaacgtgtgccatggtggtttgctgtgcctatcaacccaagaatcttttatagtaaaaacataactactttaaaaacttggttctttcatttccgaaaaacagtagaataacattatttctttgcattggtcaaattacatattctttctgtgacagaatttctttctgctaggaacttaagagataatagttacaatatcacgatcatcacacatagtacaaacagtataggtcctaggaggcaaagaccaataactgtgtaatgctgataatgaacttttaaaggtaagggactacacaaacaatagtgattccgaaaatgctcagaatatatactgagcaaaattctctgcaacgaggtatataaacctgaagtgctaaaaaatttcacaaataattattttaaatacacactaaaggataaatttaaggtaaaaacagtagctgacttttagtttatttttccagaactcaaatgtcaggccaaaaaagtcaaagcagaaaacatcataaatgatacctttaaggttattcaaagagtgggaaatatttttaaagcaggtgagatttttccaagcagaaagtgcaccaaatactgaaatcacggaagacagaactcaactccattcctcacctcaaatgcaccgaagacccttagagacaccctagaagcctccattaaatcccatcaggaagttgcatgtgcaggtattatgtgcaatatggtgcacctgcaccccaatgatccaaatgcctcaagctagaaccatcactgacgcttactcaagaatgtcagcgatgggaaacattaaacgcacaaactgtggcgtgttcgtttctgctggtttcataccctttccaacaaatcctccatcctctgccagggaaatctttgtaaatcaacatctgatgagacacctccaggtgatgaaaaatgccagctagtctgaaatacccattctcccttcttccttgagactcccaatttttttttaaaatgtgtgctaaagagaagtgttgtatgaaacttcaccagaacttaaacttaaaaggtatgaggcacgtgctttttttttttttttggctcttctgcctttctttctcaatgcaggggtaatggctggagctccagcagccaccttgaaccgtgcaggaccttaaggatgaaagtcaggtgcagcacaaccaaaagaaagattgacatctgaggaccttctaaagatgcttctctagacttggaatacttccctctagacgtcatttatttttatttttaattttattatttttttagagacaaggtctcactctgttgcccaggctagagagcagtagcacaatcatagctcactgcagcctcaaaatccagggctaaagccatcctctcgcctcagctttccaagtagctaagactacaaacgcatgccaacatgcttggctaaattttttttttatttttggaagttggtctcaaactcctggcctcaagctatccttccaccttggcctcctaaagtgctgggattacaggcatgagccatcacacccagccaagacttctcctatttgagagtataaactgttgtatctttctgccactgtagttgggtctctgtcttgcagctaagtccaagctgtaactaaaacactcactctttttgttctttctttttttttttttttttgagatggaatctcactttactgaccaggctggagtgtaggggcatgatctctgctcactgcaacctccacctccagggttcaagtgattctcctgcctcagcctcctgagtagctgagactacaggcatatgccaccatgcctggctaatttttatattgttagtagagacgggatttcaccatgttggccaggctgatctcgaactcctgacctcaggtggtccatccacctctgcctcccaaagtgctgccattacaggcataagccaccacacctggcctaaaacactcactcttgaacaactctctatcacctaccagaagttctaagccctgctgcctcgccagtttcatctcctgccatgtacgacatacactatttttcttaagaattctattctctatgtctctatgtaggagaggaaaatgtttcttttcttacccatcagttcgtggctgagatccctataacaaaagacagattgacaagagaaaagcatataaatttattttaatgtaggttttaagtgacccaggagccttcagaaatgaagacccaaagaagcagggaaattggtctatttttatgcttaggtctgacgaagaccagagagttatggggaagtgtgattggacaatgggaatatgatctaatggtaataaattggggaaaacttagcaacgcctgtttgttcacattcttcttggtatctctctgcctttgaggataaggatggtctcttctccaggtatagagagtatgcctctggaatgaaggatttataacttgcttcaggagataaggatgagtagaagataagagcgaccttcttgcttctgctgtttgttctaatgccatattttggggtagcatgtccggaaccccatcacttatcatgctccaaattttcatagatgaggggtttcactgcctgaaaccagaccttaatccaccctctactgacctactaaattcctagtcccccttcctaaactcaagggtcgcttcccgtatagtttttgctgggcctctcttctccggccctactgaggctctcctcttcagtctttctcctccttccacagcatcccattcacagtttctacttgttggattcctaaacatctgtatatgtcttctacaaatcaatgggctcttgagttcagggagtatgttgtgtccagttctgtatcttcagcacttggcataatgcgtggctcataatgacattggctagatggccaatattttgatttataaattatgggtcacaggccagccaaacttgaatgtgatttattctgtgaaatcatctccaacccaaccatccctcctgtgtgtttccagacactctgaatgtatttggggttagttatgtacacatctgtcttccctgctaggctgtgagatccagaagggcagggagcacgtatcacacaagctggtacccccacctctaagcactgtgcctggcttacaccacctgctcaatcagtattttctcagtgttgacaaaaatgactacatgaaggatggctttctttaatctcatgttcattccacgttgctacagtggggatacaaaaacgaataaaacacatttcttgctttgagaaggatacagtctaagaatattagaaaacatgaatacagcttttaagacagaacatcatgttgtgtctgcaatctctagcccctaatatgtactaaactttaaatattttgtgatataaagacaaaacaaaagtaatattttactaggacattatcctaatacataatttctcttgctctatgagtattttttttaagccacccagtaaatgtgtagcaacaaagaaccatttggaagttattccctgtcttgcagactgagtcagatcatggctaactgatggtcggtcctctctcatgtttcttgttttgttttgtgtttagggttatttctttttctttgcttttcaccattactatgaattttgaaattccttccattttgcaaaaaaaaaaaaaaaaaaaaagctttcctaattattgttcattataactgtaatcttttaaaaatgaaagagtccaaaattcatctaaatgtctgttaaaatgaacagaagttgacttaagatacagtgtagtttttagtctacatatttaattttcagtgtattcccagagaaatagcagtgttgattatctctctttcatgtcctaaaattaatagcagctcatactgaacccgtctaatggaaggataaagacttaccctccaggccagtaactacaaaatgactgttgcaggaagtaggaagaacatatgctggaaactggttctaaaatgagtaatcagtgatgtcattatagggaaaagagtgcagcgttaatgacagaaaccgggcatatcatctgtgacaagagcatcacaatatagcaaagcgattactacagagttctaatcaaataaaatatcacaagataattaaactttccatgttcagaatgaaacttcagttaatacaacacctacatcctctggagtggtattcaaaaatagttcaattttaaaggaaaaactctcattctccaaaatttcaaatataaatatcccttgcagaatgaacaggaagaaaagactaattaaaaaaaaaaagaatctccaatattctttggagataagtagacacacttataaagaatgcagggccaggaaaggtagctcatgcctgtaatcccagcactttgggaggcagaggcaggagaatctcttgaggccaggagtttgagactagcctgagcaacatggcaagatcccatctctacaaaaaaatttaaaaaattagccagcaatggtgatgcacacttgtagtcccagctactcaggaggcgggggcaggaggatcacctgagcccaggtgtttgaggctgcagtgtgccaagagccaaggtcgcaccactgcactccagcctaagcaacaaagagagtgctgtttctcaaacacagagtcacacacccttatgaaggtgtattcgtatatgacagaactaagaattctgaaaactactacttgctaccatatggcaaattaccaaggctccgaacatctgtcatgtatttcaaaaatgattcactaaatattaatcccattacatgctaatgaaatatccctagttgccaagtaattttcaaaaatgcaccaactaattaaagaccaaatcacatatttgactaaaggacacgtttcatttaactcttagctggacactttcattgaactctggattgcccagtaaccaaatgtaagatgacattgtgtatggtgaccaggccgaactcagctgatgtcctaaccaaggacaccaaacaaacatgcccctgctctccgggactaatttcacatctgcactgaaaaacacaatgaagggcgtagccatgattaacttcaggccaatcaaatggctcccaaaagaggccaattttaaatctatggatcacagaacttcttcataggaagtttctgtcaagggaaaacatactttgagttttttgattttactttgatttccgtgaaacactctctataataccttatagagctaaagagaaaaattaagaggagataacagactgtcctttacaatgtactatcctcttttaccctgttctctcactgaaaattgaataacaattacaaagttcaaaatcacagatatctgacatttggaagtgccagaacacctttcaaaaaatgagctgaatatgttcaaagcaatccaaaattaaagagaacttcaaggtgcaagcaggtgataatctaaacggaagagccatctgatgcaacagcctacatcattctgcattggccctgcatggtggctcacgcctgtcatcccagcactttgggaggccgaggtgggcagatcatgaggccaagagatcgagaccatcctgaccaacaatggtgaaaccccatctctactaaaagtacaaaaattagctgggcatggtggtgggcacctgtagtcccagctactcgggcagctgaggcaggagaatagcttgaacccgggaggcagaggttgcagtgagccaagatcacgccactacaatctccagcctgggagacagagtgagactccatctcaaaacacacacacacacacacacacacacacacacacacacacacacacacaaatcattctgcactgactttcctaatggtggcagtccttgggttccatctttttatttttgtccctaataaaattgaagctattaaaattgtattacatgcttgtattgttttacataaggcagtatgctaagtccaaaatgcctaattaaaacattacaaagggatgcatactgtccatttttcttgtgttttttttcccctgagaaatgcacaattttacataggaaccgttaacgaaatggcaaccctagcacccaaagatgggactagtcctgcatctgctgccatcagcctttcttcctatcaacgcctcttacaagtcatgtctgtcatccttgtcactatatctatatctacgaatataccacattttctttattttaaaatctctccatttaagatcctttccacaaaagatgttgtcttcgtatttacctcactgccaatgcttaaaccatattttgtgtataacaaagtcaataagtgttgaattaatgatgaattatcctatcactattattgcaaaagcaactgttttaataagtgataaacactctctttaaaaagtacctttagcctgtgttctagtctcagtattgtcactaattggctgtggatttaaggcaagtcacttaacctctctagtttgtttcccagtctgtaaaatgtggagttggccaaagtgactatttaaaaagttccaaatgaatgaatgaatgaataaaaaaagaaagaaagaaagaaagaaaagttacttccagcaataaagactacagctgtacgagttttttttaaggttttatcaaccaaatcactaagtctttgaaggtaattaaattgcataaaatccaaagatgctgtccacaaagaaggcgaggtttgaatagagccaacttcctaacatgtacccatcacctattaggtgcaaaacactgagctagtcaatgtaagtgcaaaaaaatgcctaagactgtccctcagttttccaacctaatgagatagatgaatgagtaaaagagtgactacaataaaaggcagatgacataaggccggagagggacacaagcagcataatttaagacagaaaataaccaggtgtgatggcttcagctagaatatatcttggttgagaatgtatctgatgatcatacacagaggcctggacaggcctcaccccaggccacccatgacactgtaatagagtgatcttttctacttaaaacaaaatctgggcggatcatgaggtcaggagattgagaccacggtgaaaccccatctctactaaaaatacaaaaaaaaattagccgggcgtggtggcgggcgcctgtagtcccagctactgggaaggctgaggcaggagaatggtgtgaacccgagaggcggagcttgcagtgagccgagatcgcgccactgcactccagcctgggcgacagagcgagactccgtctcaaaaaaaaaaaaaaaaacacacacacacacacacatctggaatttcccttatggagttatgatgtctcaatgattacggaactttactacattggtaaagatgttgatggcagcatatttaacactgtgaatagtcttccttagtacttcatatattgaagttgaatctgcatcccatacccttcacaaacccctgcataatgaatactatttaagtcatcagaatataactttcatcatgttaattttatctgaagaatatgcactggctctttattgcctgttatgccacattcaaattcctcagacaaaatcccactgtacctatgtggtaaatggggtaaccatactatgtatgacaagtttctatgacaaagaaacttgagatttctagaaaccaggtctttcagatacctcttcactttgatatagataaactaaagaggaataaacaaataaaatttaaaatttttagctatttaatattttaaaagtaatctactgagtatagaacagtttttaaagttcagctgaggaccacgatttatgagctcgaaggaaagacatacttcgatggagtggtaacatataataaaagaccctttggtaaagctaagaggaataaaagaaagaatggcaatggcaaaaacaagagggatgtgatgacgatcagaagtggtgagagggatcctgaataacagacaaatatgggcaatatggctatgaaccttagataacgacagagaggaaaacagccaatcaagcaatcagtccatcaatgaaacatcaccaccaagaaaacataatttgtaattcgagtagtagtaaaaaggagtggcaactacctatccactgtatccattttatacacaacaaactttgaggaatctataagatgtattggaaggaagagactagagggttagaaaccatcggaacagcatttcagtatccccagaagctatcagccagccatctggaaagtgcttcaagcagaataattccagagcactaagaagcattacttacacacagcgcagtgccgtgccaagctaaatcatggagcaacacagcactgcagcttggacaggatccccatctgggcatgagcactgcaaaggagctttagatcagtggttctcactgggggtactagggaccattttcagtattttcaattgtcacaatggcatgtggtagactgtagccaggcctgctagacaggacagccttagataacaaataattacccagtatcctccaagtctttcagatgttccaccagacttgccggtaggtgagaaaatcctgttacttctttgaatatagagcctaactgtattttacttacagacacaagtgtttcttgcactgtttagtagtcactgaattatcaaggaatgcaacatccttaaatgtaaattgaagaggaattatactttgttttgtttgcaattgtaccaagagttgttcatcattgtgaaaaatcatgtcgacaattcatggcatttcaatcaccaacacaataaccaggcatcaatctacatacacagatgttacatttataggattctatgtatgtttatgtgtatacttatttactccttatttcaaagcttcaaatagaaagaaaagcttttgccaatactcagttgaatgttgttttactcctctttaatccaaatatattcattgcaagtaggtccaaacatctgatgacatcattttatctccaggaatagtcaacaagtaagcatttacataataaaatgcactgaaagctatctttctcttttctttatattaaaattgtaacactattttaatacttaaatttatgtgtagaggcagttatattattaatacatttcatttcagaaatgaaggggatattccaaaacacattacaaagatgcagcactgaatctaatagggttagtaaccactgctttggatgcacagagaaaccgtagagagcggattccaatgtatctacacaggaaggtaaagtgcaaaagtaccaaaaggtgatgctagctctgtaaaggaaaatatcatttgctcatgattagaagagagaaatacagattaatgccatatagaactctgaaagggcagcttttcctgttctttgaggatgcttggttattgtaagcggtcacaaggcaccagttcccatgccaacctgagtcaactgcagcaccaaaccatagactgcataaacacctcaatatttctcattcacagaaaaggtgagaacttttttgtcaataacttcaacaaagatgagcccaagtattttcagaaatactagcattttagtgtgatgatactgcattggaaagttggataaagtagacaaaagatagttgagaaatcctgtagaagaattctgtattttgttttagtattttgtttttaaggagctaatttctagtttgttttcttctatttctgttgtctgtaagcaaaaagaactaatttccttactggtctaatccctaaactcactgcagtggaaatgagtgaaatatgaaaaggaggctgggtgcggtgaatcacgcctgtaatctcagcactttgcggggctgaggcgggtggatcacctgaggtcaggagttcaagagcagcctagccaacataacgaaaccccatctctactaaaaatacaaaaattagccaggcatgatagcgcgtgcctgtaatcccagctactcaggaagctgaggcaggagaatcacttgaacctgggaggcggaggttgcagtgagccacgatcacgcccctgtgctctagcctgggagacagagcaagactctgtctcaaaaagaaaagaaaagaaaagaaaagaaaaatacgaaaaggagaggagattatatagctaaaatgagtgtaaacatagattataatttccagtattactattttaattattagtattaagtatgcatttattattatcatcaacttttacaaaatgcagtaagggtagaaatgtaggcgtaaagcaaagccctgtttggtagaacaaaatcctacttggtagtaacaataacaatcaaatacctccaagtcactgttgaaatgttgtcttctccacgaggcctaatgtgactttctatgtaaaactgcaagttgccccaattcctgcactcctcctccccatctctattacgatgttcagttttatttcatagctcttaccagtttctagcatacaaagtaatttgctcatttattatggttatagttgcctcctacctctagaatatatttctatgaggggaggaactgttcactatacagtccagcatgctgaaaagtgtctggaacagggtaagttaaccagtatgtatttgtggaaagaatgaacaatagcacataccatttactgagtgctttctatgggccaggcacattgataagtgctttacatagaaatcttatttaatttttattataaaagcctgcaaggtaaatattatgaatcctcagttcatagatgaacaaactgggatttagagagagtacaacagctgttctacatggtacagccagtgagcagtggggctggccctcaagcccaggcagtctgacttcaaagttccatactcgccacaacagaaactcagtagagctcagatactctttttctccctttagggggtgaaaggagtatctggattagtcagctccattgtgcgtgtgtgtgtgttgtgtgcttttttggttttgttttgttttgctttgagatggggtctcactctgttgcccaggctggagtgcagtggtgcgatcacagctcactgcagcctcaactttccccagctcaggtgatcctcccacctcagcctcccaagtagctggaactacaagcacacaccaccacaccctgctaatttttttgtatttttcggggttttgccatgttactcaagctagtctcgaactccagggctccagcgatctgcgcacctcggcctccaaacgtgctaggattacaggtgtgtggccctccccactgttgatcccattcttgttcattgcgatccttcaaaaaatatgcaagatggaagacaaggtgcaggcaggggacagatggggaatctttgtgtcttcaaaatctctcaattttgctatgaaactaaaactgctctaaaaaaaattaagcctttaaaaataatgtcttaatgcacttgtatttctgaatagttcaattttggggtcatgaaagctttaataggtaattgttgacttaacacctttacaacaatgaaagatttacacctaaacattacatgaggtaaaaggaaatttattcatcaaatacagtaaaaaaaaaaaaagtagaaattaagaatagagtaaagcatggttgacctcagcttttttgtgagagtttctattttctcatttggtgaaactatctttgagggactgacctttcgacattcagcgccatttcctttgactcctggcatcttctgctgcatgttcactattcaaagtagcccaaagggaaccaagacagtccacagctattgttttgccatttaatcaaacctgaataaagagcttgtacacataaggaaagtaaaaactcactagaggttacatgaaagaggctgccatggagaggactcgtctgttcacgtaacatgaataatttccccatcgagttgagaaagttctgaacacatttctttctctttttttttaaagactgaaaaatggatataagcccatagcacttgttagctagtcaagcaaagagtgtactcactaaatttgtgcatagaaacaatcatgatcccacagcaaaaaatacttccttaccatgcccttcatagcaggcattttgaaaactgaaaattctgccaagtcaaatatataactgtagctatgtctacttctgtttaaaggcagagagaagaggaaactaacaatactaattccataatttcagaatgagttgcaagtacaatattggaaagaatatcctcagaaaacaggttccccagaggcaggtgaccacagcaagtcatcaggagaaaaacttatatgttcaatttttctatcatcatagaattcatcccatcataaatggagggaactcttcaccttgagaggctacaatttaggatgaaagttttaacgtttaatatgtagacaaaattatcactaagatcatttagggttgtccaacttttcatgaagttcccaggcctccatattttcagtgttataaacacttgagctcccatttataagccctgaatccattttatgtctcccaaaaaccaaaatatttaaattaaaatacaggtagctcagattgactgtctctcacaggaagaccatttatgctaaaacatgctgattcttatagagtgactacccttttaaaattaaaaactgcatcagtgaaagaaaattacaacctatatttatcattcaaaaagaagctagaaaccttaagtaaaaacagggcatttttgttttcaaaaatccaatttttattctcgttatataacaaagaattttaatgtctccctaatcacaaaaagaaaatgctgtttggattaaaagcagtagttacatgccactcattgcactccagacagttctgacctttttgtaagagaccaattttgtatttcctttctcctgcctgaactattgcactggcttgagagttgggctccttccttccagtcttgactctctaatctatatttcatgccatgaacaagaattatcgttctaaatcgtcataatcatttcattctcctacttggaaactttaaacagctctttacttaatagagaataacgtccaaacttcatactagagcactgaagcaaccccacaatcaaacctcgtcttaacactcctagtcctgtacactacacacactctatgctccaaggactagaagcagataaagtcctttccatgggctcaggaaccttccttgtgtggcttcctcattccctccacttggctgctgctgaaatttaaaatcagcacatgttctacttttcccatgaagacatttccagttctcacagtcataattacttatgtcttcctttgcattcccaacacacatacattttatcttatcatgattagtattatagggggttgcctccattgccctatttccctctattgtgtgagatcaaaggtcttgtcgtgtttaattccagattattataacaaaacactgtgtacatggtggtggctcaggaaatgtttgctaaatgaaagaatgaatgaatcatgtaaacatccaatcagtcaatcagtaagaaggaataagggtgaaatgttgagtcaaagacaggactttgagtgcctgcactttcacttagaagaaccttaggttcttattcataaggctgaccatgcctgctctaccatgataataacaaggaaagaatatacatttccgttacttcatagtcaacccaaaatgatctgagatgtattatacattcccaacactgtgcggggcacattgagagacagaacataaatttcggctataactcttactgattgtcttttgtctattgaaatattcccctcctgactacacaaattgtttctttaaaaaggtgagtttgaaccacaattttatgatttatgcaatgataaagtctgacataaatttccggagaagtctagaactggttattaaacaatgatgaacacatatgaagacaatgaccaattaaagacagaacattttcattaaaatactttatatgaaactaaatattttcccttttttatatggttataaggctgaaggtcagaaaaagactataatgtttaaatgagaaattcttgatgtccttctgagcacaatgaagaagcacaggggaatgatatcagttatgtttgcaacacacccaaacagtatagactgaaaaatgaatgttgaaattcaatttttagcactatctctaatgggctgttattaagtcctggaattgggacaattctactaaacatgcccatcggcgacttggctgagatcataaaaggcatgcttaccaaatttagagatgacaaaaaattgggagaagtagtgtatatattaaatttatatatttaaaaaagctttacaagaaactcatcagattggaagacgggcctaaacaaacaagattacattcatccagattaaattccaggttctgaatttatgtttttaaaaaattaattgggttatgaaaaaaacaatccatgtacatggattagaaaactatatggtcaaataatctttaacaagagtgctaagaccattcaatggaggaaaggacagtctttttgacaaatgctcttgttaaaactgtttatctacatgcaaaagaatgaagttggatgcttacgttacaccatatacaaaaattaaagcacctaaacaaaagacctaaaactataaaactctcaggagaaacataaaggaagtcttcatggcattggcttgagcaatgattactcaggtatgatacaaaacacaggcaacaaaagtaaaagtagaaaaagtgggctacatcaaaattaaaactgctatgtatcaaagaacacaatcaacattgtgaaaaagcaatccatagaatgggagaaaatacttgcaaatcatttatctggtcagggtataatatccagaatatatggataactccaaaactcaacaacaaaaaaggaaaaacccaatttttaaaatggggaaaggactcaaacagatatttctccaaagaagaattacaaattgccaacaatcacatgaaatgatgttcaccatcattagtcattagggaaatgcatattgaagccataatgaggttgccacttcacattcactaggatggctactatcaaataaacagaaaagaagaaatggcggcaaggatgcagagaaactgaaacccttgggtactgctggtggaaatatgaaaggtgctataataaaaactacaaaaaacagtatggcatttcttaaaaaaacataaaaataattaccatattatccagcaatcccatttatgggtatgcatccaaaagaactgaatagtatctagtatagtatctagaatatataaagaactctcaaaactcaagtttgaacaactgaacatttgattgaataactttcccaaagcttgtcatttaaatgaacccacggcatgactgagggaaaagcagaacatcataagattccactcccaggctcgtgaagttactgaaaacatctattggtccaattcccaccaagttgggaaaggatgagaatgtttcccataacaaatctccacactttactcaatgaaaaacctgaaaaagtaaataaataaatacttctaaagacctgagtgttgttaaacttattatctaatgatagtatctcattgttccttcagtttttaatatagttttccttagttaagaatgtacaggaaaagaagggccaaaggggcctgttgcactgcttacctcaccagcaactatcttcttgatatatgtcatcacgattggctgatactaacggaagcaggggtgtggctttattaaagtgcatcaggagaaacatcttcttaaggaaatgccagcttttatattattttataagaagaaggagaaagagggagaacacatgtgcaagcgagctgaatgcacacacgctcaatgaactcaactactgtcaaaaaaaagcttgaaaacatttcactattttataatagccacagctgagccagcaaatgacactgttgtagctactatttatataattaaaattataccctaacatttcattttagaactccatattaaaccacttccatctttaagctaaaagcacttcaaaagaaatgtattcttgttatggtcaactaattaaaagtgcattgtatctggaccagaagaacctatttccatgcacaggctaaagacagcccggggaaatgactagtgaaccttcagataagatgacattttaattttcctttatatatcacatcgcctacacctagcttcataagcatgtcagctcactttgtcacctgctgtattacattaagaaaatgtttttattttcccaccttttcttctagaagtggcctatgactgacatttcaggaggaatagccttacttggaaatattctcttttataaatagtactcccaaagtctattccaacctaagctccacttcaacataatttaaaatgcagctttctatataaggcattttatatatgtttattaaatgccttataataaacacttatgtattcaattcagctagatcatgtatatgattcataagtaatctagataatttataaattttatacactaaatttaaattatatacccatgattttcatcacataaattaacacatactatttatatgcccctagcagaatatgcttcagaatccatgaatccattgaaataatatgcaaattttatatctgtacatacatgtgcttagctttccacagtttctcaaaagaatctgtgaatcaaaagaagttaagaaccactagtctattcccaaatgtccatcatattatttaaatataagcagcatctctgaacaggagacataagaccctctgacttttagagggttaaataaccatgcagctttccatttgcatctacacctatatgcaactgaaattgattgaccacattttcttcccccccctgccgcttttaatgactcatttttaatttccacttcaatgctaaataatatctatttttaaagtgtgcttgtttgcatatcacaccaaactaaaattacatccccaagaaaatgttcccagtcaagctaaaaaaaaaaaaaaaacttagcatatatgctgaagaggctgctgtttggtaccttggttagtgctgaagtaggcaggaagagctggaaatgcaaaacagcttctctgacttagaattacatcaatattacagttcaggaaaatcacattatttaaaactataacatgctcataaaaattcaaaaactggctctttttctgttacaatatgctgaagagctacagtgattcagtcatctacctgaaagcttttgtttcaaatcctttctaataggtctcactactcctctgtgaatggtttagagtaggacctttggtcccattcatccttctatgtggagcatcagacacagtacctgcgaacacaaagcaattcaaaaagttttttattaattaatattgtatgacctaattaaatcctaaaatttaagcttctggaagctatcccagtgtgcacagcttaagtatgttctaaaatgacagaggggcaaaagtaagccatcttagggacatgcgtcaaattattccaaacaactatcacttccagtaacattcctgagtcatctcaagataagtccatgctggcaaatatagaagtcattaggcaaagaacataaatttgcttaagatgcagaggcaaaagtgatcccaatatcaatcaccttaaagcttcataattaaaatgagtctggcaattgtctcagacacacacacacacacatacgtgtatgtatacaatgtatacatattatatatgcataatgtatacatattatatatgaacagagtagaaatatacagctaaaattgttttaatatacaaaccaaaatgacattttaaataaaagagaagcatatgacatcatccaagtagaaggaactgctaagagtcatctagttcaaactctaatctggtccattacctttcaagcattcaagtaagttttctgtcctgttttttaaaggcctctaggattgtataatgtatatcaagtgtaaggctttccaaaatcatcctttattcacttatgcaaaataagaaagaaaacaatgtgagaaaagatgaatattctcaaatctggcagtgcctgctgataacttctcactgttagatcagagagttattggtactgtttgtcattcatgtcctgaaatcttcaagtacaccaggaactgcacatgttcccaaaccaccatttcaaattagcaccaacagattggagttaatggcacatataacacattctgcagaatttaaagctttcaggccagctctaataggtagctgtgccttgatttgtggttattatcctacaataacataaaaattagctatccaggtaaagagtggctctccattttttagttggctacccacccccaattccaaaagcataggtccatcatgttcagattttaaagttgaaagaaaggtagacaccttagacacctcatggaggagcccggagacagttgtgaataatgctgccccatctgagatagaaccttcttttgttatgtactgggcacttaaagaaaaaaagtacaactctgtaatggcaaaagaaaggtgcaaaaaaatgcaggatagaagcagggccttgagaatatatctgggagttggaggaagaaggtgggaaaaaggctgagacaatgtacagcatgggctctgcagactgggcagggagaacataacaaccagtaggcaagataaggaatacagttaaatgaatcaatgagtgagtaaatgaatgaatgaaccaacataggaaccaatgaacatacaaataaaatgaatgaataagtgaatgagtgggcatataaatgaatgaagttgctgaatggtaggctggaactaagatgcagacagtcctaaatgtcatgtaatgagtctgaattcatccaaaaaagcagaatgagaaagacatttcttagacttctgcagagcacagtctgcccaactgtatgcacagacctaactaaaagcaatgagagttcacggaaagtttttaactctattaaatcagtcactgtggaagatcattcagggaacagtaggcagaggataagaaacagaagtcttacaacaggtccaaggactacgagctaagcaattgggttgttgtttttctgatcatgcatatactagaattttggatttgggtttttttaattgttatataagtcacgtgctgtaatattcatgcttctaaagtatacaattcagttgtttctcatatatttgcaaaactgtacactcatcaccactatgtaattccagaatatttcatcactccataaggaaactctggacctattagtggttactcgccatttctcctcacctgagtccatgggattcacatgttttaatcttaatattaatttctcctttatgtatctccccaaagtgcatacaaggacaatataagggtatctgcacaaagcagactctcagtaaaagatacatgattatctgccaaagaaatattgtcagaatgcaggaagtatcaagacaattttctttgctacccacctgatgcgacatttttactctcacacggtgagtagcaattttcaaggttcattaagttttttaaagtatcacttggtttcccaattgcaaaagtttaagttgtttttctccccactggataccataacaacctaaatatagtggccagatcaaaagacggtaaaagtagatggtgcacaactaataacccaattcagcaaccacagccttagatcatgatcgatttttccctccaccctacagagtgaaacaagttctgagaacgcacaggtgtttctctgcaagtccctgggcggaagtagcgggttataggataagccgatttctttttccattttaaagtcatctaagaaggtatttccattacattttgtatataattctactactgagttttggaatggctctttggtatttgggagcacacatttaaaaaaaaaggaaatctccaaattcctctcagagattattaccctgaattttagaacaaatttcatttaggctttgtatgtcatcccccattacacacacaaacacataattttttttcttatttctgttaaaaatgtaaaatacctttaatgataaaaagatattccttaagataattaaatccagctgaataaaaatatagtatgtatgtcttactcattttcctcattctgtgcatagggccaagggactaaatttacacatagcaccgaggctgtgcacagtcctcctctgtcccatcctcactccgccccgagtgctgcactgtgagaacaagacaccctcttcgtatatattcgctcactacttatgaaagatatttgcattaaaacagttgttttcataatactaagcttctaggatttaaaacaaaataaagcccgaactgaaaacaaaaaacaaaaaacctgactgcattttggtcagttcatctcttcctataaactattttaaaaatttatttatttatttattttttttctgagacggagtctcgctctgtcgcccaggctggagtgcagtggcgcgatctcagctcactgcaagctccgcctcccaggttcacaccattctcctgcctcagcctcccgagtagctgggactgcaggctcccgccaccacgcccggctaattttttgtatttttagtagagacggggtttcaccgtgttagccaggatggtctcgatctcctgacctcgtgatccgcccgcctcggcctcccaaagtgctgggattacaggcatgagtcaccgcgcccagccaaaaatttatttttaaaaaaagtttaaatactttgcacagtacctaaatttctttgtaccgctctctataaacaaatcatgtggaaaatattttctaaatgctcaggtctgtcaagtttgctagacataatctaatcccttttgtatcttctctcagtaactcaagactttgtaaagctgcaggacagttaagacaacagggacccaggggacagagccttcacaatcagtcacagcagccaccaaacccctggcctgagctatacagaggaaggggtttttatcttcttccttcacaatgcctgaatactctcaaggaatcctccataaataattcattagcagcaaaaagaatacagtctaatcaataaggagtaatggcgaaactcacagcaggttcaggggactgattgagtgttacattaatgtctgattaagcttcctgggaaattttaattgttcatagaccaaagacctaaaattaaccttttaaccttctgttataaagggtctttctcaatggaccaaaaaatgtttataaaatatatctaatgaaaatgggaggctaacatgagtatttcaatacatagattttctcaagaccacacagaaaaacagaacttggttgacttcattctacctaaaacattcctaatccaatcatattgtctaatatttaatgattattttccagtgggtgttataagagctttataacacactttcatttctcaactatcaattccctattttccaggaaaggaatttagcaaactctgcactctttttctctttttctagtaattccctttgtcaattcacagcaaaacaaactgcatgccataagcattcaagaagctgagtttgaaacacatttctttaacaaaaatgaaaaattctgattttatagttacacatgtagaattttaaattaaaaattgttgatatgtgctaatattacacagaaaatccaagatggttaacaatggtgggttatagaaggccttaatgacaggctatttctccaattttgttttgttcaagctaatgttaaaagaattgaatatttcatcacactctgagaagacagcaaagaatcctgctggaaaggaaagagcagctgatctaagcttttaaatatgccatggatagtccgcacaaagatatgaatcacctgtgtttcactctacaatgacacagctctccctttcattaagatatgaatcacccatatttcactctgcaatgacacagttctccctttcatcaagatattcttttcatcatgtattggttgatcgaagacaaaacataagaatggacaaatcattctttagttacataagaatattatctaaaccaagatctctttcaaaaggatcatgaagaatgcacatatatacaaatgagaagacttgccagtaatggtcaatgaggtacaagtgccaggtttctgctgaaatgcttggtaaaacaggtaaaaggatgatgggttctggggatcaggacctttcgcttcaaattccagctccaccgctttggatgtgcattattttggcccagacacttttctctaagcctatttcctcctctggaaaattattagtggtattcatcttgtacacgtattctttgggactaagaaaaaatgaaagacttacactttctagcaacaatataaggtcaacaaatgttagctttagtattagtactagcaccagtagtattagtaccgctagcagttactgcagctgtgcaacagagaacggaagtgtccaccatcttcattgaaggaactgctccgtggtggattattttcctattaaagtttatactttaaagcatcaaacctttttatcccgcccatttggaaggaaatgctatttatttatttattattttttagagataggggtctcaatctgtcacccaggctggggtacagtggcacaatcacagcttactgcagcctcaaactcttgtgttaaagtgatcctcctgcctcagcctcccaagtagtagggactataagcacatgccatcatgccccgttagagatggagtctcactatgttgcccaggctgctcttgaactcctggccttaagccatcctcccctctccgcctcctgagttgctgggatcacagaactgagccaccaagcccagctggaaggaaatgcgtttcaaatgcacatcacggtcactggcttagcagagtggagtctatcttccttggcaattcaggaccatctttaggatcaatacttactatcttatataacttatgacagtagaggtattgtcaggggctacccaagtgggcaggcttcattcaggtgacctatccgttcaactgctatgtttttcttgaagctggtgactctgtcaggaaaactcagaacaattctcagaaaggttcataggacactaaatgtcttagggtcacatggagctaatacataagggagcagtcacttgaacccaaaagtatctggcttggaaatcaactctctctaacaacccatactgaactcagctgtcactgtatacacacaacagaactggaaactctgcaaaagatctagcaggatttgaattccacacgatatgagcaaatgttgaacagggcgacaggatacagctaccaaaaagcctaatggtaaaacaaagacaaacaattatttctcaaattttatcatttgtacggatattcaaaggaattttaatgtcttaagcacaccttgacagatggtgcattcctatgattacttactttcattttactgtcctcaattctctccttcacagttatggtagccaacaaaagcaacagcagcataatgtctattaaacatgtacagtgtgctagaaactgtggtaagtcctttacagaaccacagcccccctgaatgtactcaaaattctgcagtaaatgactaacatgccaacgtaaacacatttaaaaaaaatcttcatttaaatttattaaacagtccagaattcataaagcaatgtaaaaacattcaagattccatttagtaaacacatctcctggaatacagcactagttgctgtttaaaccctggtgattgagttctatgttcagtggaagcagagtcgagctggaagcaatgaaagacttattttgaaacaaagttaagtttcctataaagaagtcaaattatgtttgggttcattctctttttcaaagttttcctcttccttactctcacatttaagaaattacctttaagcaaaaagaacttgctcagaagatagcagtcactaagaatcaggcatcaccggccttgaacctcagtataccacattcttttttctttctttagcaccagaaggatacctctcttctcgattcagtagtcccccttacccttaggggatacatttcaagaccctcagtgggtgcctgaaaccacagatagtactgtaccctctatactctatgctttttcttatacatacatacctatgataaagcttaatttataaattaggcacagagattaacaaaaataattactaataaaacaattataataatatactattcacagtctcatggatagattctttcttcctgtagatcttagcaacctcagcgtattttttttttctttccttattaagtcgggaactttcaccttttcactgaaggaagcactttacagcttctttttggcatatccaaattgacagcgctagtcttgcactttgggagcattattaagtcaaataagggttacttgaacacaagcactgtgagactgcaatactccatctgataactgagggtgactgctaggtgactaatgggtaggtcgtgtatacgcatggatacgcttgatgaaagaatgattcatgtcccgggggatacgggattccatcatgcttctcagaacagtgcacgactgtaaacctatgaactgtttatttctggaattttccatgtaatatttttagactgtagttgaccaaaggtaactaaaagcacagaaaatgaaacctcagataaggggggcactgctgtactttcagtagagagttctcgtaagtatattgctcttttctggacacctacaaacacaaattggccagaacatcatgaagcatgtttagtgtgaagacaagtaagaagggcttggtgatcttagttccaacctttggcagcttcttcatggagataaacacgagggtagaaagttctgtgcaagtctggctgtgcaaccagcctctcttaattgtgtaagacccacatggaatggtaagaaataattgccaccacaatggacaacaaaatctcactaatgtgaattaacaggcaaaaaagctaacctggattacattatcttttttaatggaaatacagttgtatatttaatacacacacacacacacacacacacacacacacacacacaaacatgcatcctccaattagactaacagtgtagagggtcttgggacctgcttaaaggatagggactcttagtgaatcatgcattactgcaagaaatacgtcttcccaaaggcttcaaaacaggtgcctttctttgtaagtttaaacagtgtccttgcagtcttgggtatacaataggattctaagtcagttctctccataacacattttgaaagaaaaaaagtcaaagcaggacaggcatggtgctcacacctgtaatcccagcactgtgggaggccaaggcaggtggatagcttgttcaagaccaaccggggcaatgtggcaaaatcccatctccactaaaaatacaaaaaatcagccggctatagaggcatgtggctacggtcccagctacttgggaggctgaggtgggaggatcacttgagcccacgaggtcaaggctgcagtgatccatgattgtgtcactgcatttcagcctgggcaacagagcgagaccctatctcaaatcaatcaatcaatcaatcaaagcagcactatatgaatcatcataaatgtcaaattagtaaggtctaaattctagattctgcttattcatgctttgggatcccagcctctatgcttctggatcctcccatctgttaggtcaacaccatttacctatatgtctagaagaatgctccactacatcacctcacagaagggcacaggatcaagatattgaacatttgatttaatgcagaaaaagtaactttcccaaagccttgtgctttccagccaggcactcgtttcctcacacaacagcagcatggctaaccaacagcttccagaagtacctgtaaagattgataactttagctggaggaaaagctggagattttcttctccattccctgactgtacttataagctacttactgcagcccggcaaggctctcctcacctggacggacagcctccctgtcgagctgacaagagctgacggatacacccgccagaggactactaaagatcgggatgctgctaccgccatgtccctggcactcttcagggcaagcctgggtaccaatgtcttctcttactcatggcaaacactgacgtggaaccagcctaaaaattctaacacagccccttctcaattaaatttattgaatgtgtttttggtattcgaagctcatttttatgtttgcaataatgtcagtacaactgatccattattattaaactacagtttttaataaaactccatttcaccataacatctaaaatactgcagctgaacttgattaattataccctagaagaaagtaataacagatttccctatttcaaatacaaaatgggaagctcctgttttattcttctaattatatgagaatgggcaaagtaatataccctccctgtcaacaaatttcagaaacttgcttttatctttttatttttcctccagtcagagtccttgttaatgacaggagcatatcataatttaattagctgacaccaactggcaatctacccacttctttttaattggaatcatttcatagaactatccataaaggcccattttgcataactaataaccttcataaacaagacctttggaaaactgctgactttaatggaaagagataaaacacttggacacaggcaccatgttcccacttcacagaagactagggacacagaatttactctgcaatgtatataacagagctaattcaggaagcacgaatcgggtttcccggatctggatagcaaaaaacttccagaaagtcaacttccccaccgcctcacgaaagcatcctaatagttttgtatagtggaaagaacacaggcttgaaaatctgaatttgtctttcttctttctttagacaaggtctcactgtgttgctcaggctggagtacagtggctattcacacactcaatcatagtaaactatagccttgacctcctgggctcatgggatccttctgctttagcctcctgagttactgagactacacatgcctggctcagatgcaaattttaatctgagctacaatgtgaccttgatcaagttcagaaacttctctgagcttctggttcttatttgcaaaatgaaagcggtataacatctaactcaaaaggctgtcaggaatattagttataatgtatgtagtgtcagcagcgaatagctcaataaatagcttttattctcccaattattacatattaaatttgactaataatactgaattgttgggatcatattagataattttgtgcaagtgcttagacaattaaaaggcaatataggcatctgagcttcactggattaaagacaagttttaaagtgctgttcttacattttacttgttttgattattgattaactgctatatactcaccaaatgttgctgccttcaatgaacctgagatcttaagagcacaggcttggcaatcaggtgaccgagtgtgaactcagcccactttctagctgtgtaacattcagtaagtagcgtaagcctcttaaattgactttccgacctgagaaaagcagctaattaaaaaaacagcattcatctcacagacatcacgaaggttaaatgaaaccatccatgtagactgctaagcataatgcctggcacaaactaagtggtcaatatatgttagtagctattattgaattagtgacaatccaagatcgaatctgatacaaatgaggaagtgagacttagaaaggtcaaagagtcttaccgatattaaggagtagaggaaggaattttattccaggtctgtctgacttcaaaactcatattcaaccctaatgcttttaaagcactcttaaagcaggctcagtcattattttctaatatacagttattgagtattcacaggctgatcgaagtgccaattgttgaggatataatcgcaagaaggtagagggtatccctgccctcagggagcttacctatctgggagaaatagataaagggcaagacaagaaagcatgccatgttctccgataaggaaaatacaccagcctaaaggtgcaccatgcaggaagaacagggaagtgaataaacatgaactttttagaagaatccaggtactaaaacagcttatgaccttttcttaaaactaaaatttctagggatttccagcaacccaggacatttgtatatcaaagaatcaaactacagaactgtaaatggaccaaaaagaagaaaatgcttatggcctgacctcagtagaacacgtacctgcacatgtgagttaacgacaagggtttgggaaagagacctctgtccaaacaaacctccttctccgccaagtgccaacacccatccttccttcagcagttaaagaggagacagtaaacacaattggctttctcagaatggagggtatgcagacccggtgcagggtaaggcataaaagactaacagaagaccgtcctgggggtgagttttgaggaagacagaataaactagaagtgaagcggagtgtggagaaccagtctgggaagcagagactagaaaggaggcaaactgcccaggaatctaataatggggcctacacacccatgctagccagagccacatactccaattcacctagaattggcacaacagcaccaattctgagaggaggaaggggaaggatggcagaagagaagaaagaaagcagcagctgaaaatttcaagaactctccaaactgttcctcccttggtgaaggttgatggtgtcgtccaatcactgcagcaaactgacacaggggcctgcagacggttgtgtgtggcttttggagttagagacaggccgttttcttgttaatcggcaggcaggcgtgacagtgttcggcagaggacaatctgttcgagaataattagattccccctcgcttcttgcgttggtggcggaagcacccggagtatttacaatacaccattttgcttccatccgagtccatatgttcgctggtcaggttaaaactgaggctgcatggcacatttttcactgtaaacaacgctgccccggcaaaccctaggggaagggaggcgatcttgccctcttaatttcccagtccaaggaaaggctcgccttcaggaacggcagcagcttcgatatttattgctggagaaaggccacacctccggggagtcatgtcaggagccataggtccagccaggggagcagccctcatttgatgtgagacaaagaagctagaaaacagcccccatgaagagtatgcctttataacatgttgaaagtcacgtgaatcaggacgtgctcggtggttgtaattccatctattgatggcagctgctgctgcaacagggaggccggctagggctgcacactccatggaggcggtgggagcctcacccattctgggttggggcaggggctccgtgggtgccactgcagccacccaaatcgtggctgcagaccaggcttcctgctctatggagcaggcaggcgccccgccttcctgggtggggctacagctgcccaaactgatgctggagatcggagcttccctgtgctcttggtgggggccgggagcagacaggatctgccctccagggtagagctgcagcctccctgctgcggctgcagacctgggcttcgcgctcaatcgagcaggcaggagccagggacaagagggagccccacctttactgagttggtggagcgtgaactccgcaggtgcagacctggcatctctgcagcctgcaccctggagggcccgggaagacccgccccccacttcatccctgcaggctcgggggtgtctgctcccgcttcccagcccctctcctctccagatgcctgctctgatctccgaccggggttggggccgagcccggggcagcaggaggcagagagattcctgggtggaaggcggcagtccccgtaaggcccctccttcagaccagggagggcctgaaggctgggggccaggatgccagtccgggaccggagtggggacttgtggtgcctcgtctgggtgcacatggaggaccatgggccaatcggcaggaacttcctcccctctgaggtccataaaagcctcaggctcagccagagcagggcacgtggagacaatgggcgaaccagctacagagaggagctgccctctgctgagagcttcagagacctgcagagatgtctgaacggcctgcttgtgaagaggagccaccatctccagggcctcctctctgctgagagctcaacactccactagatgacctgcctacagagaggaactacccacagtgggcttcctctgagctgttctgacactcaataaagctcctcttcatcttcttcaccttccacttctctgagtacctcattcttcctggacacaggacaaaaacgggcaaaggtgccaccagccacagaggtttccggccagaaaagcgacaccccgaagatcacataacactatgatttggaggcaaagaatggaggaaaatggagggaggaagaaaagatggagaaaaatctcttaggcatacatgcctgctgttcaacaaacactgtgctaggcaaggtatacaggccatctccaagaaaagatgactaagtgacttctggaacgaaaagcacaactgccatcctaaccccctccccaacattttccagggatcagccctttacttgttaataagcaagaagacaatgcatctgttgcaactgtgccatcagaggacaccagggcagagttactgcagcacttaattagcttagtgcacttgaaggctcagcctggagttctcaggtgagtggcaggaaaaccctacaactcagggtgggtcccaggacaaatgcagctgatgtcagaaaactatgtttggcaatgcagttagagacaaggagtagacgcctcatttgagaatcatttctcgaaagaaaattctagaaatgtgacagtagctggaggaggatgtggggtcagtagagatgaaaaatatgcaaggcctgatttttaaaatacctctttttgcatttcaattaaatgattaaaaattagcactaaaaagaaccatggagatctatatcaaaacccttcttttctctacgaagaaactgagatgcagaaatgttgagtgactgcttgtctgagacacctagctaatgaagagcagggctcgacttagaatttaggattcctgtccccatcactgggcctctactccatctaccacaatgccatgccatgtttctcactctgctgtgactgatcctcaattttagttttagttttgtctttattaatatgtttcaaaataccctaaagagaaaggtatcagattaactagcagaagtgataattttttttcctttcaaaaggaaaattttaactaccttcaccaacaaagggattaagtctgctctatgatggaactgcattaaaaataatgaggcagataaaaaaaagcttttattattttaatgaattcaaaagccggaagcattattgagatgagcagtgtgttactgccctaatccaatgttaccatgttttaaaaattattctgggtaggaacttttctgctacatcagacaaaaccccaaaatatgccaagtagacagaatattaaattaacatcaaatcctcatccctttcaaaatagagatcacgattctaaggagcatccttgaaagcaccacctataagacacaaaacttgctcatatgcaaagatcacccctctgtctacaatgtaacccaaagattcctctgtctgccatttaacccatgtcctaagaaatttatgattctacacattctttatctgaaacaaccattaacttctatatgtacaagcaagttaatttaatctctctgttcttttgcatccgcagctatagagaaagaaattctgtttttttaacttaccttacagggattgattctatagaagaaaacatcacagtaacatttggcataaacacaaatttgccactttaatgtgatactctcttaagtctcagaagaaaataacagaatcttctttcccaatttcaatgttcacagaaatgttactcaaagaaagtatactataaactataatattccattcttgtgtactatagactataatattccattctctttcaaaacagatcacatttcttggccattaagttgacaccattctgccacattcttgacacatcaagtttagaaattagtactcgggtaactgtgggaacaaaaatgactctggtaaagtgaagttaattacatttaacttattctgaagggttgtattttctaccacagctcacttatacagaccactcccattctgtaatcaggcctagtattacaaaggtatgctgaagcattttttacatctgttggttaaaatgacttattactatactgctaattctgtacatactgtactaatgtttctgtctgcataaagcacaagaatagcctatatggaaaaactgggacccaaaccaaggatttctcctctgcagctatggaggggatgaagcgagtctatttgtctaagaagggaaatgtctggcccagccgtggaagtccaggggttggggggacatggaaaaaggccacagggaaggagacaaaaccagaaaaccctgtccacattaccacagtgacatcccaatggcttactcacttcccctccagagccctgccaaagagccaagaagtcttaaacatcatgccccagcttaccatcctaaaagagatggaggaaggcttgttcagatggctggctccaggttgaaatgatactctagagaagttattactcataaaatattccttggctgggcgcagtggctcacgcctgtaatcccagcactttgggaggtcgaggcgggtggatcacgaggtcaggagttcaagaccagcctggccaagatggtgaaaccctgtctctactaaaaatccaaaaattagccaggcgcggtggcgggcacctgtaatcccagctactcagaaggctgagtcaggagaattgcttgaattcaggggacagaggttgcagtgagccaagaccgtgccactgcactccagcctgggtaacagagtaagactctgtctcaaaaaaaaaaaaaaaaattccttgaggggaaaaaatagccccacagccccctactttcaatatcattttgtccttctacaagcaggatagatggacttcctgttagataatgaatctaactccctttttttttgatatggtacaaaaagtatggggttcatggccaaggtgtttaaaatcctggctctgctacttagtgcaatgaaccaagtaactttaatttctttgaccttcagttttcccatctgtgaaatgaggataacaaacctatgttgaaagactactggaacaaagaaaaaataaaaaactctttgaaaaggacctagcctatagtgtcacattcagcatctactcaataaatatttgtcgatccttcctccacagtcctcactccaccagcagacagattcaaacatcacttgattagatgagcaaataattttctttaactacccaagtatctttaaggcccgtttcaaccccagaagtagattcaataccatacagaggtattttcagagcctagctgtgcattcccaaggattcaggcgtatgtaggcctgtctggcattctactaggcctgctttccagtgaccttcctgtggcaggagccgagatcttctggagaaagtaatgggaagaagcaaatgcttacagacttggtcaaaagaaaatggagaaatagaagaaggaaatttcaagtggacaactccaacccctgagtcagaggtcagcactgtgggatgtgggggccaaaacaacaataaatgaaaaactacttcactgagaacgctgtttctgggagctcaaggaggaactacttcctctggagtctgtgaaacaaaacaagctccctggaagtgaagggttcagcccagtggctgctggagcagaaaacaaacatgaaagtgcctgggtgacaaaataagagaggctcccggcaggcagcccacatccagaggagagaaaaggcagcctgggacacctggcgtctggagagcagggatgacgatgtagagaagtggagggaagagagtgtttgttaacacatcctggggacaagggtgtagtccacagatcagccacaaggacactcagaactgacttggaggagcttgtcattggctatgtgaagaccgagcatggaagtaccatgttgttgctattttcatcctgagcaattataagttggtaaagcaagagttatgtgccttgaaactaatgccacctcagtctagctgctcactcagagcaagtgcagaggaaggcaagggaaccaatattctccatacacttgctatgttttacgcactgagtgaagatttttctcatttaattgcatgtaatttcattctaaagagcagacaaacaatttcattcgattagatatacttcctcaataaaggcttttgaatgaaagcaaatttcattttgctgatcaggctacactacgtgagtgtgtccttatagaaataaattaacctggaattaacattacgtatttttgttgttgttttcaaagacagagtctcatcctgtcacccagatttaacctttctcagccacatctgcaaaatggggatggtaaaaataggtaatgataggagctatttcacactgttttgaggactgtgttactacacagtaaggtgcctggcacaaagtaagcactcaataaatgttagcaatttttatgttttataacactaggctgctaagctttgatggaggaaatcatgcaacaaattctggggagtgtttcctcaacatatctgatgtccaattttctcttgtagctgcatggggcccagaaccgtatcacatggtgcagaagttctctcaaatttccaactgtctactcaagcaccaagcctctgcgtgtgtgcgtctccctcagatgatcttgcttccaaattcacaaagaaaacagaagccacagccctgctaccaacttcctacccaacccccataaacagcattatccttctcctttaaactctccccacttttgagaggaacagtcctcctacacagaccatccattctcctgtgttccacatcctctctgtctcctacagtcataacctggacttccttatcttcagtctcatttacttcccactcatcacttcccctcagcctaaaaccctgctggagatagggaaggagggagggagggagggagagggggagggagggagggaaatatattttatttatattttgattggccgattgcttttcagggtttcactctgtcacccaggctggagtgcagtggtatgatcatagctcactacagccttgaactcctgggttcaacaaatcctcttgccttagcctccccagaagctgcgccaccatgcctggctaattacttttttgttttgttttgtttgttttttaatacagacagggtatcaatatgtttcccaagctggtctcaaactcctagcctcaagcaatcctcctgccttggcctcccaaagcctgggattacaagtgtgagccaccactcctggcctaagtcttctattttaaacaatcccacctttaacctcattcacctctagctacaacactttatttatcccttaatagccaggttgctagaaaaaaaaccctttatacttgctatcatctccatttccccaaatttccaacctctcataatatgtactgtgacatcattaggcactaaatctacccttgctttgggtgggttctaatgacctcttaaatgcaaagtgcagaagactttaatcctttctgcttactgccccatacatgagtcactccctcttctacattactgtggcctcattacactgcaagtttactaaaggcaatccatcaatcaatctggcatagctttggctatatccactcatgtggtattgcacgcagcctacattcactgaacgaatcaatggaaataataagggccttaaaggctccgatggcttcattgtgccatccgctctgcttctatcgctactaactatggaaaaagttaacatttctcttactaagtgaatgatacctttggcaaagtaagatataaaaggtgtaatgttctagctgatcctgctccatacagctccaggtaagtaatctgccccagtgagagatctgtttataccggcaaagtgcttcagggcttaagtcttcagaatttgacccccgctcacggcacagaaggatgcccaggacacactataaagctattagaaattgaaaccaatagccctcctagtttcttttaatagactttcagatgcagtgttttctgctttcctttaaaaacagtagaatagtaattaacatttagtaattttcaaagcagttgtgcaggaagatttcctgaactatgaaagcccacaaatttggcaacaagaagtatcacaacagagaaacagctcttggtttattgttcattgttccccacacttagttaatgtgttacaatgacaatgtatgaaatacatgaagttaccatcaaaacaaacaatgttttttttttgttttgttttttgttttttgttttttttttgagatggagtctcactctgtcgcccaggctggagtgcactggtgcaattttggctcactctaagctccgcctcccgggttcatgtgattctcctgcctcagcttcataagaagctgggactacaggcgcctaccaccacgcctggctaattttttgtatttttagtagagacagggtttcaccgtgttagccaggatggtctcgagctcctgaccttgtgatctgcccgcctcggcctcccaaagtgctgggattacaggcatgagccaccgtgcctggcccaaaacaaacagtatattaaacaagaaaaatgaatttatgaattagctttcttccctcccaaactcccttactctacacaagtcattcctgatggagagattgaaataaaatgagaaatttaataatgaataatagtaatactattactaataattccagcaattatactggtattactttaaaaagaaaaaaatattgcttaatctttagcttttgctccacagcaaattccaattctttcaggacacagccaagagaaagcagataatgttcgtcccttatttccatacgtttcttgtttcaaaatggcaacccaaaaggaatactccactgattgtttgtagatatgctgattaaagaaaaatataaaatttcaagcccatcaaccagtgctgctctataataatcaaaaactacctttacaataaaaggttatcaaaccaaacagtctgatcatcacataatttctcatgaaagctgaaaaggaaatacaatcattcacttattggttcatctttcaccaaacacttattgtactaaatgctggcaatacagaagtgaagatctgcttcatgccctaaagatgctcatagttagcaccaagaactacacatctcgccaggtacaggggctcgtgcctgtaatcccggcactttgggaggccgaggcaggtggatcacttgaggtcaggagttcgagaccagcctggccaatatgggaaaatcccatctctactaaaaataaaaaataaaaaaaaatagcctagtgtggtggcacgcacctgtagtcctggctactcagaggctgaggcaggagaatcgcttgaatctcagaggctgaggttgcaatgagccaagattgtgccactgtactccagcctgggtgacagagcgagactatgtcttcaaaaaaaaaaaaatatatcgacctctaagaatcacatttatcttgagctacagagttcgaaggacagaatttttttttttcaattaatgttaaggtctggaagtttgactttggctcttaacctttggctcacatacctaatttggttactatgtgtttactacatgcaaaaagacttccttgggcctatgaatcatttctagtaaatggagctaataataactttccatcagaaagctctttgtcccatttttgtatcagaaatgggcaagaaaaaagtgaaacaaaataaaacaacaacgtgaagatttttttaaatcctgcccctgggatgttgatgagggcagagacaagcaatttacctgcacacaaaattaagttttttaaataatttagattctaaagaaaggaacttttagaatgacatctgctaatactctaaagcttataactctgagttattgggaaggtaagaacatattttccccataaaaataagttctatatcatggttatgatccaaggtgaactcacagaaacctactttctttggttccttcaataaacattaaaagcctgttatttgtgaggcactatgccaaccattagggatataaaaccaaataggactcagtctctgcccacaggagcttaagagtctagtggaggaaactaaattaacatttgcaagaaatgctgtgtttcctaaaatatctacaaggtgttttggggagcaaagaaaacgggcaccttaatcagactacgaaagggagagtcacagaatgctttcccttaagaggtcatatttgagctgaatttgaaggctgatgaggaattacctacactaaaaaggaaatcacaggtaaaaaggtcgaacaaaccgtatttagtgatttgctgaatcatggaggtgggtgacacaaaggaccctagaatgactcaggtgtctggtttggataaacaatccaacgtaggcaccattcacaaagaaagggatgctaggaggtacgagggcaaagatgaaaaggtcatacgcagaccgcaaagcttaaaccttcgcctcacatctgtttggaacagcagtagctttttacttagcgcttacatcaccaaagccaatgagtagcgaagtctgggacgaggacaagagctgcccttggcatcactgcctgtcacctgtcccttcggggcgccccctgcctccactgcttggcctctgtttgtagcttgtgttttggccttgccagcaagtgtccttcagggaggtctggctactcacagtttatagatgagaacactgaggcagagcgataattaactcgacaagagaaaacaaccagcaaatggccctcttgtcccagagcccacgttcttcaccagaacactgcctagtttaagaaacagcagcaattctgtttcttataaactcatgagcttcccaaagacaggctctcatccggtcaggcatcatgggtggatcatcaagcaaacagatgccaacagacattccctcccaagttattccttttaatcctgtcctttgtcagatgcaaaaggcctaattcaatactggaattcctctatatccattatcaggtcacctggatagcctgtcctaaaagaatgaagtccctccttgccacaacaataagctttgtcttttttcccccccataggtcagcttccttcttttatattctgctacaatctgttgttgtggttaattacacaagagactagcatgggtgtgtcaatccctagtggaactgcgttgagaatctgcaaaccagaccatatattatggggcttccaaattttcaagtgccacagaatcgcaagcttctgatcactgcattaaggatctagacctgtggttcagatgagagatgagcttcataaagaagtatgttgccagtgagaccccactaggttgaagattgcaggaagctgagatgcttaaattattctaattaatgggcttattccccactggttatgcacagcagattgaatggacagttgcaggtgcaaactgagaggtaaacagacctttaaataagtaaagagccagggagcactagctggggaagcacaggtttcagaatgaattattaaagcctgcactgatccacagtcgagggtatgactgatttctaagtgaagacatcttatcctgaatgctgctactttaaggtaaaaatagactcattcttcccctgactctctttctccatcattggtgcaaaatgaaacagctccgttggtttgtaattgatgtatctgacactaaaatttcattctatgtacttccatcctctgaaatgcacagtaagggaagaagatcatcttgacaggtaaaatagtaggttttgacacaaagtcattgagatatatgtgatggagaattttctactgagacaaaatgcagttctatttgaaagtttactacacatttcaactttcactttgaagaaacactttcagataaataaataaatacgcaatgattaaaagaggaaattggctttgtttttttgagaactaccccgtagagtaaagcatacctttttatatttactcttttttataaaactattgattgaaaaatatgaaaaggtagaaggtgcttagaattcctagcacataatacgtgctcaatttattgatgtgaattatatttacacataaatatacagacaaaccagaatatataaatataaagggatataatcactccaacaccatgaattccaccttaattttcctctccttgacaaactactgattaaatgtaaaaagttgctctttaatctagataacacgttttgtatgcatttaagaaacatttactgagcacctgctttacatcagcatagttctcagtacagatagagcaatgaacaagatacaccaggtccttattccaatggagcttaattctacccagcgtgagatatgcagtaccgagaagtaaataaatgagaagatattttcagataatgttcatgatgtggcgacaataaaacagaatacaccacgagcgtgtggaagaagagctactttagagggaatgaccaaggaaggcatctttgaggcagtcacattcaatggagtcctgaagaatgagagcgccaaccattaaaaaaggtttttctaaagtgctggggggaaagcacgtgtaatagccggagttaaattcactgctttcaacagaataccaaataaaatgatttacccacagaaagggtcccttttctcactggattcccacaatgccattagggagccaagctccttatacctttttctttgcccctcctggtgtgtagctcaccgggggctgctctactactgagcagtaactcagccttccagtgatgaagaatggggaaggctgaagggcagggtgtgtctagccagcctagtcagtcccttcctatccgcaaatagtaccttccccagaagccctgcccataagtgttcacttacatctgctctaaactgtcccacagatacagtaaagctaaggaagtttcttgcttttaactggcatgaatgggccttttgtagccccgaaaaaaaaaaaaattgaaactctgttagcaggaagaaagcaagaatgggcactggcctgtgataagccatgtctgctgaagcatcctaggcagggccatggcaagtgcgaagtcccttgtgggataataggtccagcttgtaaaacagaagaccagggtgtaggagtgcagggaacacgacggaagcacagcccaggaagactgtgagtgaaatgggagccaccggtactgagggctcgccaggtcctggagtggggggagtacttttttttttctccacaccacctcccagatgtggtcttgctatgctgcccaggctggtcttcaactactaggcccaagagatcttcctgcctcagcctcctgaggagctgggattacaggagtgcaccactttacctggtgatattacctttattttacaaataatgaagtaaactcagtaggttaagttgactcagctaaattcacagattaggaatgagaggagacacaattataacccagcttgatctgactcctaaattcatgcctgtaacccctgtactctgctgctgtcttcatatccctgctttaacaatatgcctctgagtatgagctgacagaatccattcttccaaatccattccggttattacctactgtcctattcactcacatttataggaagtgtttatttgttctaatattttcatttatttcaaagttctagatagagagaactctatgtctttctttgcctacctaatatgcatagaagaaaaaaatattaaaactgaaaatgactatcttcatctgatgctgaggtttggggtgaaaattcatattagtgggaaagcagatctctatactgctccttctcactctgagatacctggggagggagaaaagacaacactgaaatgtcaaagctcctgccagttcctcggtgctgaaacattaatgagcttctgaatgtgcaaaggtgggcccagagccgaaggatgtttgagagttaaattgctctgcataatcaaggaaaggtaattgagtttcccgaggaatcagagaatcaagaggtctaggagaagtgagaaaggcagggagctatgaaggtggctgctgtctaaccccacatgacgtctctcatgatttccacattaccagcaacactgttcccaaattcctgacacagagctatagcaagctctcacatgggggacagcagtgagtgaggattctgtgggtgactcctgtgggtaagcattggggaaatactttcagatcacatccaggataaaccattattttcaaatctgggaagattaaatagagatggtgaatgtaaaagaacctgtgggacctggcagagcaactctgatattctccagagcagcagcagacagaagctggggctgtttgcttactcctctcgccctgaacattaccaacatgcaggctgggactgtgagacaacgccatcagacaagcgagacgatgccatcagacaagacaggtgttccagcgattgctctaggtaagcctcattctctttgttcactggcagcaccaccccgctccaccctgcgcctcatttgcagagtcctctacaaatgaacatgcagcctgcctggcacacctggcacagctcacctgcatgccgccaagcatgacagactgtctttgctgtggttgtaaaggcctattttcccaagaggcttcttctccggggccctacagctttcagcgtgcacttcaaactcactgaggactgagtgacttacagttttctctgtgtgctaagctgttagattgtttccatctttacacaggctgttccctccatttcaggcatcctctcttccaggctgaacccgttttcatcagattatcttttaccagttcttcagaaagcaattcaggcctcgtttctccaggaagccttctctggcctccacctttgatttcgatggtctccttcatgttccccagcccccgtctatgcctccaccttggtatatcatgctctattgtaattattaatttacttttctttctccgcgaatagatgtacccacagagcctagcagtaaacctgcaacaaagtggtggtttgatcattcttatcaaatgtatggcttaaaagtattgttcttctaaaatgtaaaaagagaatcaaatacaggtctggccaatgacagtatatttcaaatgacaggcaggaacatgtcttcccaagtcctgatttttctttgaatgcacagctctgacttatctggcctctctccagaccttcatatgactcttctctagttaagccaatagcaggcttcaagccaaaaactcctagaagtaggagtttgccaggcaatagtgcatgtgtgttggttgcaagagggtaaaaaaaatattacaaagataacagcctgggtgcaagcttggagagtttcaggaacagaagaggacagcgtggcagagctgtgggttcagtaagtgaggtcaaagcgtgtggacgtgtacctggccggctaagcaacagtagtttcttggtgaatctatcagagaaggactactatacaacataagtcggtgggagcaatgtatctaaagtgagaatgagtgaagtaatgctatcccgcaatgaccactaattgaaatgccaacaactccaagttggctaagtgaaaagagagtcttacctcaattaccctaaaagaacattctagaactaggttaagctaacaggaataagcatatgtggagggtgtttctgggaaaagaagtctgtcagaggcaggcagaagtatcaattggaatgtgtctcagagacaacctaagttgacaccatataaataaatatttctgaagattgcagccaactgatctgaactctactgccacgtaaggcatattaattatttttaaactaatagaattggtgtgcatgttcttgaatcatttaaaattcttatctcctcaagaatctggaatttttgtttgtgttacccctaaatccaaatttcacaatgctgaggagtccatggttttcaggcatcattacaaaataaccagcacttcctaacagctggtggcagcaaaaatctgaaacttatatttctcagttacaatgcctacttaagaatcacctcaaacctttaagtacaatacaatgtgagggttactcagaggtacagagactagtggtatggtcaggatttcaaccgtaccatataacctgcataatgaacaactcagacttacctcacttgttactaaatatttgctttatgtaagggaaaattatcttcagccaaaatggtagagcacaaccaacttaatatatatcctaagtggcttagaggctaagtacataatcccttcagcagtagcctcaactacatttctcttattgtagctagctcttgcacatttaaccaccttcatctgtattgttaacttgaaattttaaatgtgcatattcccagaacgcatcaactaatttttatcattctttcatttgaaaatatccttggaacattaatggttgaagagataaaggataccatgttcctaagagaatttattgtgactcttacactcagtgactggttgtaactgggaaactcaaaaccacaactatatatgactataaaatgacaatgaaaatagtttattctatacttgtaggctgtttgacattttccagcttgccttgattttataaaaagaaatgaccttgaaaataattaagcatatcaaagggtaaggctgtagctcactgaaacacagcaatatgttcacgtctttataacactgctaagcattcatgaaatagcaagagattgtattgctctttaaccaagttctactttaattttataggcttatacatattcactacgaggccattctaatcttcacctacctgcattcttctgaacttgcaaataaaggcaatcaggactctacctgctagacttggaacagatcagattttgcaagaggcatcagggtctggttgattctttttttttccagcctgtgtttaatgagagtgctctcaataaaaacacaaattcagattaggtttctgtactcaatgtttattaatttagatactctttaaaagagcatgtaagcatcttgagaaataaatttagctactgtcactttataaaaggaacaagtgcaattaaaaaagaaacaggaaatcggcaatgatatggaaggaaagtgcttctgagacctggatgctatcagccccactgcatacaactgagtgtgctccctgcagtgttgcaaagggctcagagaaatcacaactggccaaatgttagaaccttccgcagagaaataatgacagaggaaagtcagaatctccaagaatggaagacctaatgctcggagatctgcagacatcttaataaaaggaatattcaggagggaaggtgccattttgacttagttcaagttctctgctgggtttcctcctctacccccaccctagcaagagtcaactcagaccacaaaatttaaattaaaacacaaaatgtttagctggtttctcccaacttgaaaaggggttgacctgggatcccaggtgagagaaaacgagctatataaaaataaggcttcttgggaggccaaggcaggcagattgcctgaggtcaggagttccagaccagactggccaatatggtgaaaccctgtctctactaaaaatacaaaaaaattagctgggcgtggtggcgggtgcctgtcccagctactcaggaggctgaggcaggagaatcacttgaacccgggaggcggaggttgcagtgagctgcgatcatgccactgcactccagcctgggcgacagagcgagactccgtctcaagaaataaataaataaatagataaataaataaataaataagacttctctcatgaggtgatggaatgccttagagatctgctatttccaaaccaccaggaccagccccagtgagccaaatccttaatgcttacatctttcctcttcctacaacacatggacgggggcatgtgagtaaccaaggaagccaggcccaaagagaaacttcctggtgccaggatcattttgggtgagccacttgttttttgctcatactggatacgtgtgccacgtgccaggcacacagtcctgaacaagactgataacgtctctgctctcatggagtttatgttcttgtgatgggtgacaaatggtaataatgaaagattttgggaagagtatcaatcatggaaaacatctatttatcagtccgttcatttacttaacataggctactgttgtgcaacaggtcccatgttggctgctggaagtatacaaaggtaactaaaacacaagctaactttgggagtcagccacacagagacggtgaatgaagctacaggaatcagtaaggtaacccacagacagtgtgcagagaacaaacaaggtggcgaaagaaccccaccgactgggaagacagtagtgcaggaagaaaactaggagagtatggtgtcaccgaagcccagggaaaagcgttcccgaaagggagcggtccacaggacacatgaagttagagtatccggaggattgagcaacatggagattgctgctcatcgcaactacagcagtttcaattgagttaaggacctgaacgccagactacagcggaggtgacaagaagtaagaaagtgaagactaaaaatgtaaataatttcagttgtaattgtgaaaggagagatgattcaaagataagtagaggaagaggtggagcaaaggcattacttctttttttcccctccctcgctttcttccttcctaagaggaagacaggcacatttaaaggctaaaaaaggtgaaaataattgagactagataactagtagagtgaggtccatcaaataataaaagagtgagctctagaaaacaggaaaagacatccttgcctttggggatttcgggacagaaagagggaggtttgctgatgctttcaggggtgaggagaggtgaagggttaaaagtcgtcgaaacaatcttccaccttatagcctcaggccaggaaaactcccaggcaagattgtgtgcagctgaagaggccaccatgtaccagtcacaggtttttaaggtgagcttagatgcaaatggtaaaagtgaataaaggtcggggagtggagaaggtggcttgtctgattattaaagttacttacagatatatatatctgttatatagatatatgaaatttttacaatgagacaataaagtaatatttgggtaagaaaaattcacacatttttaagtaaaaatgtccacttcccactctacattagggtgagaggaggccctggcaatgcagacaatgctgaatcaataatttcagtaacctaagagggctgtctagaagtaaatggatctacatgtgcacatctgaatgggagagatcaggaatgtaggtcaacaagggtcatcctcggtgacccacacccccattacctacaccagacaaactgctttgctgcactgtggactaggttcccctcccttttttaaaaaaaaaagaagaagaaaagcactatctgttttcttgcaactcctcaaggatttagtgcagtgtatgtgtcatgcttctgggcaacttggaaaataacctgagaacatcaaaggtctatactgaacgtgaaaaaccctctgggcacaggctgcaccaggccacacactgccacgttcccttcacagtcctaaagaaaaaaaggtacatgtttgtatagggttctttcagattctctcaccggaatcatttgctccagcatgcatgactgaaacctaccctgattaggaggaggataagatcatgctgcctgagcacacatgtaagtctggtaacaccctactcactgtgtgaaaaagcattttagctgttggcgtcaccaaaatgtaagccctttatttgctgagtgtctgctaaatcaacatacagccttcatattttgtctgttcccctgttaattcttaaaggctgttggttcctggagtctcggctggagtctgggaaccacgtcagtcattgtgcttgtccacacatgtaaagtgctcaagataatgtttgcctatcacagtgtttgtttaacttgctattggcccaataacatgcaaatatgtgctccataaaagctgcaactgactgtaatacctgagagctaggggccgcgggataacttagtcattattgttttttcttgaggtgaaacataaaattaactattttaagaacaattcagtaacattgagtgcattcacaatgataaacgaccaccaacctatccagctccaaaacatttgtatcactacagaggaaaactcgatacccactgaaggcagctgctctcgggtgccccttcccacaagccctagcgaccatcaatctgcactccgtctctatggattcatctactttgaacatttcatacaaacggaatcacagagcatgtggcgtcttgtgtctggctcccttcattaagcataatgtattccgggttcacccgtgctggagcatgtatgggtacttcattcatttgatggctgaatgatactcgattgtatggatagatcacaattggtgtattcattcaactaacaacgagcattttggctgttgctaccttttcactattgtaaatactaatactatttataatatatgtatgtgaaattaagtatcagttttccattcttttgtgtgtgtatatggcagtggaattcctgggtcatacatcaactttttaaggaagtggattccacagtggctaccacactgtacattcctatcagcaatgtacagggttccagtttcttcacatccttactattttccattttactgatcacggccatcctactacatttcattctattacatttaatagtaaatgtgaagtggcacctcattacggtttttttttctttttttttttttttgaagacggagtctcgctctgtggcccaggctggagtgcagtggcatgatctcagctcacggcaacctctgcctcccgggttcaagcgattctcctgcctcgacctcccgagtagctgggattataggcacaccccaccaggcctggctaatttttgtatttttaggagagacagggtttctccacgttggccaggctggtctcaaactcctgacctcaggtgatcttcccaccttggcctcccaaagtgctgggattacaggcgtgagccaccacgcccagcctcattgtggttttgatttgcatttccttaataactgatgatgaggagcatcttttcacgtgcttgtcggccatttgtatatcttctttggagaaaggtctattcaactcctttgctcttttatatttagggttatctgtcctttggtcatttttaagcaaggtactccaatattcttctctatgcatactcctttaaacagacaaaacgcaaaacagtgcggtggttaggaagctgtgctatgaaaccagactgcttgggtctgtcctgcaacttagtcactatgagaccttgacaaaattatctctctgagccaaaatatcttaagagtaaacctcgtggatatgtagtaaatattaaataatcaatgtaatatacatatcatggcatgtgacacatagaaaagctataaaatgtttcaaaagccaataaaagtatgcacaggtagcacgttcatgtaattacttgtgtacttccataaggatgggaaaaatgcacgaacctctcccagattcagccatgtaagggtagaaggaacttcagggaggaagtcacaggttttttgcctccatgttaagacaaaaatggccccataatgaaaagcactgtgcaaaatattaatttttaaatatctttttaacaacataggaaaggcattcttctacttttgcaaaggaggcagaaccaaaatctgtgaagaacctttggctatacagacactccacagggaccaaatctcctgccccatcacacattcctgggaattaaaaagaatggagaacgtttacaagctgctgtactttataattgttatttctttgaaatgattctttttctttgtgagaggaaaataaaccacagtatattgctgagaagtattaagactcattcctttctgcccacacacaaaaattcgttgcacccggaggaatcatgtcaagcagtccacctgcttgggtctaaaagtcatgtatattgttctgacaagtctaccttgctgccaatatgcttttgccgtctttagaaaggagtgtttagtaaaacaaatgatgcctatacagtgtccatgtacaaaggcccctgtgttccagttctatcccatacttgaaaaacaaaggctctttcagggtagggggttcaatatcacctgctatgtactctggtccaattaaatttcccatttgtaatacacaattttatacctataattctttctgtcattttacattgctttaatatgaaaagaagtctctgcttcacttgaattccttagagagcctggcttttctaaaagcttgtgtgtccgtccctacatccctcccacctacaccaaatttaaaccttgacagactaatacattggatagcaatccaggcagtctgcaaaagacagatgccaaggcccaggagtcacgggtaagctcacgtttatcttccacactgcaacgaatagataggatggaagaggtagtcagaaattagtaagccaagatgaaaaacgccaaagttaatttaacaaatatagagaaggaaaattggtcaaagtcagttacagggcaaaagactttctttcaaaaaaaaaaaaaaaaaaaaaaacctctaacaatatatgtgaaaagggcaaagcttaaaaagctggactatctaagaaacaaaataatgttcctggagtagcaaacagaagtcctgtttgctcttcttgggacaaatgctcttgcttgtcccagatcacaggtgaaaaaagatacttccaggcagaataacaatggatagcactgggagtctcaagtttgagttccagctctaaagatacagcaaggccgggtgcggtggctcgggcctgtaatcccagcattcggccaaggcaggcggatcaccttaggtcaggagtttgagaccagcctggccaacacggtgaaaccccatgtctactaaaactacaaaaattagcagggcattgtggcacaagcctataaccccagctacccgagaagctgaggcaggagaatcgcttgaacccaggaggtgaaggttgcagagagccaagattgtgccactgcactccagcctaggcaacagagcaagactctgccaaaaaaaaaaaaaagatacagcaagaaatcttcagtctaaaatgtacctataaactcatttttcacagattatggaaatatttttgattttcaagttttgataacaaaactagaatgtgttacagtttaattctgagtctgcatcgttcttggtttttgatcattatagaaaatacagaaaacacagaataaggaaaaaagagaatgtgacatagtacaacttaagaaaaaataatttgggtgttatttcctcactatcaaaaacaataattaaataatatatttttcattaacctaaaatgaagaatttaacacaatgattttctccccctcctagaaatatgctcaattaaaaatatcagaatagtgtgatatatattatgtatgaaatataatccaactaatactgcagcatggttagtttccatattactaaatatgcctcatggttgcatgtagcttccctttacatttatttataattcatttaaccactcccacactcattacttttttttttttttgctattaaaaaaaagtataattactgctttcaccaaacaaggattgctatgaataattttttcttaattttaatttttctttttttattggcctacttaggaattctactatgagtaatttttgactcgataaatatttctaaatttgcttgtctcaaaatataaatcaatttacacaaaaacggtagtaatacaagactgcctgtcttaaactctccctaagatttgggcattaacatttcttgttcatttttgtcaaatggcatttcactatttacctttcattcttccaaatgaacactaaaaaattacctggaaaactgctttcaagaaacgtagtcgagaaagactgacacgttataatgctcagtcttatcatctacaaacatactatgtctttccaagtaatcttctacatttcttaaagctcgtagacttcttattttcctgcactgtttgtgaccgctaaatactgtattttgcaaaacctttcagtttttttatatgcaaaattcatgttatttttcaaacaaccctctaattttttttaaaccagaagattattttctatggtttcatagtctacaaattactactttcagattatcaatttctgagtatactttgtttctttcagtacatgttatggttctctattctagttttctaagtggttttgatttctactttggtctaatagagtttctgtgctcccacgcattgggtgaggtagaaccaatgctgtctgtgtacaatcaagaattgattttggtaaacgtttcaaagataactgaaaaaaaggtatatttcttttataaaagatatcaagtttatcctatcaattgttttttatcttaaattatttttatatgacattaatataatccctcctttctttgaatttctctgattcacctttgcatatccttttgctttaaatcataacattttagatcattctttttccagagggatgggggtagggagtgccggtgtcatcactggaaaagagcttacacctgagagtactggagtcatgtcttcttaacagagacacctgccaagaaattcattgttaggtgattttgtccttgtgtcaacatcatagacacactaacgcaaacctagatgagacagtctactacacacctgggctacatgatattgcctattgctcctaggctacaaacctgtacagtatgttcttgtactgaatactataggcagttgtaatacaatggtaggtatttatgtatctacacttatctaaacatagaagaggtacaataaaaatacagtataaggttgggcatggtggctcatgcctatgattccaatgctttgggaggccaaggtgggggaattgcttgaggccgggagtttgagaccagactgggcaacatagcaagacctcaactctagaaaaacttaaaaaattaacccagcatgttggcaaacatctgtaatcatagctactcagcaggctgaggcaagagaattgcttgagcccaggagttcgaggctacagtgagccaagatcacatcactgcattccatcctgggtgacagactatgactttatctcatgaaggaaaagaaagttatgaaagataaaaatggtatacctatgtagagcactgaccatgaatggagcttgcaggactacaagttgctctccgtgaatgagcgagtggcaggtgaatgtgaaggcctagaacactcactgtactctactgtagactatccacactgcacgcttaggctacacaggcctagaacactcactgttctctactgtagactttatcaacaccacacacttaggctacacaggcctagaacactcactgttctctactgcagactatccacactgtacgcttaggctacacaggcctagaacactcactgtactctactgtagactttatcaacactgcacacttaggctacacaggcctagaacactcactgtactgtagactttatcaacactacacacttaggctacacaggcctagaacactcactgttctctactgcagactatccacactgtatgcttaggctacacaggcctagaacactcactgttctctactgtagactttatcaacactgcacacttaggctacacaggcctagaacactcactgtactctactgtagactttatcaacactacacacttaggctacacaggcctagaacactcactgtactctactgtagactttatcaacactacacacttaggctacacaggcctagaacactcactgttctctactgcagactatccacactgtacgcttaggctacacaggcctagaacactcactgtactctactgtagactttatcaacactgtacacttaggctacacaggcctagaacactcactgtactctactgtagactttatcaacactacacacttaggctacacaggcctagaacactcactgtactgtactgtagactttatcaacactacacacttatgctacacaggcctagaacactcactgtactctactgtagactttatcaacactgtacgcttaggctacacaggcctagaacactcactgtactctactgtagactttatcaacaccgcacacttaggctacacaggcctagaacactcactgtactctactgtagactttatcaacactacacacttaggctacacaggcctagaacactcactgttctctactgcagactatccacactgtacgcttaggctacacaggcctagaacactcactgtactctactgtagacttcatcaacactacacacttaggctacaccggcctagaacactcactgtactctactgtagactttatcaacactacacacttaggctacacaggcctagaacactcactgtattctactctagactttatcaacgctgtacacttaggctacactacatttattaaaaatctttttctttcttcagtaataaattaagcttagcttactgtaactttttactttataaactttttttaaccttttgactcttgtaataatacttaccttaaaacactaacacattgttcagctgtatgaaaacatttccttttttataaccttattctataagctttgaactatttttaaattttttttactttttaaactttttgttaaaaacgacgacacaaacacacacattagtctatgcctacacagggtcggggtcatgaatagcactgtcttccacctccatatcagatctcactggaaagtattcagggtcaataaaggcatggagctgtcagctcttatgataacaatgccttctctggaatacctcctaaaggaactacctgaggctgtttacagttaattttttaatgctttttttttctgagacagggtcttgctttcctgccctggctgaagtgcagtagcgggatcatagctcacataaacctcaaactcctgggctcaagctatcctcccacctcggcctcctgagtacccaggactacaggtgcgtgtcaccacacctgactattttttatttttatttttgcagacacagggtctcattatgctactcagattggtctcaaactccttatgtcaagcaatccttctacctcaggctcccaaagggctgggactacaggcatgagccactgcatctggccaactttattttttttaataagtagaaggagtgtgctctaaggataaaagtataatatagtaaatatataaacgagcaacacagtcatttcttatcactatcaagtattatatatggcacagaattacatgtgctacactttgatagaactggcagtaccgtagggtttttaataccaggttcaccacaaacacgagtaatgtgttgtctgtggagttatgacaggtggtagaaagttccccgctctattataatattatgggaccagcattgtatacacagtccatccttaaccaaaacatcattatgctgccatgacaacatttgtttggttttcttgtttgttgtttgtttttaagaccaggtctggccctgtcgcccaggttggagtgcagtggcacaattaaagcccactgcagcctctgcctcccaggctcaagaaattctcctacctcagcctcttgagtagctgggactacaggcacatgccaccacgcctgactaatttttgtatttttagtagagatggggtttcactatgttggccaggctggtctcaaactcctgagttcaggtgaccctcccgccttggcctcccaaaatgctggaattacaggtacacaccgctgcatgactacatttgtttcttaacagtggatctattccaggagagtggagtctcaacaattactaattattagttataatatatctgcctttcttcttcacactttcatctggtaagcacctgataaactgaaataacgtttgctctgatcaccagtcgatgaatctctgctgcttttagaaatatctaaaatattacaatactttctaaggtcatgaaaatcttttaggtattaatgagagtgtgggttacatgaatatgcatttatctatactcaaatatcatcaaattatatccttaaatatacacattttatcatttatacaatacacctcaaagttcagaaattattgggggaaaaactaagtatagctcaaggagtaactgcgcctgtgccctatgtagaaaacgcactggtgatacagacaaacattcatttatttacaaaatcgtatttgagtagaaaatattgtgtcatcgtattttgtaacatggtaaatatccctttatattgcaccaaaaattagagtcaggcttcaagatgatttttacataccttattataataaacttagtattatccaactgataggagataaaacaaaaagcaccactgggagaggtttacaattcaggtaaaataaatgctttgttctttgagatctggagtaataactgtctgcttattaaacaaaaaggttattttttcctatgcataacctttacagtacagaagtactccagacttgaaaatccctctaccacctgaggattaaaacactttaaatattcaaatctaacttcttaagtttgaactatactttccatcacagatctggaagtagtctgtgaactatcgaggaagacagggccattcacagggtggtcattcactcaatttggggaaacagagtatcttctaatctgttaggattttgctgaatgacatttgctaggggaaagttttaaacatttattgccgacactccaggaaaatagagggtaatttactggcatgtgtgattgtcaagtgggagaatatgtcaatcacctaattatcattattcattaaggagggctttcaaatacattgtaaatgaaacatgtgtaaagtagccatgaattccaagtatattatactgtgcagacacagaataaaaacttttttcaaaatacataatttacttgaaggagtttcctttcttaaatacattctctatgaaaagcaatttgtactgactcaagttaccacatcttccatggtccttttagaagagatatttattcaaaagcagaaagataatggaaaccaagtgttttactctaagctaatgttacacaaaatcactaagataattttttatttcgttccagtactctcctttccattgagtcctccaggcctcaacccaaaccccctcaccagtaaccacaaaataataattcttttttatctgctacttagtctcagaaacaaactgtggagtcccaaaatcaggtcagctgacaaaattagccttcctcaactacacccataagtaccagtggatccaggccattcctacatccattcaccactgtccggctcttaagaaggactatatttagctcttcagagcccttggcagaaagagataaacattaaaaaacaaaacattattttgaactgaattgataccgtaacaaaaaagtaacatttgactctttaaaacattggaaaacacttacatggtctgaccctcagcaacacgaaaacatattcgaagcaatgagattaatgcttatataggcttttgtttgttttgagacaaggtcttgctgtggcccagactggaatgcagtggcgcaagatcacagctcactgcagccttgacctcccgggctcaggcaactctcctaccacagcctcctgagtagctgggcccacaggtgcgtgccaacatgcctggcaaattactgtattttttgcagagacagggttttgccatgttgtccaggctggtctgaaactcctgagctcaagcaacctgctcacctcggcctcccaaagtgttgggattacagatgtgagccaccacaccagcctatactggccgtttgttaatggcactggtaatattggctcttccccttagacggctcatgaggctagccactcttgaactaaaagaatgcacgtataacatacaaacataatgtctgaatccccaaactatagactttaacccaaattggtgaaacacaaaggaaaaggaaaagaaactttaaattgtttttaggcctgctgtttggatattacaggaaccactgtgatttatatttggcctgagggtataaagatctatgattttatttatggcttggttaaatcttttcaaaacacaagagccacctattcataatattaagaaatcaggtgatttaaaccttactacactctgctaatatactgttctcttcagtagaaacatgtaggagtatgttagggacaatctctcaattatgagcaaatttacaacttcaatgctgtcttcttaaattacatgccatcacttacaatccaaacatcatttaagagtttataagtttaaaaggaggacaaaacaaaaacctttaacaactcattattatttaagccagagttgcaccaagttaccccttcaattgtctaaataaattctagacatggcagcctactgaataaataaaagcaattgataatcccactctatagaaaagcaaaaaagcacaaacataaaatcaagagaccacaccgaagtagcatcatggagaagaataaacattttcaggacagaaaatgtttaagaagaacagcaaaaaagaacaaaggtaggtatattaaatgagcaaggaaggagtggaactgttgaaaggtggggtctaaaaaggctgtgacctgctttctaagtaaagcctagtccaaaaatgtcttgtgaccagatcaatttccattccttctcgaaagatggaagacataagcaaaacacatagagctatgaggacagagtggataatgattagtacatagaaaagttgctacttcgaaggattcagatattaagtagagcaattaaagaatttctccaatgacatcaatctcaaccagacggatgttctcaacatttcgcctagcaactcccccaggccatccttacagcaggcttagggaggtgctactctcttggttcctgctttcaaaaagggtgctgcctccatttagtgatgtttataaaaatggcagtggtttcctatttgaatgttaattattgttatgacacacaaggtaatttaacttgctttggtaatttattcacccttctaattagatgtagttactggaaaatcttccagagtgtagcaacagttccaaaggtgaaatggcaggaggagggagctttcccataggatcgcaactgtaaatctgggatggatgttcaattgccagtcacctgaatgaacaatgccagggatcagagacggtccttctggaatcaagcaggtggcacccatcaccttcaagaatttgatgattcaagaggaaggtaaagccccaaaagatggttggagctactctgaaaagattaaagactgaacttgaatgaaccaaggaacaataccacacaacaccattttaaatctcctagaccgggagtcatttacatacagttgagaaatgccgtagacagagtataagccaaaaacaccactgaagtgggagaggctccactcgagttacttgctttgtggaagtattttcacgcttgccacatcatacctgctcgatcaatatttactgaaacaagcaaatgaatgaatggacaagtgcatgcatggctacagcataaaaacaggcacacccactccatctctctcattacggcctcctcagcaagcagaccttttttcttaatttgaaggtccccaaagtgagcgagtttcaatcaacagaaatttctttgtctttaattaaactgagctgccactgcttcttctgtgaggtctaagtgccagcctgtagccatgttctacgctagccagaagggaaagactgaatcatatttgtgaccaaaaaaaaaaacccattagactccaatcaatgcagagcaggtggctgatgactgcagcgatccctatgaggagcacggattgatactgccaaatgaacacattaactgaaactacccaggccttaggggaatggccagaggcccctgtagggaacagtttaagtcaaacttttcctgcttccattgtaggatggaggattcaagggctcagattatataaacaagttcaaggccatgcaagaatgtatacagaaatactcaaacctctaaccccaacaggaagaggaagaggaggaggaggagaagtagccagcagaacaagtggaagaaacagcttccagtgaggtcactgcacccaaagaagaggagcagtcaagctaacgaaagccacatggcactgggctccagtccttccacttcagagtgatatggaccttcgcaaaaggcctttcaattgccctccaagaaagcgtctttccctctgttgtcctcttcactgtaatgcacaaaataatttattttggtgatgaggggtcctgatctcttgacatacagactgaaaaaatgggggttgtatgtgtgtcctacatataaatctgtcagcaaatattgccaccactgaattctattttctcagattgccctcaattttgccactctgaaataatgtgctgaataatctcagcaaccagaaatcatcatccaggaatgtttcttatgagacagctgatttattcggattcactagatcccttttagtagatttaatccccctttgggaaatgtaatagcaagaaaaacatcttttaaaagtgctggagtgaggccacttctcctagaagaagccagatggtcagatatatatttctcaaaacccatcttaaccttgagtatatgaagggatactacatttcattcctgataaattttggtttccatgttggcattgagctccaggctttctatgtgttgatagcggagatttggaccctccatccacagtctctttctaagtgaaggggaagattggtttttgctgttccttgttattccaaaagctctggtctggggcccatgttcaccctggctctcagtctggtcagatgcaatgttcttcaaaggtggggacctacttgttatcagagtagcagccaaaagaggaaaaggtgtgaattaagtactcagttaaaaggaaacatgagaccaggtgtggtggctcatgccaataaccccagcactttgggaggtcaaggcaggaggatcacttgagccacagagttcaagaccaccctgggcaatatagcaagatcccatatctaatatatctaatatagatatattagaaaatatatatctacatatagtagaaaaatatatatacacatatattagaaaatatatatacatatatgtatattagaaaacataatctctctctatatatatgtgtatatataaactacttatatatatataagtatatatataaactacttatatatataagtatatatataaactacttatatatatataagtatatatataaactacctattctatcttataccttccactcaaggtcatgaagatttgattttggagactgatgcaaatgtttgccacctgattttaaaactcaggagggttaggccgggtgtggtggttcatgcctgtaatcccagcactttaggaggccgaggcaggtggatcatgaagtcaggagatcaagaccatcctggttaacatggtgaaactccatctctactaaaaatacaaaaaaagttagctgggagtggtggtggatgcctgtagtcccagctacttgagaggctaacgcaggagaacagcttgaacctgggaggcagtgcttgcagtgagctgagatcgcaccaccacactccaagcctgggcaacagagcaagactctgtctcaaaaaaaaaaaaaaaaaaaaaaaaaaaaaaaaaaaaaacaactcaggagggcagaagagaatgggtaatcactatacctagtttccagcaagagattcctccctttagaaacactccccagaactgacagaaacagagaaagaggcgtaaggagccataaagagatgtgacgtgctttaaaagcaacaaaatatcagggaggaacatactctactctaatatgtccatcataggggttctatttgtttcctacagataaagtgatcatttaactatgaaaattactatcattcatctctccacatgcattcccatccttgagaagtggtaggaaccatgcgcctctgggatgtggaaacaagtgctcttgtgaacagaggtttcattccactgagagaaatggccatgcaaagcagtgtctcaagagagcaaggcaaatcaatgtctcgcctagagtatattttacaaatttctaatacaaatgattgcactgaaggacaaaggttttcctgtactcttcctccatccaaccttcaaacagatacactagtctcagctctagtggaagtaggaggcatccttgacattatactcagctgtgatgtaaggaatctgtgtacttacaaaactaatgcaaagcatttcaggctgtcagctgacatccctgccactccccacagctgagactattcagtaatggcagtacatctgacatcctgtctgacatctagaggactcaggaaattcaaagaaaatactataaattctatcatttcatgattcacacttcatgcaaccaaagatctcctctacacaaaaacacaggaaatgtcagaataccccataggtatgtgatttttcttaacttgtatggttttatttataagaaataaattcagttactgaattatgaaacagacacataggggtcccctttgggatctagtccttaagatgcgttcaagaggatgaaggatgtccatctctgagatatattagtacttctacaacccgtgtgccaagcaccagtgggctaacatatcctccagatacatagacacaacttaaagcagagaagccaggtagagagatttgaaaaatgaattctaacactagcatactaaattcccaaataaattgtttaattacattgtacctacatttccccaatgatcacgtagagataattacctttgcttatttcacagggggcatttgtaataataaaaagaattatttgaaatcttcaaagaaagagcactattttaacctacttatataaggaacagaaagagaaaattgagttaacagtcttaaattctgccaaattaatctaatttttaaaaagagagaccaagtaaaacctcaccactgttgttctcatcgtaactgaaatccagcacattaaagagagagagaaagagatcaacttttaaaacttgtaaaactccatccctggtggccacaaacactcttatcagttccccactgaaaacccctcctcgccatctcccttccttcccctttctcctattacctcagccttcactccacttaatcttcccatctctcgacttctctatcacctcttcctccctgatagttatgacctcactcccactgtcacacatagaactgatccaaaggggacctaagaattattctaaccaatctcccacacagtaaaaaggacaactggagactgaagtgataacgtcacaggctcagggtcaggtagccactttcatgcaaagctgggtcctcacctagatatatgactcccagtacagtactctttccagtaccccacacaacagtctacctggacctgttcaccagccttatccaagagatccatttctgaaacagttaggtgcactttgttgttcttccaccatataaagcactttgagtcacaattagaaaaataaaactgatgacagcaatcagattagaatcctgtatctggaagacacctttacccataatccatcttatccaggaagtaagactcaggaggccatttccacaatgcctctcctccccagacactcattcctatgttcaacatcacttccattgctcaaacctaaatccttcctaatgatgatactgaagcaaaatcacaataccaggttttccagacccggctgagaagacactaactgagcccctaagtacaaatgagcatacttaacatagagaagacacagttagcacattgctaaatttctccacacccttatttttagcagattaaataattgtaacccctttaactttatcttctaagtctatttttggcttttatctaaggcccctttaaattctccatgttgcttttggaaagctagagtccagaaccaaggacaggtagctaaagtgtttcacataagagaaactccatcaacaaaagtattgcgaagtctgtacaagcccagggcaatcaatgaaatctgcatgtaaacgaggcagttttccagacaatacttttcaattagactaacttacaaacttgaggaataacgagaaactacaaagaaaacatcaactgcgtcttcaaagcattttcaagcacaaaccctaatacagtttactggatgccatttaattgggcagctctaagcatgtagctaaatacaagaaggttggcataagagataaaaaagcaaacaatgtccaagctacatcacttaaatactgtcagaacaaggttaagaagaagcaaggtgagaaatcagggaaaatgcaaataagaattccatttcctacaagataaagaaagataaataaaaatcctgactagctaggggagtatgtccagcaccaaaaaaaaaaagtaattatttcatgtgtggtcctgatataaagtcttgaaaataataaggctgctaaattgcaaatatcagggaagtgaagtagtagctcaaaagattatgaaaattgagatttccaaactgaatttgaaaaggaaacaggtaaaatgaggtcaggacattacagatgagaaagaagcttctactatttggctggctgttttaaattaataacctggaacattagcaggtttaaagtcctataaaaatgacacggagggagaagtaaatgcggtagaaacagcagtgtttacaccttcatcatagaaaggtattactaaaaggatttacaaggtggtaacaggatacatatcaaagtcaaagcgctttaataaatgatgagaaaagacattaggcatggaagtaaagccgaagggcttgaaataactccacctatccacgtcccagattattttaaaccaagtaagccactccaagatccacaaaagatcaggttgtatttttccctaagtggcagtattcccatgagcaccaaagcagtaaaggcagtaggtagaaaaaccaggagttaaaagaatataaaacactagtcctttctgggatattgttacacatgctgaaagaatctaaatatatatatcatgacccaaagaggtctcaggcttaaaatccaaaaagaaagaaaagcaagtatattgcccttttttcctattgggaaaaccttgtaaccactgaaaaattagaacagataaataggaatgggtcagtataattagtatcttctaattatagaagcacccagattggcatcaaactcaccaactcttggctgtcttcaacaatgaccaggcctcctctggggagactacttcttgccatcctcaatctgtacctcagatgtgtgacttcttgcttctaacaatatcacagattatggactaaatgtttgtgtcctcccaaaattcttacgttgcagccctaaccctctgattctatttggagaaggggcttctcagacagtaattaaggttaaatgaggtcatacaggtggggacctgacacaataggattagtgtcctcacaggtagagaccagagagctcattgacctgctcccttcctccctgtgtgcttgcatgaggaagggccatgtgaggacttagcaaggaggcaccatctgcaagccaggaagagagacctcaccagaaacctagtgggccagaaccttgtcttaggcttctagtgttgagaactgtgaggaattataaatttctgttttttaagccacccagtctgtggagttttgttacagtaccctgaggtggctcagacatacctaccacattgatgcttaatagtgactacccaaacagcaggaataaaagtttcaatttgtttcttacatttcctaatgcaatgctctgtaaggctagatgttttagaaatgctttttgaacttaataatggttttaaaaagtcacagacttcaataacagccatcattttctataagcactaatggtgttatatgccaagaatttttaaaggcaaataaatttttcttcttatctaaaaagctgcctggagaatgctcacccttcctttactcactactgaaaactgtcaatagcaattcaagtaatataattccttttttttggaggcagagtcttgctctatcccccaggctggagtgcagtggcgcgatctcggctactgcaacctccgcctcccgggttcaagcgattctcctgcctcattctcctgagtagctgggactgcaggtgcccgccaacacgcccggctaatttttgtacttttagtagagacagggttttgccatgttagtgattctttttttttttttttttttttttgagacggagttttgctctgtcgcccaggctggagtgtggagtgcagtggcgcgatctcggctcactgcaagctccgcctcccgggttcaagccattctcctgcctcagcctcacgagtagctgaaactacaggcgcccgccaccacgcccggctaattttttgtatgtttagtagacatggggtttcaccatgttagccaggatggtctcgatctcctgatttcgtgatcacccgcctcggcctcccaaagtgctgggattacaggcatgagccaccgtgcctggctggtaattccttttcaagaattacaaacaccaaagtatcttgtacaatggtaatttatgtgcacacgtatgctaaaaatgccaaaaagaacttacacaatttttacatacataacatactttagttccttgattctatgccaattcacctaaatattaacaaacttaggacagtggaccttgggcttacagaatattaaattgtagaataacagaatcataaaatcatagaatcacagactagaggtttgtctcggtcaaatctcaccattttttttaaatgaggaaaaccagagctcagtaccttgctcaaagtaacataaatagttcccttaattcccagaattgtggttttttactgtattgttaagaaataattttctgtaaagcaaaataatgattctcaaaattaataaaacacatataaaagatttaactcactagaaaatgagtaagatgctaagtctgatttttaaaagaattcaaagaagacacaaatacataagcatcagaaatgccagcaagatgtaaaatgtgcaaaactagtcaatatgcataggaaaataatctattgcattctccaaacacaactgcattttatggacaagaaccaggcgctttactgtctattttctgcagcacacacaattctagtacagctcaaagacagtgaaaggcagagctgacctgatggttgagtagacaaaacatgctcttttttttttaatcatttcaaagtctttcctcacagtcccttaccatgcacaagtactctgaaaccagagaacagcacggtgggtgaattcaaaaaacagaatttagaattcttgtttaattgctaactttctgaaagccctcagaaaaagacccaagttcatttcatatcagccccaaaactaagagacaatgaaaacttgacctgtgagagtctggcactgtcaatgtccacagcacttctctcaaaatgatccctctgaatacttacaataatcccaccagggcaaaaggttcacaacagcagttcctcagccaagtcgtgggaaaggctgtatcacattccggtcttctgcttcccagtctcacactctccccacatcacaggcacagttacctcgcaggagaatgtctctgaagccccttagagtcattatgcaagaggtctcacggaacaacttttcgctgtgactgaagagatgaaatgtaaaatgaggaaacacgaaagaagaaatggtctgctacacaaacatacaaagtaggtgtgatgtgctagataacgaggtgatgtgctgatggagctcaactctgaccccagttccacagctccagtcaaaagatctgcgtttaagaaaggagaaacaaggtggctcatgcctgtaatcccagcactttggtgcggtggcgcacgcctatattcccagctactcgggaggctgaggcaggagaatggtgtgaacccggaggcagagcctgcattgagcagagatcgtgccactgcactccagcctaggcaacagagtgagactctgtctcaaaaaaaaaaaaaagaaaagaaaagaaaggagaaacaaataggaatgaagagtggaaaagatatcaaataaggacccaaaagcactctgagaaaacaataaggttcttatgtcctgtgttcaggcaaagaaacacaagacatagacatgaagagaacagaaagcaaggaataatgtttaaaactaatttggcacaattttttttcttttaaaatgctcaagaggatcattgcagaaaacacagtggtaaagcaagctgctgagggatttttcaatagctccactgtgaaaaaacaagcacatcttaaaactacaagctttgaaacttttaaatttcttaattaaaatatttctagattccgttcatttctaagcaagactgcagccctaaagagaccagtaaatttttattcatcttttttgaaacaaacatgattaacaagtcattgtttgaatagaaaactatgaattaaacaaacaagcaaacaaccccacaataatggaacccattccttggagataatgacaatgcaaagtacaagaaacccattttgaagcattagtttcatgtgagcacttgttgacggaaatattacaagaagtccccctaagaacagttctcttcattgtcgtatcaatggtcttggtggctcacattcctcacgtgcactgagggccgtcttgataaaaagtatctagtagacctcttggtgtcaagttgtaaagctcgaacttgttttgggatttttaagaatgtataataaatatcgatttattaatttacaataaaaaaactaatgggtgaaaggactggacactcagcctctgaccttcatgttttctccctgcataggaagtcaaactactatcagaatgttgtcgtgtctggcactacagcaagagcaatgagttgcacaaaccatgaagcaaacagactgttcattcatccagcacgtcctggcctagagctagaaatacagcagcgaacaggagcgatcagagtccagattggactctgaaaagaggatctccttgccccaggagctgtgcagtatggccccagttctagctttctctggcctagacaatgcctaatggagccctgcaaagattcacttcactgacttttttaaaaatatttttatataacataaaattttcactttaaccattttaagtgtacacttcaatggcattaaattcaaaatgttgtgtaaccatgaccactatttccaaaagatttttgtcatcccaaacagaaactctgaacaagtttgctttttaaaagtggcacaagttactaacatttgtggttgacatttttttttttaatatctatgttaagaactcgattataggcctacccataatatgcttctttaagaggtctggggccaggcgtggtggctcatgcctgtaatcccaacactttggggggccaaagtgggtggattgcttgaactcaggagtttgagatcagcctgggcaacatggtgagaccctatcgctactaaaaacacaaaaaagagccaggcatggtggtgcacatttgtggtcccagctactcgggaggctagtgaggaggatcactggagcctgcagggcaaaagctgcaatgagccaagatcgcaccactgcactccagcctgcgtgacagagcaagaccctgtctcaaaaaaaaaaaaaaaggtctgtatgtttcattagccattgtgtgtgtttatgttaaaaatatgaagtgtttcacaaatttgcatgtcacccttgtacaggagccatactaatcttctctgtctcattctaattttttagtatatgtgctgctgaagcacgaactagccattgggttttgattttataactgttttccagaaggcaaacttctaacttcttaaagagaaaggtaccttgttgccatgtcctccctcccaccccactacacagaggcgctttcttctacaatgcacactatttcatccaactcttacaaatatctaaagagatgctatcatcagctttttagacataaggaagctgagactcacaggaatgatatttctcaaagctactcaggaagcaagggaacaacgcaagtgtcggtaacagttattccatattggagcatgactgactggatgaatatatgtttgtttttgctatacagctaacattaactggttctaagactgaatactgtattaaatttgttattaaaatacatactcctataacaagaagggacatataagacaaaataggaaagatgaaaaggttttaaagacacaggagaggctaaagaagtgatttttaatggatatactctgggagaaattctcaactatttccctacaaatgggtgacattagtcacttagggtggctgccttttttctgaaagctatcagacatctccatgggcaaaataaagaaagagaccccctacggtttatttatgtacgtatcatggtagcactccgtggttttaagacatattgaaactccatcatatgctgcttttaaagcccaaataactaaaataaaaactcccaggcacagcaacggcaaaatactgtcatttgtatgtgcttaggagacacgtgtctctaaaagcaacatgtacatttctcttttcaagcaaatgtttaaagaactggcaccgtaacaaacaaggggaaatatggagatcagttttaaaggcaggatttgtttttgtggagtctaatttatttcaagaaatccagattattaaattcacctcctatctgaggaaggatctcaaaggaaaggtaatacaggctagtcgtccttaaatgcccaagtccaaaagactagtatttaagacccaagtttatcacttactaagtgtcagaccttggccatgttacataatcgctctcaatctgtttcctcaaaataatactgcttaacaaaggattaagtaaaatggtgcgtataaagcaccacacacagaccgtagcgtatacttaagagttttatttcagcattagaaagcatgggaggccgggcgcggtggctcacgcctgtaatcccaacactctgggaggccaaggagggtggatcacaaggtcaggagttcgagaccagtctggccaatatggtgaaaccccgtctctactaagaatacaaaaattagccaggcgtggtggcaggcacctgtagtcccagctactcgggaggctgaggcaggagaatcgcttgaacccgggaggcagaggttgcagtgggccaagatcgtgccattgcactccaacctaggtgacagagtaagactctgtctcaaaaaaaaaaaaaaaaaaaaaaaaggaagcatgggaagtaggggagtcgctaaagctcactgatttaaattactactcaattagactaaattttttaaaaatcatgattttctttgtccccctccccaactcacacacaaaaagccaacactatactaaataatagaagatagtcgaggtcaagattttcaccttgttctccagctatcattttttccctcccgacttctattttggattaaggtatttcaggggccccaacatcaaagtagaacagaagaaggaaagcaagagaaaatgagaggtaggaactagaaaagccagtatcagaaaagcatacagcacttcctcactatactagcaaagcttaccatgcaatattcaacaggtaaatcctgatggatggctgacaccgggttcaagacactagtccacatgctccacatactgaataccctaaggtagttcagagagaaactgaggggaagacggagaaaacgcacctcacggtgcattctgtatgtcactgccttacacgcaggagtttcaatgttttggtaccaattaaagaccaactatcagttctccatggaagcagcaaaatataaaagtatccttgaaatcagtacagggcccttctgcgagggtctggtgatgtggttttgagattctttgttttggatcattcctcgtttggtggacccacaaataatggtcctgcctagaaccatcaccgcaagctagagtgaaaaaatgccagaagactaggctggtgggtaaaaaaattcaacgtttttcctcatgattaaccttgggtggccttgacaagttatgtaaggttttgtttcttcagaaagacactgcatttttagaacatctctaggcacaaaaattagtcatgtaactgaaagacaagaaaattttaagcatatattataaataaatgtgaatattaggggtgtgtatccaaacacatgaatagctcttaaaagaataagacaaaaagatcaaacatatttgaaatcagagagatgtcttttgggaactgaactcttgccatgagcaggagaaaaccagaaaggtcttcatgggttctggtacctgttcaaccattaattcatgatgtgtcgctggaaaaagatcacaaatgtcttcaagcttcattttccctatctgtatctgcccaagatctcactggattctcgaagaatcaaatatgataacacagtcattcctgaagtatggccacggaccaacagcatcagtaagtcaggaacttgttcaaatgcagttgagtcccacccagtcctaataaatgagaaacttcagcaatcggttattctgatgcaccttgaagtttgagaaccactgcacaaaaacagatacaatctgaaacatctgaaaacactggagtgttgttattacggaaaaaattaagaatcatacattgaagatcttaagaactttcacttaaaagttggatacagaagaggctatgtgtggcttttgttgttgtttttgttgctgttgttgaaacaaggtgtcactctgtcacccaggctggagtgcagtggtattattatagctcactgtagccttgaatacctgagctcaagcgatcctccttcctcagcctcccaagcagctggaaccacaggcatgtgccatcatgctcagctattttttattttatttacttatttacttttttaatttataagaaaagaggtttaattgaagaaattggcaaaaagaaaggggctacagaactcctgcaactttggaacccagcagggcagttgttaaatgttaaagctccaaaataacctggctcatttttaatttttcttttgtagtgatgaagtcttgctgtgttgcccaggctggtgtcgaactcctgggccgaagcgatcctcctacctcagcctcccaaagtgctggaattacaggcgtgagccactgtgcctaacctatgtgtggcttttttaaagccaagattcgcagttaatgtaaatgctacaataaaataaaatccaaaattacggtacctatcaatgttaaaatgcagtattatttccttataactttaaaagggttaagggaaaagaaataaaattagtaatgattgtaatgattacatattctttaaagagtaaatatgagactaaatgtatctcaatccaactattaataaaaaaagagtgaacttgagattagctctctctagggaaaaaggagaacagtaagtcctcctgggatctttacattttcttggcaagagtaatgcattcattgcttttaaaaaggtaaaaggtaaagtcaaaaaaaaaaaagaaatgtagttacaaaagatgcatttcaattgataatgaaggcttttaatgtaatgattataggaaatcttggaggagttctaataagtacagccaaattaagaacaaaatatgctaagaaaacagagaagtcatattgtttttcattctacattctagttaaacccaataaaacatgtgaagacaaaagtattcctcattagaagtatccttaggtcccatttatcgtcatatcttgtttactaccagttaagaaaatatggtactacagcctctgacaaattagggacaacctgagagccacattggtagaaacatacagatctgaaaaaattctgggatgaaagtaaggaagaagagattggaagaataaattaacatttaaaatacaacaagatcacatagaaatagaaatagttcgatgaaaagacttgtccataaaaagcaaaattaccaactatctggagatttaaattagactgtactgatgaatgtattcttcagaatatgtttatttgtatgatcttttacgtacccttcaataaaactctagactaagtccctacgacaaaagaggcagccccagcagtggccttgtggcctgatctacagagacagcaagccgccattcactgacccacccccatcacactggcaccccacgtttctctccaagcttcttccccacagtataaatcagatccaaattagctgctagtcataatcagcagaaaggatggagaggccttacagttaccttagacacagccctagtggtcttctcctacttcctcagggacggcctccgccagcagcacaacagcacacttcctgtagatctacaatcagttcttccgagccgcagacggctgctatcgtcctcgcagctctccgggtactcacgcttctttttctccctctttaattctaggccttcttttctttcttacctttgtgtcccctttcaagctttcccttttattcaaacgtacaccaaaatggcaaaagcagcaaagcattctaaatcatgttcacgcaagccagtgctggggaacaaaatggatacaaattggtcattatgttctctttcatttgggggtggcgcacaattaagagaggtacgctgtttttatgtacttctctataactgcagctctaaaggttcctcataccatcatgaaatttaagaggtacatgagcaatggcactatactgggaaagttaaaacaaaagatttattaacctgtgggttgttgttttaaaaaagtatcaagggggtctacacacttcctaaggggaaaagtaaacatttttttgaacacttcatatactacagttcttgtggggtttttttgtttttttttttttgacatggaggctcgcccagtcacccaggctggagtgcagtagtgcgatctcagctcaccacaacctcccacctcctgggttcaagcggttctcctgcctcagcctcccgagtagctgggactacgggcatgtgccatcatgcccggctaatttttgtatctttagtagagacagggtttcactatatcggccaggctggtctcgaactcccgacctcgtgttccgcctgcttaggcctccgaaagtgctgggattacaggcgtcagccactgcacccggctgcatgccacagtttttcacagacattatctcacgagtagacatgccaaacctagccatctagagctgtgctatccaaaaggtagtcactaaccacatgtagctatttaaatttaaaacatcattaaaattaaatttgaaattcaattcctcagtcacattcaacgcatttcaagtgtttgatacatgaaaacggctactgattgccatattgcacaacaaagagagaacatttccattatcagagaaattctacggcacaacaatgatctaagtctccttcacgaagattttccacaaaaacgtctgaagaattacattgggtccctcgtacaatgaagattaattcgctcacactaaagctgtaactacaatccatatacgtgtgttctcttgtacctgcagccaggttttcaccactgccagtttctacgctatacttggcctactgagagctccagtcttttacaaacacttactacatcctaacctctcttgaatgtctggcaaaggtttggatcaaaaaagacatcacatttttgcacatatgacataatacttgtagttgcctggaaatttattggcccatatgaagtgggatccccggggcagtgacaaaactaagtttatgctactgaggttttgcttgcccaggaaatataaaaaacttgtgactgtgaagtcactaaataaactaatggttttaataatgagggcaaaaaattattttaataggtataatgtcattatcaaaccacagaaaatgctatacctgaaatagagttcaattttggttagatttcctttaaagtctcacaggactcatgtggtacggggcctctgtgacaataggtaacttttcataaatgcttaagcacatctggactctactccagtgacctacaaggtaatacatcattctgtcagtttcagaggtacattcacatcctattctccaaaaccagaaatcgcccagggattcctagaccatatgacatgttgctgaaggaatatacaaatatatacacacaaatgtgcgtgcacgcgcgcacacacacacacacacacgcactgaaagaatattataaccattcacctttcttctaaattttaccttctgtgttaactttccctgtgttgacaaagaatgcctctcactaagtcatgaccctgcaggtcactgtaatacaacatcgcatacctggattattataatgggtgaagggttcttacatatagctcaaccggaggttaggaagccctacgaacactcagatttttgcttcatttttaaccaaaaggggtcagagcctttgtcaataccagctgttgcagtggttggctgcctgtgataataggctgcctttcacctgaaagaatgaaggggtgtttctcagagtaatatcttacgatacagaggatgatactgtctttaaagctagtgaaaatcaattttactgtcacttctttatttaaaaaaaaacctccctttgcagaaatatcactgagatgtcatgtttaaattttttttctacttcacattatttataagccaatattttaaagatttttggcagttctttaggcctgggcaggggtgatatttgcccagaatacatctgatatggtctcctggttgtttctaaatttcctgttttgactgatcaatgcttgtacagtgcttgttattaactactagacaataactcctgggtacagacactgctccttgtcttttttcctttgtgtaattcagatagtaaatgtccagcaaaaagcaagattccaaggggtaaattcaattgctgacgtatttgcatttctaattctaatccaagttaaataaatgaaaaatccactgtaaaagagaagcacaaaaggcaaaatcttcacaatcattacccagggaatcactgctttgtataaaatcattaaaaattatcttgaaaaataataaaagcaagttgactgagacaattatacaattctaagaaatgtttttagaaatgttcttctaagtattgttctttttaaattttatttttggcaattctcaactgtaactacaatacaacattctttccccaatgaaaaacaaattttaaactatttatttaacacttttggccaccaacatttacagaaatagttgcttagtatagcagctcaagcagcttaaaaaatttaaaagttaaaactttcatagggcctagaagcaaagaaaactcattagcaataaacataaatagtgcccaatcttgttttctaaaactattctccaatttctaaattctccaatttctaaaactattctccaataaaagaaaacagggcacattgaagaaatggctgcttctaggatatgagcaggaaacataaaaaataagcctgaagcatcttgtagtgccagaaagtgaggaggtgctaaagaaaaaaaaaaacaactctgcaatgatgaggatatgtcaaacggacacagaaatcaactgaaaaagttccctgcggccaaaagttagaatattttgggcaagaacataaagtagtattggattataactagagatataaaataaattgtgtacgaatacatactgatataaataaaagacaaatctcctgttcagaggaattccaaataatttacatattaaatactcctccttcaaggaggtggaacgtggctcccctctccttaggtctgggtggtgcctagtgacgtccctgtgacgaggacagtgtggaagggaaaaggaggagctctgcagtggcgaaggctgacaaacgcgacctcagctaggtgatcaaggtcaaaatcaacaagtcaagtcaatagagcatattccaggtaggatgtaatgaaaacggcactttatctctgtggtcttcctccccaaaatccgtaactccactctaatcatgaaaaaaaattcagacaggtattaccttctttccacgtaaggtacgttctacaaaatacctgaccaataatattcctccaaactgtcaaggatcatcaaaaacaaagaaagtatgaaaaactgtaccaagagaagcctaaagcaacacaaggaccaaaaataacgtggtatcctgtgtggcatactggtacagacactgggtaaaatccaagggaatctgaataaagtatggactttagttagtaccagtatatcaatattggttcattaattgtaataatgcaccatactaatataaggtgtcaatagggaaaactgggtacagaatatataggggaacactctgtactattcacaattttgctgtatatctacactttctaaaatttaaagtctatttaaaaaatttaaacagtctttccaatactaaatcatactgcatacaattaaaaatatttatttgtttgccattgtaattgtggttaagagtgtgggctaggataaaactgctggatctgaatcccgttcccctgtctaagttgatttttactattaatagttatgtgcttgacctgtacacagtatatagctaacacgggcccattctgacatcagttatgttcagcagtctttgctttcccagtaagagaaaagaagacaaataaggcccaatcagcccaaagcttctcatcacagggtagccatatttagtaaagaaccaggcaacatttgctgagtatcacagggactaaacctggggcaaactggacccccattcacagtcaaggcaggttctctttcccaagaacagatgtaaccagcaatgtgaataatgcctctgggcaaagtgcaggactgattttaagagctgtcagcaatttcacatgatatgaactctgtttatttctaatattcaaatgagctcaactaatgaaatactattttattttcataagcaaaaagagcagtaaaatgaatttgataaaaaatatctgaagacacattcaataagaatgaccggggtacatagtatgttattcatcttttttaaagtctacatgttaaaagatttacaaccaatgaatgcttcttaaatgaatattcatacagcaattgcagtggcttttttactgcctaagagagtcattaaaggcttgtcatcctggcccagcaatgcctctggtgcttctaaatcattagatcttagtctactgctttgaatgttgtaattgcaacataaaaatgagaaataaattaccagtatgaacaatcaaaggtcacgattttcagcaaaagcttagaattttatagtggcacctactttttaatataaacgattaagggtatttttcttgaccagactgagtaaataaacagatgcaattaatgaaacaaatgaaaaggctgagagcaactggctattctttaaacagattataagtaactaatgggcattaaagggttttttaatgtaaatttttgcttataatttcaacttctattttagattcgggggtacatccacaggctcgatacatgggtatgtagtgtggcgctgaggcttggggtagaaatgactccatcacccagggggtgagcctagtacccaatgggtagtttttcagcccttgcccccatcccctcttccccctctagtagtcccagtacctactgttcccatccttatgtccataactgatgtttttagagttagattaactgtcactatacctaatacaaaattcagtctgggattgtgcctcaggctatgctccacgtctgctactactctaagatcacgtgccctctgtgaagtcactgagctgagcacaccccagggacagggaacctgatatttctcttctatgaatgcactcagcacctcacactggatatataaagaataaggaaatcacttaataattcttggattaaacaaatgaatgcatctgcttgtggaattatttccaattcagtgcaccaaacagggaactttggtatacagccaaccaggctattttaagttttgttttgttttgaaaaaagtatttactgtgagggcttagagcagttacagggctctaaacagaaattactggatactccctcccttcaggacaacgtttgacacatttccaatatcttgtcacgtacaaaattcagaagagcacacctgattcgctggcttggtggggtggatgcttaccaggagatcttgattgacaatgacaccaaggctttatccaaggtggaagttaaacaaagtaaacacggagatgctattcctagaagagaacagcatagatgctgagcgagaatgtacacagacagccactgtaacagagaagatggagaacagcgtagatgctgaacaagaatgtacacagacgcccactgtaatagagaagatagagaacagtgtagactctgagcaagaatgtacacagatgtccactgtaatagagaagatagaggagaacagcgtagacgctgaggtagaatgtacacagacgcccactgtaatagagaagatagaagagaacagtgtagactctgagcaagaatgtacacaaacacccactgtgatagagtagaggagaacagcatagacgctgaggtagaatgtacacagacgtccactgtaatagagaagatagagaacagtgtagacgctgagcaagtatgtacacagatgtccactgtgatagagaagacagaggagaacagtgtagacgctgagcaagaatgtacacagatgcccactgtaatagagtagagaacagtgtagacgctgagcgagaatgtacacagacgcccactgtaatagagaagatagaggagaacagcgtagacgctgagcaagaatgtacacaaacgtccactgtgatacagaggatggagaacagcgcagacgctgagcaagaatgtaaacagacgcccactgtgatagagaagatggagaacagcgtagatgctgagcaagaatgtacacagacgcccactgtaatagagaagatagagaatagtgtagacgctgagaaagaatgtacacagacacccactgtaatagagaagatagaggagaacagcgtagacgctgaggtagaatgtacacagacgtcactataatagagaagatagaggagaacagcgtagacactgagcaagaatgtacacagacgcccactgtaatagagaagatgcacgggatgggaacaactaacaattccccaggaactacagtaggcattttgcttttcatatatatgatttgattctccaaacaaccttttgacgtgggtattatcaaccccatctttctagagccgaaaatgaagttcaccaaatttaagttacttagctaaagtcatgatatcaaacctaggtctttctaacctcttctacctcccaaccaaaaaaaaagtttcttatcaaagcatcatgtgaaacattaaatccatgaagtctcagaaatgcaagtcatctttgaaaacaatgtttcttgacaacgaggatttcttgcccccatattaacaaggttttctcacaacatattcagcaaatctttttcattcaatcaaaatatgttatttgcttttatataaacctaagtttccatggctattgacagaaaatggtgataccaacgtgacaagtacaattcttacagacaaattaataatctgctcatccctacaagctcaagattcccctctaagtaagtctatcagtccttatatatggtagcagtaataagagataccagatgagaatatggacacatccacaaaaattgctaatccctaatggcagtcaaccttattaatagggggttaaagcaggagcattttttaaaccagcgcaagcccagcacttttctaccatgcagaaaatgggtgttcatctctctggatcagcttaagcacacgcatgctattttgtttattatttgggtcactatatctgtaacctaagcagatggtaatatgcattttatatgaaatatttaattaggccatcaaaaacatggcagtaccagctgtcacggcctgctgaccttgggaaaggaggaagtatcagcaaaatgaggatgacaatgttcagatgaaacccagaaatgaagtgtttatgaaaatctcagttgctctaacttaccacacttcaaaccaagaaatgtcacggaagcataatgatccggttcacatcaatcacctacaggtccactgggtttattaaaaactattttcaggccaggcgcggtggctcacgccagtaatcccaacactttgggaggccgaggcaagtggatcacttgaagtcaggagtttgagaccagcctgggcaacttggagaaaccctgtctctactaaaagtataaaaattagctgggcgtggtggctcatgcctataatcccagctactcaggaggctgaggcaggagaatcgcttgcacccgggaggtggaggttgcagtgagctgagatcatgccattgcactccagcctgggcaacagagactctgtctcaatttaaaaaaaaaaaacaaaaaaaagccatttttaaatgatttatactgatacatacatagaaaaactggaaatatgtactgcaaaataataattattatttctagatggtgagctaatgggtgatttttatttaatacttttacttaacgatattttctataatgtacttttatgatttgaaatatttttaatttaaaaaaacagtgacatatacatatcagtccttttatttagtactgtagttcctgaaacactgccttaaaaatccatttttctcataaataaatttgaacacatttgatcctttctcatttctacatgaccacctttacatttttcatatctgaccgccctatcattggcctatgaagctttccaatctcttagcccaagttctttttccaaccaagtcagaggactcctgctactgcaaaccccaggctgggccttgactctgcctgcaagaattcagctggaaccgagtcaactccttccccctttcctcagaggcttttccagagacttctccctttcctcagttccccaacccatcaccatctccctcaaatcatcgaaatgtgacgtattaaatccacgcacagtctcagaaatgcaattcctccttgaaaacaacagttcttgacaacaaggacttcctggtatcacgctagctaacaaaatatactccaaatccttttccattcaatacattatgatacctgcttatgcataagcctaaagcctccatggctagtgagagaatatggtgataccacagtaacaaatccaacccaatcactcctccacctcttcgcccagaaaataaagtctggaggctgggtgaggtggctcacgctttaatcccagcactttgggaggccaagatagtggatcacttgaggtcaggagttcgagaccagcctggccaatatgggaaaacccgtctctactaaaaatacaaaatttagctggtcgtggtggtgggcgcctataatcccagctactcaggaggctgagacaggagaatcacttcaacctgggagggtgaggttgcactgagctgagatcgcaccactgcactccagagcaagactccgtctcaaaaaataaaagaaaagaaaaagaaaaagaaaataaaggctggagacttaagaactttctccagtttccttccctggtccacagcaaatccctctgaccccagggctttgtttccctctcactggtccttcagtgaaattaattcaataaatatccacagagctttaatccagatgtgtgcaagatattggggatttgttcagccaccatcagacacaatctctgctccatcaattctctcccgcttctggacgccagcacctccccatggttgttcgctagagctgccataacagaatactacagactggtggctgaaacaacagcaactgattctcacagttctggagtctggaagttcaagatgaaagtatctataggtttggtttcctccgagccctctctggctggaggagccactgtcttgctgcctcctgacacggcagtccctctgcgcacatgtgctgttggtgtctcttcctcttcctacaaggacaccagtcatactggactagggtcaaccctaaaggcctcatgttaaatcacctcttcaaagaccttctctccaaatatggtcacattctgaagtaccggtggttagaacatcaacatatgaatttgcggggacacagttcagcccagaacacactctccttctcctgggtttctcacttgctcctggctcttctacctcagtcaataacatcctcaaatctttttcatatttaatgcaccaacaacccactcctagtccagatcttccccctgtcctatctagctgcttcccatcactgccaagatgtgaaaataccctaaactagaagtctcaaactcaaatatagaggagccaggagaatcctaagtggaccggatggagaacaagagagtaccagtgcctgctaaaggtggagatcactatccattgccagctaacttcagtcaggtgtgaaaacagagcccagggtatctactgtgttttgtaagagaacccagaaatatatttatatgtaatttcccaagttttatatgctgataataaaaacagaaactccccccaaaaactgtaagtgggccaaataaaataggtttataatctatttttcccctattttttccctataatctcttaaatttactttccccatttcctgacctgtcactcatcctcacattaatgaaaacaggcttctttgtaccaattccttttcccagaccccacttaaacagctaatgctgaagcccccatatcttacctgccatgcttcccttctcaagtgtgagctccttgaaagcagatcctgtgtctctatatttccagtgctgagcactgtgtccagcatagaatgtgggctcagtaaatgattactaaataaattggcttaactctttctttagaacaacccaatgaaatggaggaatgataaatcaaagaatcttacctttgtcaaagctcaccacttaatttacctatttgcttcactggtttagcaagattctggaccatcatgtcacatatatactcttacatggcacgacagcttaaaatccccacttttccttcaaatggcacaattgagcttccaaagagacaaatgctgatatcattctgtcatttacccaaaaggtccatttatctgcatgcttaacattttagaacacagtcaatcatcagaaggtaagaaaaaaattctatgaattgtcaaaataggtgattaatgttcattcattaatttcactcataagcaaactcttcaggccttgactcagaatctcctggcttttaatttttaaactattctaacataacttcatttgcaggagaaatacatcaggccagaactatcttttacatctgttagcctgagagccagacttaattcctgagataccagtgtgctgctctgcggagggggttcctttgaacccactccgaactacactgaatttagcctcttctcatctgtcacttcacttatgaactgtcaaaattactccagaagggtggagtctatgaagatgacaataaaagaagttttgtacttaaaaggaggcatggaatttagacgtaagaagacagaaacctagggtggtccttacaaggagatacagttcagctatcacaaattagctcaagaaaatacttaggtgtcatctctttctaacaaagttattttcttgaccaggaagcttccagtgttccaatgaagtgctccaaaccctcttttctttcactataaatgtgggcatggtctccctcctggagtcctttcccatgaaatatccagtacagtcatgcgcagtctagccacaactcgccacaggaaaagcacaatatgagggacagtgttcactctcatacatctctgcttttgttcaatccaggcataacaggaattagacaggactagattaaaagttcccagttccggcccagcgtggtggctcacgcctggaatcccagcactttgggaggccaaggcagacagatcgtgaggtcaggagtttgagaccagtctggccaatatggtgaaaccccgtctctactaaaaatacaaaaattagctgggcatggtggcgagcgcctgtagtcccagctactcgggaagctgaggcaggagaatcgcttgaacccaggaggcgaggttgcattgagctgagatcgtgccactgcactccagcctgggtgacagagagagatgccacctcaaaaaacaacaaagacaacaacaacaagagcaaacttcccagttctgctacactcttaaggcaagttactaaacttttctaaatcttcacttcctcatatgtaaagtggggatcacaatattaaagcctataaaagggtgaacaaatactaaattcactggtgtgatgaattacccatcatgctgtcttcaatttccacgtctcagctgaggctttccctgatgctgcatgtgtggcaaggatcgggctttctatagaaaatattgaataaaataatattcctccactgtttttaggacaacttcaattagatgtggaaatactagggaaaaaagagtagtcttaaaatgtattttataaaaatctagatacaacttaagcctaaaataaatttaaaaaaagaaaaacaaattaatccagatgacatataactaaacatcaaaatggggaaggaaggaaggaagggaaacctacattgaaatctattctaccataaaccaacatgaacacttctgaaaagaatgtaagaggagttctgggctatctcttaagtaaaagcaacaggaatcccatgggtaaagaaacttgtaataaagaggtatttagactcaaagaatctcacagaaatataagaaatagagttagggtcatatggaatgttctagtggtaccaaaagccacacaaaaatgacagagaaaaattatgtacagaacttgtatgcttgaaaaaaaagttacagtattattcttctcttgctaccaatgcaaaacaaaaatcaataaccaattctgttttcagatttttatccactgtgctgcataaaggcaatttggggactgtctgaacagaacttctaactcagcatcttctcagacaagtagatttgtcattctaaccaataaataactagtcatactgtggctaagagagcactttatatttaatgctttaataaagctctgaaaaagttgggaaaactttaaaaccttagccactttagagtaatcatattaaattttaatatagttttataaactgtataacagctcagctgatttaacaactgtaaaaagctaaattcacagaaaaataactcgtattaattattgaattcacttttcagaagcactgattcaccgaaagtgatggcagactcagaagcttctgaaggaacacagttgagttccctaaacatttcattagtgggcattaccagggaacacaattctatgccaaacgtataaggcaggttttaggacttcagattacctaaaatgaacataataatgagtagtcacttctataaagatactggatattggatataaaaattaaatatgtgttatttgacacacctattctctatgaataggctgtaccacacataaaacatcagaaaatctgaattcttgtgtgtaggtcattcatatgtttactcctgtcttttaaattcatctttatcaccatcagatcctcattacttattgtctggatgcaggtttctcttttacttacactgcctctccttccacgttttcatcgttatcagtggcccatgttagtaggttaatcttagtttgtgagcctgaagatctcttagcgctccaagatggaactggtacgtgtcatcttatttccatctaaatacagcataaggagtgaaaaaggtcaatggactgggagttactaaataaaggtgatgtggaaaacaaatcataacataggagtataagctaaaggaaagggccattatggtaatatctatcaaggacacttacaaacagtaaaagacaaaaggacatacaaagaaacgtacaacttaactaaaacagaaaagaaaaaagaaaagctctgaagtctacaaaattataacaacgatgggatatgaatcatgttttttcaattctaagtggaaggaagaaaaataaatcacatgtgcctggtaggggagaatttgcttaagaaagttttctcattttagatttgcttttggggtagatggtactttttcactatattcttcaatctcaagttttcacaggaatcacattaataagagacagggactggacaataacctggggagcagtaaatttgggggttattcttttgcattaattggtctagttaaccaagatgtgcaaactgccagagtagaagtaaatctacattctcaaaatttttttaaaaatgaagagtgacaaggaagaatatgcctcattctagcaaagtcatatctgaagagagagctgggaaaataggtgagatttgaaatttgtgtctatatgatgtaagacaattttagaatgatagttattatctcataggctaaatcaaagcacagctgtctctctgcatgcacattttgattctgcaacagaggtcctgcaagagccatcataatgccagcaaattaaataaggagagtttgaaaggcccagtcattgtgaacaagactgaggctatttcattcacttcacgtggtgaagtgcattacgaggagctgatatgactgtaaaatgtatggagacactattaagctgaaaggaatctagacatgtggatagttccctactcactaacacttcatgataatagagttaaatattctgaatagttcacttctaagggattaatacacttccccagtactcaaaatcatgtctgcctttcaacttatttgaaaggttcagtaataactcctcaaatactcactgcttgtcatattctaaatactgaattcttagatgcaaacacgcagctcctattagggctaacggaagctacatgtttgtaccaagggaaaaacatacgtctagaaaactgttctctgctgctcataggcaatcacgttgcatgtcctctcgtggacggtataaaaatgcgtgactatttacgcagaaccattcaggtgttacaggcacttccatagcatccaagaatgcattagccaaaaccaactaaagtagtttttgggctcatgatcattcaagctgaatcaataatattaaacagcatgtggaatgggggaaaaccaagtgtaaagcaacattaaaacctctttccactcaagcataattcattttgatctttactactggattcagctaaaggtcaaataatatatgatgatttagattcagaaaatatattatttcgctgttgagtatagtctgaaatgagggcaactaatttaaaaatggaatcaattttaaaaatataaatgtaataaaaatgtctccatcacagaatatacaaattaagtcccactattgattactgccaacattttaagcctccctactcatattggtaatgtctttagtgcaacttaattttcttcatattgtgtcatacacattcaatgaacatcattccagtgagggaccaagaacgaggtcagaaatggctgtgatgataaattacagaccttaataacttctgaacaatttgaaatgtaaaagccatctataagtcattcagcttgatagatgaatggttaatgaattatacaaactaataaaaaccattaattatttatctgtactacaaaatggcataaggccaagatcttaaacatggtctgcattaagaccaaaactgggattcagggtatatataacaagagggggaaaaaaagagttatctattagaagactgtataagcaaaaatcacttaagctttataagcatagaagattttattaaaggactggtcagattcataactgacagaccactgaaatattatcagcattggggtaaaaaaaaaaaaaggtaactggttgatttagatgtttccttgttcttttgctttttgttttcagtgaaaggcagtttgaaatttccgtcttagtggtttgtactgcagaacactgagatcaagacttgggtacttttgtatacttgcatttcttgctcttgcatgagtcccaagcagtgatggggggctacccctccccactaaggaataatcacattccagtttctggaaagaactcaaattagtctgactctagtgaatcaagagcaagtccaagatggaaacacaggagaggcaacctgggagggaacagactgaacaggtaaaactacagttagtagcctccccgttcatgaattacaactgacaaatgacatcttatctggtaactctgtcaaatcttcactaattcttcgacttcagtatttctcaagaatggctcttctactaccaatatcagaatcacctagagagcctgtttaaaatgcatattcctaagttactttccagacctcaggtaacaggacatattccagaggtctggaaataggtaacagacctcaccaagtgtggggctgagaaagcttttaatgatctgcccaggatattccaatgtgccctaaagtttgagagtcacagtcctaagaggatgctctccattacaccaccctgcagcaatggtgcctaccatcacacgcatagtgcacatgtcagcaacgtaagagatgccaagctcttaagtgtaacagggtgccttgaatattccctaaatatgtgagaacataggcatgactggatggataaatgcatgaaggagaaaactaacagtacttctgatataaaataggaattctgattcctttagaattggctctacagcactttgggaggccgaggtgggtggttcacctgaggtcaggagttcaagaccagcctcaccaacatggcgaaaccccgtctctactaaaaatgcaaaaattagctgggcgtggttgcgggcacctgtaatctcagctactcaggaggctgaggcaggagaatcacttgaacccgggaagcggaggttgcagtgagccgacattgtgccactgcactccagcctgggcaacaagggcgaaactaaaaaaaaaaaaacaaaaacaaaaaaaacagaattggctctacaaatccattcgcagctctccaaaaatccccaaggtgctccaaatttctcacagtctatatatttgaccgtacgatcttaacttctcaggtattgatcagagaaagtcgagaggaaggaggaaatgcagggcttcaattctgatttcgcagaaacatgagtgctgcactgctttcggccccgcatggtgtgctggcagacaccaccactgtcccaggcgcgtctgctgtgaaagccgttgcttagcaacagcaatcaatgctgtatttcctcttcaccattttcctgaagattgagacactgctccaaggtatcattttcaaataccttctgtttcactgaccaaacatgtttgttaatttttctattataggaaaaaaaaatcatgaaccaaattggtctaagaatccaggaaagaggagtgagggaaggtcagtataacaccagtgctttgggatttgtttgatgaagaaaaattctttgacagctcattgactttatttgctataccgtttcattctgccattttagcattgatttctgctacctcatgggatatgaaagtcgttagcatgaattatcattctaaatgcagatccacaaggtactgccataaaacacaaaaagcaaatgattttcagagactggttgaatacacatctcacatctctgttaaagctcttgtcttggtcatgttcttattaaccaataacaacaaaatgttaaaaaaaaataaacatctctccactgataccacaatatataattctttcagatgggcaatgtttctactaaattaattgtacctgtgatgaaagcatatagacaataccaatatttaccttaggaaaaaggcagagaaagtacacaagagggagacaaataaaagggggaagaggtagtaatttttatcaatatgtcctaccaatgaatagattcttcatataaaaccaaaaatgagacttgggaactttacatgacatcttccaataaagaaacttgatacttgcttgaagtatatacgtgcagatatgttagtaagtggtggaatccaacaaggtggatattgtgtgatatttatttttcatgtttattgaatatctactgtgtaaaaattctatgggtagcataaagatgagtaaaatgtaatccctgtacaagattgtggtaaaaaaaaaaaaagtcacataaataaatacagaagaatacatattacctcagataatcactcaagtatttagtaacaacaaatattccacttaaggtggattatatctacaacagacaaaatgagtaaatcggaatcaaaagcttttatttttttaaaacactcaatactggtaaggatgtagcgacataaaaatgcatcatgtgccagaaaagacacagggctggtaaactaaatcaactttttcaaagatagttagcaatatgcaacaaaacttttaaatatgcaaatttaaaatgctgacacagtaattgtatatctagtcaattatttcaaggaaataaagatgccaacaaaagatatttatttctgctacatttaaaataataaatactaaaatgttcaatattagaagaatgattaaatgcataatggtaataattatatgataaatgagtaccattagggtattcaagaatattttatgaaaggaaataattcctataatgttaacaggaaaaacataaaagcagccaatacataaatgcatagataaaatagtggaacaaatgaaaatgctaatgatttttggtgatttttattttcctctctttattttttctatgcgtttctaggttttttgtattgactgtctactgcatatttggtcaccgaaaaatgtcccaacaaataaaatctatcagtctcatttgacttcctattaaccgatctgttttatttcaacttagaacttcaaccctcactggtatcaagtactgccaagttgaatgatagtactcttaagtttcccaagcatttttagaccagcagtttttcatttccataaagatctaataaatttggttaatattttccacagagaatagctgtaatgaaagcataaaatttaagttaatctaaacaacaaatatgtaccaagcacaaggcatacaaatgtagacaggacgttcttgggttatgagaaatggatttcagtaacttgctctcccttcagtgtccttccagaagatatggggccttcaggtacagcatttctctggtgtcagaatatatagtctgtctacaaaaggagctctagtatcatccagggcaggtgatgacactgtctacaactgctaaccctctaccatcagataaactaaagagtgaaggatgcagagaaatgaataaaattaaaagaattctgtcaagggaaattagtattctttcaaccttcctcaatctcatatgatgtcgacacagatacacaggatatcacatgctctttttgtcagttacctgtgactatggatgctgacaaaagcacttttctaaacccaaacaccaagggccagactttccaatgcttacacagcagcatgtatgttaatacctgcattatcaaaggaggaaactgaagatttggaatggtgaagtacattggctagggtccagctcatccgcaagaagacaaaactccagtgagttttgagtcaggttatctcctaagtccgtgtttccaccattatagcacatatgatctttgagaaaatggataggagaaaggcacccattgcaaaggaataacatgagcaaaacagagcagcagaagtcaacagaacattctcaggccctgcacacccaagtttgctagaacaagggcaggggaacactcagctacctggtttgttcacccaacctgccctgtctactgcacttccacgccaggacagtggccctgttcaaaggtcaaaaccagtcccactctgatgctcccctccctggctccattctcacttcagcatgatgatcttctcatggtccctgagaatatcttagcatctgtaatggccatcggccattgagtaaatcccagttttaaacttgcctataaagaacgaacttagtgtgcttttctgctgctttctctcattgaacacagttctttctcttccttcaagaagaacctttctgaagcaccttgaatttcctagtttataatctctgtgaactcctgctatcaagagctctgcagagctagcttccataacctgtcctctttggtgactctctcgtaacaccaaaagctcccttctaacaccaacaggcaaaagatggtcatggtttaatattttaggtactgttccagaattagccagactgtggttcttaatgtttgcatctgtttgtttacagaaatggtggtattgatctaatggaacactggaacttggtctttacaatggcaagttgtggatgataaggttgaaaaagacaagagaggagtctagaaatccagtcagagattagatttcacatcccaggtcacaaaatggtagggagataatacatttgtgaaagctttatttggtaaaagaatgcaagataaccaaagaggagacaaatgtcatagcaatccagctatgagttgtgtactctgtgctggaatggtaaaccaagcatggcaagatatctcaaaggaaaaatgaacagaactgtcaattaactgtatatgaggtaaaacaaaggaaaaaagacaaagagatgagttttgaaaccaatatgttgaagctcatagtatcagctcatttatttaagtgaaatatatgaaggaattgtttaaaataaaaaccaaggaatttttaaaatagcatgccaaagtaagtaaatacataataagtatgcctccaagaagtaaggctaagagagaaaccaatttagatcagtggcctctttcaggaagagagaaggttctgccctatccagcattttctataaggacaagagaaaatattttttcagtcttccaaagacagctaccggaatatttaggaacagtcctaaaaatcaagaaacagaatcttctgaatatggaggaatgatcattaaaacaaagaggaatggagaatagcaaagccattttgcagctaaacttgctgagccccaaaattatccactcatgtttatgttagcagtactataaaacttatatatatgctctattatcaaatacatttttccactttctagtaggtaaaattcatggaaacacttaattttctttatttatgcagatttttacctctctaaaaaatgctgctgctgagctttctatttttgttcattccagttgaaatgcgatgattcatcggtcatcaccacaatggccacacgcatgtggaagagaagctcatgattctaatctgcacagttgctggcggctagatatgcctaaagaggatgtgaaacagcagcttcacttccaatggagatccggacagtaataaaacagtttcgcaatctcttcactaaatacatctttgtttgcatggtctatgtatattgtcatggggcaggtgcaggaaaatataaaatatacatatttaaaatcctactgagctgctgtgaagtcagtgacaaagaaaaacacacacacgctggggcttcatgcatgtagttaaataaataactttgagatcatcaaaaagagtcagcacacccatatttcttacttggcgctcattactgttcaaagacaccatttttttttaatgctgagccatcttaaaactttgtcaggcaacattaaattcttcaagtcttaagccctaaagaaagttaccagtaatgggcagtaacattaagttagctttgcatttaagaaaaaatatttatccatctgccttctcccacagagtactttggatcactctcagtggccatcgttctctgtcctgtcttcatgcagctgggctgagcagcagcatgccacagaaaggggccagcggaactcaactgtccaaagaaatgtccaaactgcttctgttacgtaaagccaatgtcactttccttttttaaaggaagccctggggtgtaatcctgcctgagatgagtccactgacacgacaaaaatctaaaatgtgtaactatttggaggaaagtcagtgtgtatcttccacttgaaaggtataattccttaaaagggacataaaaatattttttctattgtatactctaacagtcaataactcacaaggaaaccgaatagagagcgaaagatggagcactctggactaatgtgaaaaacaaactcaaggccgggcacggtggctcacacttgtaatcccagcactttgggaggccaacaggggcaggtcatgaggtcagcagttcaagaccagcctggccaacatggtgaaaccccgtctctactaaaaatacaaaattagccaagcgtgatggtgcacacctgcaatcccagctactcaggaggctgaggcaggagaatcgcttgaacccgggaggcagaggttgcagtgagccgagatagcgccatggcactcctgcctgggcagtagagtaagactccatttcaaaaaaaaaaaaaaactcataagcagacttcaggaaaatgccaaacaataaaatacatctccatattggacaatatggtgaccccaacaacccagatagacgcactgacaaatatcttctaaatgcatcagtacattgtttgtaccctcatttggggaaaaatatgcaaaaaagatacctaggaacaagtgggaaaatctgatatggattaggtattacagaaaatattagagaattgttactaattgtctaagacgtgctatggcattgttataaaagagaacgtctttgtttttagaatgctaacaattgatgaatctaggtgctaaatttctggttgtattccttcaccttttctgcattattgaaaatataataaaaaatgaagaaaaataaaggcataaaagaagttgtatttaaaaagagaacattaaaataaaattcatgatttaagtgataagaaagaaatatccttagagtattacagtcaagtaaagataccaggccagtaagtaaactctgaagctagctttctcactagaaacatttagctaacctgaggatcctgaactttccccttgacggagacgtgggcacaaagcactggaggctgtgtgtgggcctcatccagactggaaagtctaaaaccaaactcctgaacagacctaggattttccaaggactatatgctgtgagttagaatcactgtaaattacaaaaaatctattccacacaagggagagcaaagaagttctcaatctagaccctaaatactggacagagggggataatttttttctagactcataagcagaagttggcatctaaccaagcttgtagcctaaatttatattatctttgtgggagaagaaacctcaagcccagaaattaacctgagcaggatccaaggttgttaatgccttagttatccatcaaaacaaaaggcaaattcactcagggtgaatacaccttcaatccaggcctcaaagaatttctaaagagtgtgaacttacagcttaaaaaacaaaatcacaagccagggtaacgtagggagaccctgtctctacgaaaaattaactgggcgtggtgatgtgtgcctatggtcccagctacttggaaggctgggatgggaggatcgctcgagcccgggaggcagaggttgcactgagccgagattgtacaactgcactccagcctgggtaatagaccaagaccctgtctcaaaatataaataaactaaaaattctcacaaagaaaacaaagaaacaaagatcagtgaacaagactcagcagaagtattatattgctgaatcaactcacaaagagtttctaatttggtattatcagaatttaaagtaaatatgtttaagatgtttaaaggaataagagattgaaaatatgaggaaggataaagaaaattttttaatgtctagctaggaaaaaaaataccatctagaaatgataaatataattgtaattaaagtgctaatgtaaaaattggcaacagtttttaaatcccacaatgtcaaatgctggtgaagatggttcagtacgaatgaagtcaactttcagaaacaatttgacattatctagtgaagttgcaataagcatactcatggcccaacaattccattacaagttatatatccaagaaaaactcctgtacatgttcaatggaagataaatacatgaatgttcatggcaatgatatgtgtaacagttaaaaacagaaaataaataaactatggtacattcatagaaaacaatacagcgataaaactgaatgagttgcagttacatgaccatcacgaataaatctcagaatactaggtcaaaaaaagaaagtagacaagaatacgtacactctgacatgagtaaagttaaaaacataccaaattataacacataaaaaactgatttcaatacatacaagaaaacctgttaaaaaaaaagccagtgaaaggaacataagattcaagatagtgattatttcgtggggtggagagggagataagagagagaagcagttgtgcagctttaaaagtagtggcaacaggccgggcgcggtggctcacgcctgtaatcccagcactttgggaggccgaggcaggcggatcacgaggtcaggagatcgagaccatcctggctaacacggtgaaaccccgtctctactaaaaatacaaaaaattagccagggggtggcgggcggctgtagtcccagctactctggaggctgaggcaggagaatggcctgaacccaggagacggagcttgcagtaaaccgagatggcgccactgcactccagcctgggtgacagagcgagactccgtctcaaaaaaaaaaaaaagtagtggcaacactgtatttcttaagactggctgactgctatgcaagttgtttgtttactgttatttgtaccttatatttaaggtattttgtgtgtgttcaataaaaattatttaacaaaacaaaaaagcaataatactcacgggtatcttagccaaaagcctgaagctatactagttctgcacacaacaaacatgctttagaaaaagaggaaaccagtaacattcaggaatatcatagcaagacaatcacatgcttctggaaaatacaggatactgtggtaaggaaatgaccaacgttgtcaattctgtcccctttccagggatgtagatctccatttcacagagcaccaatagctttatctgtatgcctgggagttgtcaagcctctcttttatataggttgggcttaatttaactaaaactcctgattttcccctccaactattgatagggacagggggcagagaaattctaggcagaaaatggtggtccccaacaaaaccccaccttcaagcctcaaaccatggcccaaagtagaacttacatccctgtttccctgcttgaatgctgccttttccaaaaccacctgtggccctatcccaccccaccctgtgcctataaaaaccccagatccagccagcagagagaagagaagcagctggacatcaaagactgcagctggatgtcggagagaagcagcttgacttcagagggacagcctgacggggtaactctggagaagaatctggccagagatgaccgcatttcacaggaagattaccttcctgccccatccccttttcagctcaccttgccactgagagccacttccattggcaataaaactccctgcatttatcatccttcaattcattcgtgtgacttcatttctcccagatgccagacaagattctggagccatgagtgtgaagacaaaaaggttgtcacactgaccctttgccctcgttagcagaaggcagctgcctcatgcgaaaaggcagagggcccattgagctgttaacgcataagccgtctgcagagagcagagctaaaaggtcactgtaacactccctctggggctttcgtggtcacaggcactcccagcccccagatgcagctgcaggcaagcacagagttggctcctgccagcaaccaaaaaacactcacccaggctcctgcactcacacacctgcatgcctcctttcatgaggggtggaacgcagcagatccgactgagtggggttcactgctggtgccgtagtggctggctgactccagcgaccatgtactccacctcccaccttgttgactcatgcactccctcctgtgaggagctgagagctgcaggtgagtaaacagaacacccctgttgcaagtcccacgagggtgtcagggaaatatactgcttcattattgctgttcatttgatttcaaatataatgatatctaaacgcaattttttggcatttacgttcctctaagcccagccttaaatttagatgatgaaaatcttaaattgtcccaaatggacactacctccttccacatctgttgactaggatattgatggtagtggccattccagacgacccactgctaccatcacaccagctgcagtgaggaggaatggccgggcctgcacactccacagagcagggagaagaccccacccgccccacccgccatgctctccccaacccaccatgcagctgcagacccaggcacctgcagcctcccaaaccatggctgcagacctgggactcctgctccacgaagcaggtgggagccccacctgcctgggcacagctgcagctgaccaaaccacagctgtggatccagacatccctgcactttggggggcccaggaaggcccctgactgcactcacagtctcagaaatgcctgcttcagctgcctggcttctctctgctatcgatgcccactccgacctgggagcaaagtcagggctgagtccgggcaccatgaacagcagcaggaggcaggcaggttcctgggcggatggggcctggtcaccagtgaggccccattgtcaagccaggaagggcctgaaggctgggggctgggctgccagttccggggcatggagtggaaacttgtggtgccttttccggcccacccatggccacctatggaccaatcagtgcaaacttcctcccctctgaggcctgtaaatgccccaggctcagtcagagctgagcagactgggacaaccagctgcagagaggagctacccactccagggtctcctctctagactgagagctgcagagatggtactaccagctgcagaggggagcaacccactctggggcctcctctctgctgagagaacagacagatgatgggacgaccagctgcagagaggagctaccctctctgcctagagctgcagatgatgggacgacctgcctgcagagaacagtctcttactctagggcctcctctctgccaagagctggagacaacggaacaactagccaaacagagaagctaccctctctgctgagaactgaacactcgttgggatgacctaccagcagaggggagcaagtctctctgctaaggagctgaacgctcattgggacatcctggctacggagaggacctgcccactgtgggttttctctgagttgttctattgctcagtaaagctcctcttcatcctgctcaccctccacattgcatacctcattcttcctggtcacaggacaagaactcaggacccaccgaatggtgaggctaaaagagctactgtaacacaaacagggctaaaacatgccccttgctcgccacgttgtgggcaaagagaaggagaaaggagctgcaacccttcgggtagcccagacctgggagctccctgagccagggctgtgagcccttctttggggccctgtggttcctggcatctccaagtttccgggatgtcaccacattccccggtgccagacgggaaagccgcttgcagtgaacccggtccagccacagcctcacagagagctggtgctcacgccagcacctggagctgcccacaccatagcagcagctggtgtgtctgaccgcacagtgggcggaccccacgtttgctgacacacacccctcaccactccatgcctgactccagactccctttgaagcacgggatccaggctggtagcatgagctgagcgcagcctgccagggcgagtgggtggaacaagcccagcaggtccaagcaaaactcaggcaagggcaccaccagtcacatgtttccggccagaaaagtgacaccccaaagaccccatgacagtatgacttatatcctgttatattgtctcatcacaattcacatagggttgaatctgctattttgactgtttgtgatgttttggctagcatctgaacagatgggcagtttttcttcagtatgactatttgccaacaattggaagggtgtaaaactcattctcagagcaacccaaacataactacaaggagtctaacagataaaatatccactgttgtattcagaaatcctgtataaagtgccagtgaattaaaagaacactttggtaatgtggttaaatgaatgctactaataatcataatagaactggaaatttgtataggtattgtgttcacattcatctgattatcatagctctaagaaatagatattacaggtattattacggactttattatcgacaaggaacaaagcacagagagatccatattacagaaaatggactgaactcagaaataagaacaggatttgagccgatctgtgcctcattagctgtgtaaacttaaacaagtaacttaatttctcacagcctccattgcctcatttgaacacgcaagcacagtgagacctaactcacaaggtcctcctgagaattatataaaatatataaaagttatcagcaagagctcctgtcatagagtagattcttcatgaatatatccttccttaatttatgaaatcctccttgataagaagaagtcaaaacttttatcattactcttttcacaaaggagtcaaaggtgatttcaatttagggaaaaagaaaagtttagacctaaaacattaatataaactgaaggatgcaaagaactcaatgttctacaatcatacttcagtggcctctcattgtctcctgaagaaatatacagaatataatgagtgggtcaccatgcggtttagaaggggcagagttgtcctacagtaataatcacggtacatttgatgctaaatcgtatgtgctctaatattgtaatttcacatctaatacatgaaaatctttccaatgaagttagtttattccctatagcatgaagatagatgaagttaaatagtttatttcctatagcataaagatagcccttgacattcattgtcacacatttcctgtttctgagatcagtaatttgtagattccttcctgaaggttccagcaaagagcttttacccatctgcccaactcctttgattcaagacagggaggggaacagaggtctcctcaggaaagagagtctcctgtacccagggtgaggagaaaagtggtcataaggaagccgtggggccacagatgtatgaccactcacaactgattcagtgagccaagaagacagcagtgttgccagagatggaaggtgttctcagaatgctaacaggacttgctgatgaaggggatggtggtaggggatgacagaaagaattaatcaagagcgatgccttgattttggtcctgagcacctgactgggagtaactactgaactggaaaagatagaggcagcctgagtctcctgtaaaattcagacaccttccaatctccataattctagtttcttgttcctggacctcttgctttagggaggcatatagcactttacaaagtatttgctcattttgtcatcttatgtatatactgaaaatggagtcagtgtcaccagaaaggacacctaatactccttgcttttcttatggacctacgactatactataggtgctgaaggtacctatacctatactattggtattgaagggacacaaagatttgacctaaccttagagtcactttgtaggactactaccccttctctgttttcctccttcttcattaactcttcccttacctgacaagcacagctgactggaattgtgtacactaaatggtcctttacaatacggaatacttcagtaattacaatatgctggaattgctaaattctataatttcatttggatgaacttaatcacatcatagcattcaatttggcttattttcaaaatcagcttcgtttataaactaaaaagaactgaaggattcttttcattttcaagacttctcatctgtaagaggatttagattcttctatttacaagcattcttctgagaatctttcattctacacacaggtttctttgggggttctgttttatcttttttcatacactgcctaccagagagaacaagactggcaaaaggactctgtcctcataaagctcagagacgatgaacagataaacaagtaagtgaacaaaaatacttcagataatgctaaatcctccaaggagaatatgatacagtagatgtaatgggaagctcctttagactgagtggtcagagaggacctttctggggtggggtgtggcatttgaactgtgccctgaagaccgaagcagtacaagcacaggaattagcaactgcaagggctctgtttgataatgaacttggtaggttaaagggacagaaagaaagccagtgtggctgaggtgtggtcaaggggatgtatccaaagtatagcaatacatcagagaggaaacccaggggcagatatattagtactgaaatagcataagggattcacactgtattctaggtgtaatggaagtcgatggaaggttttaagggaaggtgcagggattacctaattcatattttaaaaggtcattgtgggcgccactgagaaagaatatagaggagcaggaaaggaaggaggaggaggaaggacagaaggaagactactatgattgctcaggcaagatatgatgttacgttagactatactggtggcaaagaaagcaggggaaacagactttagacatattttaaagaaaatgttaataggacttgctaatgaattcagtggtgatgggggtaagtgacagaaaaaaaattaagagtaatgactagatttttgtactgagcacttgactgggggtaattattgaggtgggaaaaacagaagcagaaaaaggaaggtggcagagggagccgaggaatcaagagttctgctctggctatgttgagtttgagatgcttttcaaatatccaagtgaggatgaaaccagtagatggctggacatacgaacgggagctcagtatagcaatcaaggctggagatacaattttttttttagtatattggcatcaaagagggtatttaaagtcatagaaataaattagaatcctttaaggagagggtttatttaacgagaaagaaaggagaagaaagctcaggactcagcctttcataattccagtatttaaaggttaaacagagcatcaacagccgtcaaaagatgttgaaaagaaatggctaaacagagggaaaaacaagaagagtgttgagtactaggagccaagataggggtcagttatgtggaagactgctgaaaagtcaaaaaaaaaaaaaaaaaaaaaaaaaaaaaaaaaaaacagaaaagacaccagatttggcaagactaaaggtctttggtaaccttattagaacaactgtaatgaagtgtcagaaaagaaagtcccattagaatgggctgaaaagagaatggaaggtgaggaacaggggagaaggaagagacaataactacatagcagtcttttcagaagttgtgcacaagtgtgtgagagagctagagcacaggagagcgagcccgcaccagcacacacttaacacaggtgacaacagaagttacggaaagacagtgtctctggagcatctgtaatcatctccttctttgttttcctcttcgagtcattctgctgaagttcctgaataaaccatacggatctacaacatacatacatctcagacctagtatctcttttgttcaatctctccatatttttctgccaaatctaatcagaggttttgcggagggattcgtaacaactatattcttcatttttaaaaatgtgtgcaaaatagtagcattcggtaaatattacaagattgcaaggctagatgtatctcaaagaacacaatacaaaagatgtaagatgctcttctaactggaaatggtggaaacttcattatgaatccaatttccaaattatttccaataatgaaggccaatgtatgatctagtcacctttgacaagatcggtttccataatatgtttacttgctttttttcacactgtctcccaatctgttctttgaagtttcttcttgcctaaaataaacttccacacacctgctctataaacccgaactcaaagtgtagcatttttacctccataaatgttttggacactatgctgacagaagaagaagaggaactaaatgacctgtgaaagcccctgttagttgcttcatactgataccgaatttctaaatgtattataaatgcatttcacagcattccattaacatgtcagaggactttcttttccactaagcacactttgcatgagttaaatatcattcttttaaatttacataaagacaagttaaagatgaggccatgtactacagatttatttaatctacatgagacctaagatatattttcatcaatggctgtgctagaataattataaattacagaaaataaaacattcagttagtggtatagtttgcctagaattgattttttgatgctgattatataacccattaactgactaaaacttcttcactcgagtcactgcagcgtctgccaccatttgtgttagtgtttacacataaagatcacacacatttgatgcgtccactttccttcaaatatgggttagagtggaactgggaaacagaaccatttctagtctttttacagctttgttattttgatttttaaatttacatttggaataaagagaaactctgctataagaatctcatactaacctctgaataaagtggagatatgcaagtactccaagaaggcaacagaattaaatatattttctatgaaagatattaaaaccaaaagtgtttaataatcttcattaatgaactttaaagctcaagaagaccttataaatcatctagttcatcttccttggtttcaaaatctactcttgaatttatttagcattatgagattattagatgaggttatttattctccctaattttaatattgataattaatctttaataaatgcttgtgatttttgacatattaaattctaaacctcaacatttcaaacagtcttagatcatgaagaatattaaccaagtccaacgtcccatatactttgtagtaaaatggtagaccctgaggtgaagtggggcaataatttcatgagaacacatcacagtacatggttagatgtactttccactttttcttctactagaaaactaagtttctgttttgggaagtgctggctttgtgttctgcccgtttatgctttaatttcagctcatgcactggggcgccctcaggaggattaaagaagacaactttggccgggtgcggcggctcacgcctgtaatcccagcactttgggaggccaaggcaggtgaatcaagaggtcaagagatcgagaccatcctggctaacatggtgaaaccctgtctctattaaaaatacaaaaaattaaccgggtgtggtggcgggcgcctgaagtcccaactactcaggaggctgaggcaggagaatcacttgaacgtgggaggcggaggttgcagtgagctgagattgcacaactgcactccagcctgggtgacagagtgagactccatctcaaaaaaaaagaagagaagaaagaagaagaaggaagaaggaagaagaagacaactttgagtggtggatgaaactccgtcctaaagattccaggctggagaactgggtccttttagccatcttattaacagtttgaacttgaagagatcacttaacctctccagccactctacctttatgcataaaatgaaaataatattagtttacacataagtattcaaataatttcctaaggtctcaccgatctctaaaaatctgtgataaatattttcataaaatagatttggcatcatatgctatgttatttatatttacctaacaccacatttccttatttttattccttttttttttttttttttttttggagacaaagtctcactccatcacccaaactccaaactacagagtgcagtggcagatctccactgactgcaacctccgcctcccgggttcaggcaattctcctgcctcagtctcccgagtagttgggattacaggcgcatgctaccatgaccggctaatttttgtatttttagtagagatgggttttcaccatgttggccaggctggtctgaaactcctgaccttgagtgatccacctgcctcagcctcccaaagtactgggattgcagacgtgagccactgcgcccggcctcacatttccttatttcaatgtttacttcagaaggccctaaagcagggcaattcaactggcttccatgtttacttatcattaaaagttatcttacaggactcttgggattgtgtcctttttaagacaacacaaagttcatagagtaatggactgtgtggtactcctacccgaggctccaacattttgaggcataagaaaatcaagtatctggttctgatttccactctactttgttgccatttttagcaacagttgatggcacttgacctgatctctttcctggtccattgcctataggtcaagctgacagcagcataaaaccctaaacagccataactttttagtatctattaatagatacattttatggtggctgaagtgacaatctaggttcctttggttaagaagttcaaaatctttattctactgctattcctttctgtataagtttctcagagaaaacaaggtgtttccagcagcaccatcactttatgaaaaaaattaaacctccatcatctaaatataatgttttttctaaaagaagccttcttttttttagtatgtatattatttttagatacttccattgctttaagaagttcccatgatctttgagacaaaaatcaaaacatctttgggatgacaaaactaaaaatgaataaatagataaagtggaatttttgagccaactttttttacattttcatacaaatttcgaagctacaattaacttcatttagaccatgaatagcaacctaatggggctgtaacaatttccacaaataaagctacactatttgtttcacattcactaaggatgactattactctaaatgttcaattagttcttcatttattttaaaattaaattcattataaaaataatgttagaatattatccaataaattttctttgctcaccttcaaaaattctacattaccgttctcttgagaaattctacatttggtttttgttcctcatcttatcatcctgcaataattctttgaaatccatttatcttactaattttaaaaaaaagggattagtgtctatttaaatcaaataattagtaataacctattgaataagtttgtgatagaaggtgttacattgtttcagtctacctgccattgaacaaaataatgccaataatttacttaatcctattgaaatttaaattttgcaactctctttatagaaggataaagtttacaattgccctttatccatcttatagagatgatgcaaagttaaattatgcactaccatagtctgttttcgcagttataatgaaatacctcagactgggtaatttaggataaacagttcacagttctggaggctgggaaggtgctaatatccagcaaaggacctctgactgcgtcatctcgtgacagaaggcaaggggcgagatacagcaagagggggccgaattcaccttttatattgacaccaatcccacccatgagggtggaactctcatagcctcatcacttcttaaagtttccacctgttaatactgatatagtggcaattaaatttcaacacgcattttggagggacaaacattcaaatcatagcacgtgcctttcaagcgttttgaggtattcagaaaatggcaagatactagaagtattttaatgtgttcctaaaacattaaacctaaaacagacttatatctaccttcagctctaaaaatctgggccttcaagatttttccaagtgttaagcaggtggaccccaaaagtgaggcacaaacttcacattatccaaacacatgacaacgtttaatatcacagtatttaaatgctactctaatgaatgtgtgaagattttctaatctggtaattcaccgaacttttaggaaccatgacttttcctaaagccatgacctggttttcttctgaactacatgctattctgtatataatgctccacatgtttacaattgctccaagtgatcaattcattaattctcaaacaaatgacatcaatctttttttcacatgtaaagaaacaaaggcagaaagagaaagaataggccatttccctttaatctgcaatcgctcaccagaaagatttagtttgcataaacacattcaagaaaataagcgaaaataaattttaaaagaagtacataggaaatgacaacgtaaggaaaatgggaaagggaagagagaaccaggagttaggctagaatgctgtcctatcttgtgcattgccaactctggagagatccaataatcagtccaaggtaccacacaggctagacctgaactcctgggctcaagctatcctcctgcctaagcctccaagtaactaggactacagtcgcacacagtcagaactagcttgttggacttatttttgtcaaagaatagtatcataatctttgtgcctctcttgattgagaagaaattctcccagagcagaactgtcctatagaactttctgcaatgatacaatcttttctatcagcaccatttaatatggtagccactggccacacgtggctgttgagcagttgaaatgtgtttagtgcaagagaaagacttaatttttaatttgattttaattacttaagtagtcaaatgtggctactggttaccatatttcatagtgcagttctgatacatatgtacagcaaatcacagcaaatcaatttctctcacagtagtatctctctcagttactcagtttcctaactttgacagaactatttatcatatgatgtatattttcacctgaatacttccatatgagtctctattttattccagagaatttttccgattacagacttagtgtacttttggccagtgagttgtgtgggttattgctaagcatggcattggacgtgctcggatgcttgtcttcattcattcctgaaagcagtcttattctctaaaactatccatcattcttactcttctctctcatcccagctgacatgccactttcaaataggtatattttctctggtttcctgcttttctgatatagctgtggatacatggagagtgtaataaacgggttgtccagaaaggagcttctgtagtcactgggcagtagatatcagcatcagcaatagatctatttaataaaataagtaaatatatatccccactatatggaagagtataatacataaaagcatgtaatataacaaattttatgcaccaataattttttacagtattcagaaaagtttctacatagtaactataaactacatattaaaaattgttttctggtcattgctataatgtacacacacattccaattgacacacagaaaaaagaagttactttctttaaactgcaagggaaatatcaaaataacatcacgaaacatttcataatatcctagagatagtatctcttacatttcaaaactgctttaactcatatggggctccagttcatcagaaacaggacttgatacaaaaaggcatggcatgaatgataattactgctttgggtacaaatctgcacacattacatgcaagatccaatataagtcaacttctcacagcaatcaatttttcaaaaggaagggtacaaccaatgtttattttatgttaaggagaggaaatcaaacaaaaggggaaaaagtgagatgaaaattcttatgctccagttgagtttttccttgggagcactgaacagattttaggaaatttagcctaattttgctatggcaacagttataacacttgagaccacagtccaggagaagcgcagcatttattctcttattgcagcactttgatcctttccgagtctaacttaaaagccatagtttttaatgcaaatgagaatacatacattgagattcgggaataattagaatatttatatttgtaataaatccaatggaagctcttttgtgacatgaagcttactcagtggttagggggttaatgaatgaaatggatcactggactgaaaataaaaatcactatttaaaacgaaggcgacaccaggagaattaggcactacataatactgtaaccacggagaattctcaacagtaaaataaagccctgtagtcccagcattttcattacttttccagtagtgctggatgcagtgtgaatttcaatgaggtgggaaacagtggctgctccctttaaagaacatataccacacagaggaaagaacatataccatataccacagagaggagaagcactccttcaattcacacagtgatgaacatattccacagagaggagaagcactccttcaatccacactgtgatgaacatataccacacagaggagaagcgctcctcaattcacactgtgatgaacatataccacacagaggagaagcactccttcaattcacacagtgatgaacatattccacacagaggagaagcactccttcaatccacactgtgatgaacatataccacacagaggagaagcactccttcaattcacacagtgatgaacatattccacacagaggagaagcactccttcaatccacactgtgatgaatatataccacacagagaagaagcgctccttcaattcacactgtgatgaacatataccacacaggggagaagcgctcctcaattcacactgtgatgaacatataccacacagaggagaagcactcctcaattcacactgtgatgaacatataccacacagaggagaagcactcctcaattcacactgtgatgaacatataccacgcagaggagaagcgctccttcaattcacactgtgatgaacatataccacacaggggagaagcactccttcaattcacactgtgatgaacatataccacacagaggagaagcactccttcaatccacactgtgatgaacatattccacacagaggagaaacgctccttcaattcacactgtgatgaacatataccacacagaggagaagcactccttcaattcacactgtgatgaacatataccacacagaggagaagcactccttcaatccacactgtgatgaatatataccacacagaggagaagcgctcctcaattcacactgtgatgaacatataccacacagaggagaagcgctccccaattcacactgtgatgaacatataccacacagaggagaagcactccccaattcacactgtgatgaacatataccacacagaggagaagcactccttcaatccacactgtgatgaacatataccacacagaggagaagcactcctcaattcacactgtgatgaacatataccacacagaggagaagcactccttcaatccacacagtgatgaacatataccacacagaggagaagcactcctcaattcacactgtgatgaacatataccacacagaggagaagcactcctcaattcacactgtgatgaacatataccacacagaggagaagcactccttcaattcacactgtgatgaacatataccacacagaggagaagcactcctcaattcacactgtgatgaacatataccacgcagaggagaaacgctccttcaattcacactgtgatgaacatataccacacagaggagaagcactccttcaatccacacagtgatgaacatataccacacagaggagaagcactcctcaattcacactgtgatgaacatataccacgcagaggagaaacgctccttcaattcacactgtgatgaacatataccacacagaggagaagcactccttcaattcacactgtgatgaacatataccacacagaggagaagcactccttcaatccacactgtgatgaacatataccacacagaggagaagcactccttcaattcacactgtgatgaacatataccacacagaggagaagcactccttcaatccacactgtgatgaatatataccacacagaggagaagcactcctcaattcacactgtgatgaacatataccacacagaggagaagcgctccttcaattcacactgtgatgaacatataccacacagaggagaagcactcctcaattcacactgtgatgaacatacaccagaggagaagtgctccttccactcacactgtgatgaacatgtaccacatggaggagaagcactccttcagttcatactgtgatgaacatataccacacagaggagaagcacttcttccattcacactgtgatgaacatataccatgcagagaagtactccttccgttaacaccatgatgactatatactgtacagagaagcactccttcagttcacactgtgatgaatatacaccgtatagaggagaagcactccttcaattcacactgtgatgaatatataccgtataggggagaagcactccttcaattcacactgtgatggctattggcctatccatgccactatgtagtttacattttagtatcttaaaatatttcatataatagaatattgcatttaacttgcaagaaaggctaaacacctagcataacaaaccatggtgcactgtaaatgttaatttaaaaataatatatacaaatcagttacagcttagacaagaaacctctttgactacacaatttggaactagaattatatattatatttaaatgtatctctttaaaccaattcaaaagcaacatagagagactaaaacctgtactgaagaaggaaaatcaggtcattacccatgagattgcttcagttcaaaaagagaaagcaggagtaggtgtgaaaatgcacagattactgaaaagtggaatgtggcgttaaatcaaatcttacaacatggaatcacgttttactttgcattaggttcctatgctcctagtatcaaaactaggaggtcctttgagctactaacttagtaaaaactaaaagtcaaacatttcactaatagacctgcctctaagtataaggttgaggcagaagatatacaatcatagaagaaaagacaggagttaataccgctttccccactgtaactggaaagtgtcataaatcctacattagtttctcacctaacctccctatatttagtcattccagtgccccaaaattgaagaattagtctcaatttctactggaatataaataacacatcagcttctagccagataattacgtccttcctgaatatgttgcaaaagtgttattcattgtggagaatgcagaattataaaatacaacccgactctcaaattacttataatctggttaggaatacctaactataaaaataaacacagttgtgggtctcagctgggcaacagtcaggctctgcaggatgtctagatagacaggtaggtagacagacaaaaagacatgtatggtgagccacctccagctcacaggcagtatcagactcacagtagtaccaactcaaaacagaccttcccctccgcagcattccgcatgccccacattatgctagaacctctatttgaatttttcttctagagcaaattcctagcctctcctctaggaaggggagggctggggaaagagcccttggggtcttttcaaggggttcactgaccctacaagctctaagctctctctacagctgtgctgtccaatatggaaatcatgagccactgagtggctactgggcacttgaaatatggctagtgcaactgagaaactgaattttttatttaatttaatgaacttaaacagccacatatggctaatgactacaatactagaaacaagatataaaacatttccatcatcacagaaagcactactctacagagtaaagacttattataattggatatatacattcctgaaaaatgtggtatataaaatattataacttgagggctcataaggcagaacactcaaactctatacagtattataaccaaatccctaaaaagtaagaatcccaacttttaaaactagcgtgatttttaaaagacatttaattcttaataaagaaatattatgataaataagtatacatttaattatttatttatggataaatgaatgaatgaaatgaatgacagggtctcacaatgttgccgaggctggcatgccgtggcgcaataatagctcactgcagcctcaacctcctgggctcaggcaatcctcccgcctcagcctcccagtagctgggattatagacacatcccaccacacctggctaactttttttatttaattaattaatttatttattttttgagatggagtctcactctgtcgcccaggctggagtgcagtggtgcgatctcggctcactgcaagctctgcctcctgggttcacgccattctcctgcctcagcctcctgagcagctgggactacagaggcctgccaccacgcctggttaattttttgtatttttagtagagacagggtttcactgtgttagccaggatggtctcgatctcctgacctcgtgatccacccacctcggcctcccaaagtttttttatttttctgcagaggcggcatctccctatgttgcccaggcttgtctcaaactctggggctaaagtgatctacccacctcagcctcccaaagtgctgggactacaggtgtgagccaccatgcccagccaaccatacatttaaaggttaaagtagcttgaaagaaggctgtaagaaaggtatctaaattctgaaaatgcacaaagactgggaatactatggccaaaccaagcgagagacaagaggtctcgggctcactgtttctccattcctccaccttgctgggctgtgctggcgtttactgcactttgggtttagctgctaccacttgatgaagaaaaccattaatacatcaagaaaaaccacttaataaaccaaagagacgaccacattaactcaatagcatccccccacttgtcaattctatgtgaattaattcttgtcatagaaacatgagtaggcgcagaaaggacttcatttggcagacaggttctctgtgtgtgttccctcatactccccgatataactggtcgcagctccattcccatctcagtctatcaaaaaaactatgcctgctgctcaaggcttttctcaactgataccttccctttattaagcctttcctgaccatcgcctccaaccaagatatgaggaacacagacttttttctcctaaagatatttttactcacacttcacattaaatttaacacatacttatggttgttgttctattactgttattactagaggtagcttaggagggctgctggaaattcaagggggaaagctaaaacttcccagggctttgtaacatctcttcagactggattttagtcctaattctgccaccagcttcctggttaatctcagtaagtcactccctccccgtttctgggctttaaacaaactcatttttcaaaatatctttattattgtaacttttgaatgacattttaaaagtccctgtaaacctctagtatgcacagaactttaaaaagctgaagtgagaatagccttctagactttttgccacatgaatatatacaaacataaaagcattttacactgaattagaccatgccatccgtatcgtactgtgacttagtttactgtattcacttaaaacttgatttcagtacacaaagaaatctcctgcagttgttttacctgctgcattattagaaaaaaatataatttaacaatcccccattgattaaattaccctttaaatgtttaagcttttcttaaaactaggaaagtaatacatgcatttttttaagtattgaaaattttcctttccctaatacactctatcttgggtgataaaattttctaaagagtatcttctgttttttcatttttctcatagataccactggggtttctttctctttttttaagacaaggtctggctctgttgaccaggatgaagtgcagtggcacgatctcggctcactgcagcctcaacctcccgggctcaagcaatcctcacacctcagcctcctgagtagttgttttttgttgatgttcttgagatgggtatcattgtgttacccaggctgcactcgaactcctgagctcaagcaatctgcccgcctgagcttccgaaagtgctgtgattacaggagtgtgccaccacacctggccaggtttcaacgatgcattcctatatttacttcttgacttttgttacagcattattttacactgtcagtgattatttttaattcattaaattctattccataaatagatcccagtcctctgtgctttctcagttgatttttggagacagatagtcaacaggcagcattcacaatattataattatatatctattactcactgtagaactaagtattgtggaacagctccacaggggaggaaatgcaatcttatgccattcaacttctcctgtttgaaacaaaatatcccaagagtcaagcagatttcattttcgtttttttgcttttctttactttacctgcaattctttcttacatctcagattatcttctttcttggattcttctaccatttcattgcagaaactccttacatatattatttcatataagaagcctagataattagataaaaaatagcttatatccatgcatatttgagtatctttctatcactgccttcttacttaacaaatagttttggctacatgagatttttggttcaaagttattttctttgtttggtttttttttttttttttgagggaaattactttttacttcagtgcaatttactggagagacgaactgtgcaagtagagatgcctgatgagcgtcacacaacgttttcggtggatagtcacgacacttgagcccaccacgaaagcaacgggaggcagctgcaatattccagcaggacagtgtgtactacagtgagttttaagcagttatgattttttaaattatactttaagttctaaggtacatgtgcacaacgtgcaggtttgttacatatgtatacatgtgccatgttggtgtgctgcacccattaactcatcatttacattaggtatatgtcctaatgctatccctcccctctacccccaccccatgacaggccctggtgtgtgatgttccccaccctgtgtccaagtgttctcattgttcaattcccacctatgagtgagaacatgtggtgtttgattttctgtccttgcggtagtttgctaagaatgatggtttccagcttcatccatgtccctacaaaggacatgaactcatcattttttatggctgcatagtattccatggcgtatatgtgccacattttcttaatccagtctatggacacttgggttgattccaagtctttgctattgtgaatactgccgcaataaacatacgtgtgcatgtgtctttatagcagcatgatttatactcctttgggtatatacccagtaatgggatggctgggtcaaatagtatttctagttctagatccttgaggaatagtcacactgtcttccacaatggttgaactagtttacagtcccaccaacagtgtaaaagtgttcgtatttctccacatcttctccagcacctgttgtttcctgactttttaatgatcgccattctaactggtgtgagatggtatctcattgtggttttgatttgcatttctctgatggccagtgatgatgagcactttttatgtgtctgttggctgcataaatgtcttcttttgagaagcgtctgttcatatcctttgccaactttttgatgaggttgtttgatttttttttgtaaatttgtttaagttctttatagtttctggatatcagccctttgtcagatgagtagattgtaaaaattttctcccattctgtaggttgcctgttcactctgatagtaggttcttttgctatgcagaagctctttagtttaattcgaacccatttgtctactttggcttttgtttccattgcttttgctgttttagtcatgaagtccttgcccctccctaggtcctgaatggtattgcctaggttttcttctagggtttttgtggttttaggtctaacatttaagtctttaatccatcttgaattaatttttgtataaggtgtaaggaaaggatccagttttagctttctacatgtggctagtcacttttgccagcaacatttattaaatagggaatctttcccccatttcttgtttttgtcaggtgtgtcaaagatcagatggttgtagatgtgtggtattctttctgagggctctgttctgttccattgatctatatctctgttttggtaccaggaccatgctgttttggttactgtagccttgtagtatagtttgaagtcaggtagcatgatgcctccagctttgttcttttggcttaggattgtcttggcaataagggctcttttttggttccatatgaactttaaagtagttttttccaattctgtgaagaaagtcattggtagcttgatggcaatagcattgaatctacaaattaccttgggctgtatggccattttcatgatattgattcttcctatccatgagcatggaatgttcttccacttgtttgtgtcctcttttatttcattgagcagtggtttgtggttcgccttgaacaggtccttcacattccttgtaagttggattcctaggtattttattctctttgaagcaattttgaatgggagatcactcatgatttggctctctgtttgtctgttattggagtataagaatgcttgtgatttttgcacatcgattttgtatcctgagactttgctgaagttgcttatgagcttaaggagattttggactgagacaatggggttttctaaatatacactcatgtcatctgctaacagggacaatttgacttcctcttttcctaactgaataccctttctttctttctcctgcctgattgccctggccagaatttccaacactatgttgaacaggagtggtgagagagggcatccctgtcttgtgccagttttcaaagggaatgcttccagtttttgcccattcagtatgatactggctgtgggtttgtcataaacagttcttattatttagagatacgtcacatcaatgcctagtttattgagaatttttagcatgaagggctgatgaattttgtcgaaggccttttctgcatctattgagataatcatatggcttttgcctttggttctgtttatatgatggattatgtttattgatttgcgtatgttgaaccagccttgcatcccagggatgaagccaacttgatcgtagtggataagctttttgatgtgctgctggattcggtttgccagtattttattgaggatttctgcatcaatattcatcatggatattggtctaaaattatcttttttttgttgtgtctctgccaggctttggtatcaggatgatgatggcctcataaaatgagttagggaggattccctctttttctattgattggaatagtttcagaaggaatggtaacagctcctctttgtacctctggtagaattcagctgtgaatccatctggtcctgaacttttttggttggtaagctattaattattgcctcaatttcagagcctgttattggtctattcagagattcaacttcttcctggtttagtcttgggagagtgtatctgtcgaggaatttatccattttttctagattttctagtttatttgcatagaggtgtttatagtattctctgatggtagtttgcatttctgtggggtcagtggtgataccccctttatcattttttattgcatctatttgattcttctctctattcttcattagtcttgctagcggtctatcaattttgttgatctttccaaaaaaccggctcctggattcattgatttttgaagggttttttttgtgtctctatttccttcagttcttctctgatcttagttatttcttgccttctgctagcttttgaatgtgtttgctcttgcttctctagttcttttaattgtgatgttagggtgtcaattttagatctttcctgctttctcttgtgggcacttaatgctctaaatttccctctacacactgctttaaatgtgtcccagagattctggcatgttgtgtcttcgttctcatcagtttcaaagaacatctttatttctgccttcatttcgttatgtacccagtagtcattcaggaacaggttgttcagtttccatgtagttgagcggttttgagtgagtttcttaatcctgagttctaatttgattgcactatggtctgagagacagtttgttataatttatgttcttttatatttgctgaggagtgctttactgagaccatcgatgctaggaagaaactgcatcaactaatgagcaaaataaccagctaacatcataatgacaggatcaaattcacacataacaatattaaccttaaatgtaaatgggctaaatgctccaattaaaagacacagactggcaaattggataaagagtcaagacccatcagtgtgctgtatttaggagacctatctcatgtacagagagacatacataggctcaaaataaagatatggaggaagatctaccaagcaaatggaaaacaaaaaaaaagcaggggttgcaatcctagtctctgataaaacagactttaaagcaacaaagatcaaaagagacaaagaaggccattacataatggtaaagggatcagttcaacaagaagagctaactatcctaaatatatatatgcacccaatacagaagcacccagattaataaagtaagtccttagagacctacaaagagacttagactcccacacaataataatgggagacattaacgccccactgtcaacattagacagatcaatgagacagaaagttaacaaacatatccaggacttgaactcagctctgcaccaagtggacctaatagacatctacagaactctgcaccccaaatcaacagaatatacattcttctcagcaccacatcgcacttattcaaagttatttatctttcagaactttgaaagtactgttccgtgatcttctagaattaaatgctgcatatgagaaatgtgattttagtccagttcctgcatgttttgtcacttattttttccctctaggggaatatgttggtatatatatattttctatggagttctaaaattttactaggaataattgagtttttgacttttttaaatcatgtgattcaacacatagtgagccctttctatctgaagaattataaggcttttttcagctttgtgaataatgtttttatcatttcattgactatttccacccctctatcttaactatcacctgcctctggaaatcctattagaaagacgttggtcttcacagatcttaacccccaagtttctaatttcccaaattatccattaatcagttatactgtacattatatatatgaatattctgggaggtttcctgaactttcctttcaaaaatcagtctttggctaaatctattctatttgttggcccatatatcaaatgttttgttatgaaatcattctaattcttggaaagagttttaactatttcaagattattttgaatcttactttgaaagtttggtgtagaaagaattcttacttgatggactaagaacacaagagattgagagttaagattagaaagaaataacattctacacgttttgtaaaaggtggggattttttccttatttttaaaaaatgaataaaagccaaccaatctttgttgggcatggtggcaaatgtctatagtcccagctacttgggagacatatatgtgtatatacatatatatacacgtatatatgtacatatatgtgtatatatatattttaacatgggactcatatatatatatgagttaaaaaaacattttatttcattaatatctcttgtacatgggaaactgtcacaaagcagtttcttctctttttactatactctaaacatagactatatataaaagaggttagctatagttcctgagtcagctactcatcactcatttcccacacctaaaagaggccaaggacacttaaatgtaaattcattgtacttttcacctttttgagtgaccccattttataggtatcttggggctagctatttgcacatcagacttttccattctgaaatgctgactcaattcactagagagaaggattctacttgtgagtgtggaaaaaaaaaatcctgactttctagatcattttccctattcactttggataataccactttataaataggatttgatgcatgcaaagcagcaatctgaaaggaccggcagtatatactataagcacttattatagtatttgtaaatgccttattaatggcaaaatagctttgaaaccatccatgatatgtaccacagctaactcaatttgacagtgaaagatgctatgtcagtctgttatggcagatataaaacatgtaccatatgagtagatccttggcatatgttataaaaattacttttgctttatattttctagttgtgtaaaaagggacaagaagcactcctaacactgttttcattggactcttccacactgccttctgttgcctactataaacagttaaatatatcttcttttactatctggctacagcagttttctgtatataaaaatttttccactctactatgaattgggtttatatggactccatctaaacattattcatgaactattctgaatacataccaaatgataccccagtgatcttcaaaacgctgaagtttcaattttctttaattctgctatcaggccaggcaaagcattcatctcagtgaggcagcctgcctcttaggcatcattaatgttttagattttcataaattccactacggctaaatagaccaagaacctgaactccatagagttcctaaaagaattcagcagctactgcctttttttttttttttttttttagttttatttccaagatgaagtttaaaaataagaataaaaactggcaacaggccagacatggtggctgaggcgagcggatcacttgagcccaggagttgcagaccagcctggacaacatggcaagaccctgtctctagtaaaaacacaaacattagctaagtgtggtggcacatgcctgtaatcccagctattcaggaggctgaggcacgagaatctcttgaacctgggaagcagaggctgcagtcagccaagatcgtgccactgtactctagcctgggtgacagaacgagactctgtctccaaaaacaaacaaacaaaaaacagaaatactgggaataaaagtatttttgaaacatgtagatcctcttttattaagaaagaggcagacatctcacacttaggaaaatctcaacccttaaagagagaaatgaaatagaaattttacaaatcaaaacaaaagtaaaaaaaaatcaaaaataacagatttttatctaagaaattaaaatttcagatttaacgtggaaaatatctgaaaaatgttgtgattatgaataagccttatgacatttctgcatcacttcctgacttatagacctatttctctaaattgatattcattctacaccaatgaaccactaaaggccttgttcatcaagattccagaggtgatttctattcatattttgctatgaatacaccaaactgtatgaaaagttagtttttttccatttctgtaaatataagtttaataaaatacaaccacagataacacaccaggccaatgtctcagtcaattaccaacttagccatgttttcctatccaaaaaattcatttgtttttggtgacagtggtgatgaaatcatttatttacttatttttcatttggttttcatgaaatacttgttccagtttgttccatgtaggttttgagaaagattacagtattttgttgttctaataaactgagacattcagttctatcagacaacgatcttacttttattctagctgccagaaaagtcacagctaaagttgacattcaattatggtggctttctttagttaaaaaaattaataaaacgttcttctcttcccctttactacctaacttttgcctttgttcttacggtatgatccttgatcttactgtatctgtagttttattttaagtaagaagtgaggactctggacattgctctagttgttcaaatgagattctatgtggattgtaaaaatatatttttctactggaaagtaagtctatttgagtagctagggctcctgttgtaatagaaagggtaccaatcccaagtaatatgatttctaaaatgaagtcattatcataagtggagtatattatttcaagtgagtaaaacttttgaagagtgaattgttcatattctgggttatgtatgcatttgttacggtcaaggaagcttgaagcttcaaattcataaataaattacatcaaatgcaataagaataccacctactggacactttataatatgcattaatagtatatttatgactttatttaatttctaaaatggccctatgaagttatttttagaattttcattttacctatgtggaaactgagccacatagaagatgcccaaataacagtatttctgcagaaatcaaaacccaatttgcctgactctaacatttacactatatatattttatacatatatactatatatatatgtaacacatatattacactgtttaatataattacagtctcacatagggatgaattcgattattcagataattaaaatgttttttaaaagaaaataatattcagcatatttcttcgttagttatatgttaaaatacgaagatacacatcaaactactaaatcaactaagactaaatgctcttttgtatataactcccttattagacctgaatgttacagaattgtaaacttaatttggcagctgatctgaatccaggtcgctactctgtagtcagctgtgttgtatgactctgcactgagacccagaggaaccacaatgaaaaattagctgctcagtataacgaattgccagatgctggactcaagtaggtaatgacatttgaaagcatgtgtgcaagtacagaagaaaattctgaggtcccagatctcaaattttatgtgttataagcaaaatgctaaaatctcaagttccatttttaaaaattaattaaataattatttataacgtgtgtctaggcaaccacacattcaacagactaccaggacagattttgcctctagcactgtggtttaagaaagagaaggataactctctctctctctctctctctatatatatatatatatatattttttaacatgggactcatatatatatatatacacacgagttaaaaacattttatttcattaatatctcttgtgcgtgggaaactgtcacaaagcagtttcttctcttttttccgcactctgaacatagactatatataagagaggctagctgcggctcctgagtcagctactcatcactcatttcccacacctaaaagaggcctttttgtttggcaaaatgcttcccaaagtaaatagaaacgacagttaacactttttattttctagctaagagtcacctattgccttcaaaaaaataaattcttctagtagattacagaatttgctttgaaaaattttggtagacttttatccttaaaaaatccaggtagcaagagaacctggataagtactgcctggattagcgagcggttatgagcaaacgctatctgagaagtaagttttcatgagtgatgagaacataccctttcctgcttcgctgtccctcaccatcaaaatccctctcaccaccttgctgaaaccaaccgttgcagagattcattctattgatgtaaggttgggtctcaactgaaatagttaacaggcagagagcatatctcttttgaaactgtatttggagtaaaaggttcggatactgagccactgataaggtgtttggaggaaattgtttcataaaactgaaaagcaaccgtaagaaaataaggttggagccaatatgacaagaactgatgatgtaacgattctgcccagaatgttctgaccatgtcatcaaatcatgccctctaagcaatacaagacacacaagagaagtcttcacaaaacacacgctgggctctcacacactcattttcggattttgaagggatttcacaagatttcaaatctgcccagatcatctcaaaattgttcatttctaaacttgaaatgtctcccaacagagactttttggaaagtaatttgggcaggtcgtttgttcccattatcaattaccggtcagtatgtaagtagctctcttcccatgtcaaagctgcccctggccttcctcttgctcatgctctaattgtgttattagtcaggctccaaagtctgagtgtagctccatctaccacaccctctgggccagttatgcaaaagctctctgactttcctttttttttttttttttttttttgagatggagtctcgctctgtcgcccaggctggagtgcagtggtgcaatcttggctcactgcaagctctgtctcccgggttcacgccattgtcctgcctcagcctcccgagtagctgggaccacaggcgcccgccaccatgcccggctaatttttttttttttttttttttgtatttttactagagatggggtttcatcgtgttagccaggatggtctcaatctcctgacctcgtgacccgcgcgcctcagcctcccaaagtgctgggattacaggcatgagccaccgtgcccagccgctctctgacttcttttacctaattcacagtatttctctgagggtcaaataagatcaagaacaagatgcgaaaactacaaagtgcattttaaaataggtgattactgggatttttttttagtatttgatttttttatagtatgatcattgctttttgtttcttcatttgtttttgagacacagtctcactctgtcacccaggctggagcaaagtggtgcgatctctggctcattgcctcccaggtttaagtgattctcccgcctcagccttccaagtagctgggagtacaggcgcctgccaccacacctggctaatttttgtatttttagtagagacagggtttcaccatgttggccaggctggtcttgaactcctgaccttaagtgatccgcccacctcagcctcccaaagtgctgggattacaggcatgagccaccgtacctggcctgattattgatactccacacaaaacacagaaaatacaacacaaatatggaaactattaaacaattatttcaggttttaattcacaaaaatgcacccagtatggatcctagttttttgttttttttgtatttttttttgtaatttcctaaatgtactgggataaaatatttctgaaaaaataagctctataaaaattttcaattaaggttatatttgatcatcatagtagtacagcccaacaaaacagttttacctaaagtaacatgaaaaatataatttctgtttcacccttaaaaaatgtgtgtttgtatttatgtacttccaaaactttttcttatcaactaataagatcaggtcacgttaagtctattgatctcacctttcactgtaatatctgctttggcaactgttccttagatacaatgttctccaaactcaaaagttatttccccactggataggtgattttgtactgtttatattaaactttatctcttttcttctaagagcagctcccccaggtagtcaagtctgttccatgttagcttactttcaaattaagtcaccttctggcatgacacaattatagagcacattaataactgcaggcacctgcagaataaattcaaacgcattcctttccctccccctctcttgatatatacctgcaaaactgtctaaaaattctataaaatctaaaactcaaaaatggtcttctctatattcctgtgttcctccttactgatactaggttctaatactctgtcttctaaaacctggcaacactatctaatctattctcaccctgtgatgactgtgactgctgaaacctcattttcatagtccaacattcaaatcttcaattgttgcttgacaaactcagttatcatggaatagctacctgaagaaaacagctgaattcagtacactattttcagtgactgcaaaactataatacacaatacagatatttttcacataaactaggtgtaaaaatacaatgttcacacttcatatgagaatattttatttctagaaataaatcttcaccagtccaaacacgtaagtttacagaaagtcagtaagaaatcattatatttatatagcaccttgaccactacaaaagctgctcactgataatatcagaaataatcaataggcttataacactgccaaaatggtagcagagtatcgtgtgtctattgagtctgaaattaaattgcaatttaaggtccatctcttaaagctatattcatgtatttagaactctatcaaacaaaacaagaaaaaaattactttgacgtacatcttttaaagatgaatatgaaactttggacaataaatactactctcccgaatcaacttttaaagtgcaaccatcttttaatgatagttaactgctttaagaaagcaataaactaaaatgtaaacctgaaagcccactatcttaagctcttttaaaaattaaatacaccagcaacattttgagactcaaaattaatttacttcactcaatcctatgcataagtttggcaatttgtttcagatgctattttttctgtaatttttgtgggtacatagtaggtgtatatatttatgggctatataagatgttttgatacaggcatgtaatgtgaaacaagcacatcaacaagaatggggtatccatcccctaaaacatttgtcctttgggctacatgtcatttcctaatgtaaagaaaatggacagacagaaccaacattgatttgactgggtgaaaaagtccatttgagttgggagcaggggttgtgttcctggatttgggttgttaggacagtataaaaaggcttcacaggggaacattcttttctgataaaggaaagcagctgggttggcttcaaatagcagtgactttacttggaatattcacaggtaagctgcaaatataaaacaccttccacagagtgttattttgtaatcggggcttatctcaagtgcaagaacctccagcctacagctttagtaggtgcctcagacactgtgcccggctttagtaggtgcctcggacactgtgcccggctttagtaggtgcctcggacactgtgcccggctttagtaggtgccgcggacactgcgcccggctttagtaggtgccgcggacactgtgcccggctttagtaggtgccgcggacactgtgcccggctttagtaggtgccgcggacactgtgcccggctttagtaggtgccgcggacactgtgcccggctttagtaggtgcctcggacactgtgcccggctttagtaggtgccgcggacactgtgcccggctttagtaggtgcctcggacactgtgcccggctttagtaggtgccgcggacactgtgcccggctttagtaggtgccgcggacactgtgcccggctttagtaggtgccgcggacactgtgcccggctttagtaggtgcctcggacactgtgcccggctttagtacgtgcctcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgcctcggacactgtgcccggctttagtaggtgccgcggacactgtgcccggctttagtaggtgcctcggacactgtgcccggctttagtaggtgccgcggacactgcgcccggctttagtaggtgcctcggacactgtgcccggctttagtaggtgcctcaaacactgtgcccacgtactctgaatggcgtatacacaatgataataaaagataacacagtgtttgctaagtgccaggtacaactacaggtaccgtaccagatagaaactgttattataaccatttgacagataaaaacactaaagcacacggagatgagtgaatttgcccaaggtcacatagacagtaagcagtatgaagaaacatatgtataactgcactgactctaaaatattataaatttattctgttaaaggtttctgtttaaaaaaaaatccatgtatttattaaaagtagcttttttctcagattcacttatagcaagactttattacatattaacttatcactgggtacaaaccacctggttctaaagacgtctgtcctgattactgtagggactgttatatatgaggcagaggcatcttttcattattattatttcccaaaacctatagaatttgtgtatagcagttatagactatgtctgaaatagttatattcacataacacttaataatcacatttaagtattcactaacagaacaaagcctgttactatggtaaataaatacacacagttctatcacagagcacagaagtcatcaaacagataatattttcttcattacacactgaaacttgtgacccgctaacagcataaaataatgtttaatatttaataccatgtgatggcaatactcaaccaaacatgtatttcaaatgatatgttatttgacatttcaatttcagctcaaaagtacttctaaaaaggatgaaaatatgtgcctgaaactgatagtttgaatttaataaatttttctgggattgttgtgttttgaactttaattttagaaccaagggggtacatgcgcaggtttgttaccagggtatattacatgatgctgaggtttggggtacaaatgagcccatcacccaggtagtgaacacagtttccaccagttaggttttcaacccttgctccctccctccaacctcgagcagtcctcagtttctgctgttgccatctttatgtccatgagtacccaatgtttagctcccacttctaagtgagaacatgcggtattggttttttgttcccgtattaattcacttagaataatgacctccagctgcatccaggttgctgcaaaggacatgattttgttctttcttaaggccacattgtattctgtggtgtatatgtaccacattttcttcatccagtctactgttgctaggcacctaggatgataccacatctctgctattgtgaatagtgcagcaatgattcttccaatccatgagcatggaatgtctttctacttgtttgcgtcatttctgatttctttcagcagtgttttctagttcttgtaaaaatgttttacttccttggttggatgtattcctaggtgttgtaggtgtgtatatctactgcaaatgagactggattcattatttggctctcagcttgaacgttattggtgcatagaaacgctattgatttctgcacacagcgatgaacatgcaactatatgtctttttggtagaattatttgttctcttttggatatgtatccattaatgggactgctggatcgaatggtagttctgctttaagctccttgagaaacctccaatggcgttccacagtggctgaactaggtttatattcccatccacataagtactcccttttctctttttctctgctgcctcaccaaaatctgttgttttttacttcttaataataggcattctattaaaaaaactttgtcagatgtgtagtttgccaacattttctctcattctgtagactgtacactctgttgatagtttcttttgatgtgcagaagttctttggtttaattaggtcccaccagtcaatttttacttttgttgcaactgcttttaaggacttagccataaattatttgccaaagtctatgtccagaatggtgtttcctagcttcttatagtttcagatcttaaacttaaatcttttccccatcttgagttaatttttatataagatgaaaggtaagggtccagttccattcttctgcctatggctggcaagttgccccagcaccatttattgacagggagtcctttcctcattgcttatttttgtctactttatcaaagatcagatggctgtaggtgtatggctttattttggggttctccactctgttccactggtctatgtgtctgtttttgtaccaggaccatgctgttttggttattgtacccttatagtatagtttgaagtcaggtaatgtgatgcctctggctttgggctttttgcttaggattgctttggctacttggactcttttttggttctatgttaattttagcatacttccaattctgtgaaaaatgacactggtagtttcataggaatagtgttgaatctgtagactgctatgggcagaatggccattttagtgatattgattcttccaatccatgagcatggaatgtctttccacttgtttgtgtcatttctgatttctttcagcagtgttttctaatccttgtaaaaatgttttacttccttggttagatgtattcctaggtgttgtgcatgtgtatctctactgcaaatgagactggattcattatttggctctcagtttgaacgttattggtgtataaaaacgttactgatttctgcacacttattttgcatctgaaactttactgaagtcattgatcagtttcaggagccttttggtggagtctttgggactttacaggtatataatcatatcacttgcaaagagaaatagtttcacttcttcttttcctaattggatgccttttctttttttcacttgactgactgctccagctagcacttccaggactatgttgaataggagtggtaagagtgggcttccttgtcttgttccagttctcagggagaatgctcccagtttttgtccattcaggataatgttggctatgggtttgtcatagatggatcttattattttgatggatcttattatttgatggatcttattataataataattattattattattattttccttcaatgcctggtttcttgagggtttttatcatgaggggatttggggttttgtgaaaagctttctctgcatccattggggatgatcatatggtctttatttttaatactgtttatgtggtgaatcacacgttttgatttgcatatattgaatcaactttcatcccaggaatcaagcctacttgatcatggtaataaagtttttgatgtgctgttttatttggtttactagcatgttgttgtagatttttgggtttatactcatgagggatattggcttgtcattttcttttttgttattgtgtcttcaccaggttttggtatggaggtaacactggcttggtatagtttcaaaattggtagcagctcctatttgtacaatacatctggcagaatctggcagcgaatccatttgtctggggcattttttttttttttttctagttggtaggttttaaattactgattcaatgtcagaactcaatactgttctcttcagggtttcaatttcttcctgactcaatcttaagagattgtgtgtgtattagtcagggttctcttagagggacataactaataagatagatagatagatagatagatagatagatagatagatagatagatagatagatagatacacacacacatacatacatacatagatacatagatagatacatagatataaacgggagtttgttaagtattaacttacatgattacaaggtcccacaataggctgcaagctgaggagcaaggagagccagttcaagttccaaaattgaagaatttggagtctgatggtcgagggcaggaagcatccagcatgggagaaagatgtgggctgggaggctaggcctgtctccctttttcatgattttctgcctgttttatattccctgagagctgattagatggtgcccaccagataagggtggatctgccttccccagcccactgactcaaatgttaatctcttttggcaacaccctcacagacacacccaggattaatgctttgtatccttcaatccaatcaagttcacacttagtattaaccatcacagtgtgtttccaggaattcatccatttcctctagattttctagtttgtgtgcatagaggtgttcataatagtctctgaggatcttttgtgtttctgtgggatcggttgtaatgtcacttttgtcacttctaattgtgcttatttgaacttcttttttgttaatctagctaatggtctatcaatcttgtgtatcctttcaaataaccaatttttagttttgttgattatattaatttctgggtctcaatttcattcagctctgctcttattttagttatttctctttttctgctagctttgaaatgtttgttcttgtttttctagttcctttaggtgtagtattaaatcattaaattgggatctttctaacttcctgcggtaggtatttagcactataaaatttcctcttaacactacttttgctgcatcccagaggttttggtacctgtgcctctgttttcatttatttaaattttttttatttctgccttaatttcattgtttacacaaaagtcattcaggagcaagttgtataatttccatgtaactgtggttttgagtcctttaaggtactgatttctatttttattccactgtggtcttagaatatggttgctatgatttagattttttcaaatttattgaaacttgctttatggctgaacatgtggtcaatcctggagtatgttccaggtgcagatgagaagaatgtatgttctgtggttgatgagtgaagtgttctgtagatgcctattaagtccaattggtcaagtgtttactttaagtccagaatttctttgttcgttttctgcctcagtgatctaatagtgacagtggggtgttgaatttccccactattattgtgtggttgtctaagtcttttcctaggtcttgttttatcaatgtggctactccaatattgggtacatatatatttaggacaattaaatcctcttgttgaattgaatcctctatcattatgtaatgcctttctttgtccttttttactgttgttggtttaaagtttgttttatctgatgtaagaatagcaagccctgctcttttttgttattcattactttgagcctgtaggtgttgttacctgtgagatgggtcacttgaagacagcagatgactgggtcttgttgttttatcaaacttgctactctgtgccctttaagtagactgtttagaccatttacaatcaaggttaatattcacatttgaggttttgaccctatcatgaaattgttagctggtggctttgtagtttctattatgcggttgctttatagggtctgtgggctatgtgcttaaggtgcttttgtggcagcagctgtttccatatttagaacttgatatggtttggatctgtgtccccaaaaactctcatgttaaattgtaatctccagtgttggaagtgggactgggtgggagggaggtgtcacaccacccttccctctcctgcttctgccttgtaagacggctgcccctcctttacctactggcatgagtaaaagttccttgaggcctctccaaaagtagatgctgccatgcttcctgtatagcttgcagaaccataagtcaattgaacttttcttataaattacccagtctcaggtatttcttttcttttttcgagacagagtctcactttgtcacccaggctagagtgcagtggtgcgatcttggctcactgcaacctctgcctcctgggttcaagcaattctcctgcctcagcctcccgagtagctgggattacaggtgtgcaccaccacgcctggctaatttttgtatttttagtagagatggggttttaccatgttggtcaggctggtctcaaactcctgacctcgtgatccgcccacctcggcctcccaaagtgctgggattacaggagtgagccaccatgcctggcctcacgtatttctttacagcaatgcaagagcacactaatacagaacacctttaaggaactcttgtgaggctggtctagtggtaacaaattcccttagtgcttgcttgtctggaaaaaaattttatttcttcttcatttatgaagcttcatttgacaggacatgaaactcttggttgcaatttcttttctttaaaaatgctgaaaatagcccccccaactcactttgcttgtaaagtttctgctgataagtctgctgttggcctgatagggctcctgttgtacaaaatctgacctttttctctagctgcctttaagatatttttctttagcaccgaccttgaacagtttggtgactatatgacttagtgatgttcattttgtatagtatctcacaggtgttctcaggatttcttgtaactggatgtctacctctctagcaagcttagggaaattttctttaattcctcaaatttgttttccaggttgcttatttttttccttctctctcagtaatgccaataatttgtagttttggtcactttacataatcccatatttctcaaagactgtttattttattaaattattttttcttcctttttgtctgactgggttaattcaaaagactgatcttcaagttctgaaattctttcttctacttggtccaaaccattaataaaactttgaattgtatttttaaatttcttaagtgagtttttcaattccagaactggttgatttctttttaagatatttatctcttccttcattccctggatagctttagaagcttctttgtgctgattttcagtcttgtcttggatctcattgagcttccttgcaattcatgctttgaattacttatctgtcatatctgagtttccattttggttaggaaccatttctggaaagcttgtgcaatcctttggtggtgttactacattcagatttttaatggtgccagtaatcttgtgctgattctttctcagctgaagatgctagcacttctaatttttgtaattattttcatgtaggtaggatgtttctttctcttttcttcctctataatgttactgggttttttttccttctctttccctttcccctgcttcctatgggtatgactacagattattttgggtaagatctatttgttttgcttctatctttgctctgcctttggttttgtttctaccagttcttctggtaggttttgtatcaggctgtgcagttcaatctacatgccagtagatgatgcttataggtaagagccagttgcagccaatgtagctggatacttgatccttgtttactggcagaagttctctgttgcctcagacaatgggctgatacatagaatgcatagtggtctgagctccctgctcagccccaagggcatggggccagactggtcaggtccacctaaaggtcccctgatacaggcacaagcaccagcactgacagagaatccaatgggtggctaccaagcacccagaggtatgcctaggcatggagctcctcagtatcaagttctctgcacaggaatgggaaacctcttcagcatcaacttctctacacaggaatgggggatgccctaaactccaaatccagaagagctctgcctaggtgtgtagtatagtgggctccccctgaaccaagatctctgcataaaaggggtagggtgactcgaactgctgaaccaggcaagcaggtgttctgaatacctggagatctgtctgggcatggagcagagagagtccccctatatgaggatctctgcacgggaaggatggagcagctcgggctactgacccaagtaagcttgtgctccaaatgcctgcagacctgcctgggcttagagcagagagggtcccactgtcccacaggaagagttgcgtggctcaggctgctgaaccagataagcaggtgctccaaatgcctggagatctgcctaggtgtaaagcagaaagggcctccctacaccaggatcttttttatccaccagacactgtcgcagaggttgtttgccagtgttctgctcaccaggatctgggtgtccctcacgattccagtggattcccattttccttttgttgttgttgttgttgttgttttttgtttgtttgtttcttttttgagacagagtcttgttctatcaccaggctggagtgcaatggcccgaccttggctcactgcaacctctgcctcccaagttcaagcgattctcctgcctcagcctcctgagtagctgggcctacagagctaatttttctatttttagtagagatggggtttcaccatgttggccaggatggtctcgatctcttgacctcgtgatccacccgcctcagcctcccaaagtgctagattaccaggcgtgagccactgcgcccagccccattttccttcttgaaaaaaagctcatacagtttatcttcatgcactatctagccatttccaagtggctgaggcatgctacaagcctcttatctgccatcttagagaaacaatctgcactttataaatggacaggtaaatctttgttgagagagaaaaaataaaggaaacagcttgtagagtgacccaagtacagtcctgaagctgctctcaaggaaagtaagaaaaatagcagcccaaaccctccccttagaaggaaggcttttcccacagagtctcgccttctggctggaagtcatctctttctgggttttgttgttgttgttgttgttgttgttgtttatttgagacggcgtctcactctgtcacccaggctggagtgcagtggcaccatctcagctcactgcaagctccgcctcctgggttcacaccattctccggcctcagcctcccaagtagctgggactacaggcgcccgccaccacgcctggctaattttttgtatttttagtagagctgggtttcaccgtgttagccaggatggtctcgatctcctgacctcaggatccaccctcctcagcctcccaaagtgctgggattacaagcatgagccaccgcacccagctctctttgttttttttttttaatgttaccttatagtcacagcattttatgctttaatgataattcacatttaattttagaaaacttttattttcttaaagatataatcgtttattatatttacatattgaatgttttcaatgacaataaatataggaaggtcatcaacaagacccatagaatttaaacaatcacacataaaataattggtgtagaagtcaaaattttttaaatggttagctcagaaaatacagaaagctcaagacacattactaaaacatgaactgaccttaacaaagaaaaacactgctttgtttctattatacttcaaaaaaaaacagtaataagaatttaaaaaaaaaatcagttctctgttgcatagaaggagaaatataccattttctctttctgtgaggaaaaagaggaaaatcatatttaaaacgaatgacattctgtacagatgggcataaacagcgccctctgtctcatgtacacacatccttttcttgtcactcagctttatttctggcaattcttaaatcggagaaaaaagttacaataaatctgtaagatccatattgtgtatagaagtaagtgaaaaataagctgttcaaattccaatacctactgatctccttctgtggccaaagtttctctgacatcattctgctgcttgtttattcttccatgctctcctattgttacagagggcaactaattttaaaaagtatttgacagtattaagcaataactttgtgccgattttctttttcacagaacagaattaaatttgagtgcagatgtgagtagatatagaagagtgtatgatatttttgtgtgtgtgttttctttgtagagtccaaaagccctgtggattgttagtgaagctcaggcagaataaagcaaatagaagaacaaggcaactgaagtctaacgatatggtggataagaatccgattttaaatcttgacattgcttgagaatgggaataatgtgttacttatttttcgcactatgactaacaattattaaacatctaatatgtaccaaacacagttctggacatattcccatatcttaactcgtttaatcttgacaacaatccttctgaggtaggttttattacccttcatttcagatgaggaaataaactcacagacattactaatttgggtgactcagacagacacagtttccattttgttcttcctttcagttaacatatatttcttatggactttctgcttgttccaggcactatgcttggcacagcgtctaccatttctctttctactaaaccatatagccggtctctgacacctagcacagtacctaggtcatattaggttctcaatgaagattcactgaattatttggttaatttacttgtctctataaaataaacatttacatagaaatttgggtccaggtttatattatcttaaaacatcttgtaattcaacactgttaaaacatgtattttaaaaatagtttttcaaaagagaaaatatttcattgattatagacatctaggaaacccaagtcaggtggcaaatacctgcactgaaaactaacagaatcatggaaaggaagcctgacacagcatgatgcacattctctcaactttgtatgtaaataaatcctacattctttaattgtctcaagaatgcgtgatttgaatacctaattctattacaaatatcacatgggaatggtcttccaatgttggtacatgtactcaaggcacaatgcatagtgttgaccaaaaagcaaaagcttaccatgaaaaaaggtaagtaatggatggattactttgtagtcagacatggataaggttgaatgttagctctgccatttactagctaccttattttgagggaagttatttcacttttctgaggctgtttctgtactataaaatacagataattctaacagcatctactgtgcactcagagattatggtgaggactaaatgacaggatgtatgtgacctgggcacatacccaggtcagagttagggctcattaacagttagctgtatattgaagtagaaaagttagggaggctgggaaataaattttctggtaggcatgaggtggagcagactacataatgatcaccttctttttactgtctaacctttaaagctccttagtatgcaggaaaatgcctgctcctgaatgagctgatcttcataccagcgtatttatctttcctaattcaaaaacagcctccttaaaacacaaacatactttttcatactgtcattcaaaatagctgcttatgatataacttaatagtaaaaatgggaaaattactgatttctttttgtacaattctatgtaccttcaacaaattatgccttttcattttcaaaggataataccaattccttccaaaggcatgatcaaacctaaatagtggttaatttgaacatttcttttaagtcccagaagaagaaattacgttaaccacttcttcatatcttaagtgaaaaatgtgtaagacagtaactgtcttaaataattacatttctgcttattaggtgtaattaatattttatccccaaattaagccaaaataattccttagatataagatgcctacacaaccaacaaatcaagcttttaatttctgagttctagccaaaaggccatattgcctaagaagagcagaaataaatgtttttttttttgttgcctttttaaaaactttgtaacctacatataaatagaaggaaactcagatttcgaatacagacttctgagggaaatcaaatgaatacaaaatttattgtatactaagcagtaactcttgtttattctatcacttgggactgtatattctttttaaattagtatatcaattgttctgaatataataattcaatacagtcatcttcctaagggtccattttaagcatcattcaaagcaagtagtagtaaaaaggaacaaagcataagccacagcagtgctaaaaatatggtaattgattaaaacaaaaacaattagctgggtgcaatggctcatacctataatcccagcattttgggaagccaaggtaggaggatggcttcagcccagaagttcacgaccagcctgggcaagatggtgagaccctgcatcttagaactgatgaaagacggtaacttttctatattttttcaatatgattttattctcacacatcaacaacattctaagatgtcttacaaagaatagcttttgtaatcccatggcctctaatgcaatacagtgctttatacacattctatgggaattgcaggtaccatctccatagcctaagagtatgcaatctgaaccaaatccttttctgtccacatcttgaagtgcttcttaaattcctaagatctaactagttacttctctattacctgttagtggctctgctatagaagaaaaggtgaaagtaaatatctacaaagaaagacagtggggatagtgacaacaataataaccactatttactaagtgctatgttctaaacactttacatggactttgttacttaatgtttgcaattctatgatgcatacagaatcagtcttattacgagatgaacaaatttagtttccaactgataattgtgaagaaataaaaaactacaggagagtgatttttaaatcaaaggtgcatatgaagagaagcatgctaatgaaataatcctgctagcttttcttttttgattttgtaaaatattaattgctcttgcactgttctttattgacaatggatcagactgaagcttctggtcagtgtatctttattatttttcgagacagggtctttctctgttgaccaggctggagtaccagggtgtgagcatagctcactgtaacctcaaacacctgggctcaagtgatcccacctcagcctcccaagtagctaggatgtgggagtatgccaacatacccagctaatttttgtattttttttttttgtaatagacagggtctcactttcttgtccatgcttgtcttgaactcctgacctcaagcaaacctccctccttggcctctcaaagtgctaggattataggcatgagccactatatccagttctgcttcgttttttttgttgttgttgtttgtttgtcttaagaaaaaattctcattttgtgaagtgtgagccaggagaaagagacaagaggctgactccagaaaaactgcagtcttcattcttaaaaagcacatctttcagggatgatagctattgggatattcacatgtcagcagctctcagtataaacaaaacaacaataaaaagtcagaaaatcagcaagaggaataaacatgtcagaaatattgtgggatccagtgaccatcacatgtcttaataatgagctcatcatccagcctgtatgagccttctcctgtgagagcatctttttgaaccaacggatcaacagaaaatactcccgcagtgcttgctttttaaagtaggattatatgaaagtaactgagaattactcccatctccttatattgacaatcttccagttaatgagaagatggattttctcctcaagctattgggtttgagaatcttctgttctgtgttagctaatctctcatgaatgtttttaacactgaaggtccttgtatttgctattacaaaaaagcaggtgcaactgagttccttccttagaattttgagctcgcaatcatttgttcaagatcccactaatctttttagttcttgtttgctgaacacctgattttaaaagggaaccccacaaatcccctttaaccactcttccatttgagtccatccttcatagtcatctactaaacattttgtttacaatgtatcaaaggttatgattcctaggaagtttggctttctttttttgtaaaaaacagggaaagaactctattgggaatgtcatgccctgtccatccatcccatctttttttaatcgggcaactttatattcatcctaccaggaccaactctaatgtccaaactgcgtgacagaattaacagttccttcctctgtattcctaaagtattttgttcacattattattattagagtattaatatattgagtatagaatgttttggtatgccgatagtgaagtcttattcatctttatatgttccaacggtacctggtacagagtagttactcagtaaaagtatgttgaataattttattaacgtgattccaaatccctaagtgataatcttatttaaggaaaatactataacactgaatactctctgaatagtctctgaaacagtaatgagaaatacaaaaatcagctgggcatggtggtgcacacctgtaatcccagctgctagggaggctgaggcaggagaattgcttaactgggacccgggaggtggaggttgcagtgagccgagattgcaccagtgcactccagccgaaagaaagacagaaagaaagagagaaagagagagagagaagagaaagatagagagagaaagaaagtaatgacagagaaaatactttttcgagtaaaacctcagaaaagaatatgatcccaagtaaaaaaaaaagtaaactgcgaaaataatatttttttccttttcttattcattttccacagcttcttaattctcttccattaaatcttattgaggcaattttatttatggatagttatatctagttttataagcctggcaaatatcttgccccaaagttacagaatatgtatctagtactggataatgcaaaattcactttgaaactttttattagaatatttgcttgcctaattaaagatggaatagagcaatattataataaatgtgcatagcctgaatacaaaggagctaagagataacggaatacatacatacttggccaaagaagacagaccacaattataaatatagcctagatatatacaaagcaaatggtcatgcattaacatattaattgaaggtgatgaactgaagttttatcaattaagaaaacactgcaagctatattctgggcccaattttaaaagtagaaaaaaaatggtattattttatggtttatgttatttatgtttattttatgttatttgattattcccagtccataggcacatccttaaaatttcatatgaacactttggggaaacattttaaagttttcatttgaacttactcctcgtcctcaaatgccagcaaactgttcctggtatatagaaaacagatcttatctaagaattcaccgtttacatgtgaaagcctttgcttagaattcctcctcctctcctgtctgcctgttgaaatcctgtcattctttaagggtcagacattgtgcttatatattgtcagaccacatcttctgagtctctcttgcagccccttcctggattacaactctaaggcagagactgcaccttaggtacgggagcatactgttgcatgctcaacaatatttgatgaattgaaagtaggcttttatcaattcataaacaaaatcaattattttaccaattccagctcatttcaacagatttctattcccaaagtctagggtcctttgtctttgttctgtcaatccctaaagaagcaagatcatttctgtcttttcctatgagcctgagagaggacaggcctcacacattcaccattcccaggtgtgcagtagtgtaaaaataattcacactgattccaaggtatcacttatcaattgggaattgtattgtcagaggcgtgtgaaccagaacaactccatcttgaacaggagctgggtaaaatgaagctgaggcctactgggctgcattcccagacaattaacgcattctaagtcacagcatgagatgggaggtcggcacaagataaaggtcataaagaccttgctgataaaacaggttgtaaagaagccggacaaatcagaccaaaagcaagatgtccatgagagtgacctctggtcgtcctcactgctacactcccaccagccccatgacagtttacaaatgccatggcaacatcaggaagttaccctatatgatctaaaaaggggaggcatgaataatccaccccttgtttagcatatcattaggaaataaccggccaggcgcagtggctcacgcctgtaaacccagcactttgggaggccaaggcaggcagatcacaaggtcaggagatccagaccatcctgaccaatatggtgaccccgtctctactaaaatacacaaaaaaaagacattagccgggcatggtggcacacacctgtagtcccagctacccgggaggctgaggcaggggaatagcttgaacctgggaggcggaggttgcagtcagccaagatctcgccactgcacaccagcctgagtgacagaacgagacaccatcaaaaaaagaaagaaaagagaagaggaaagaaaagaaaagaaaagaaagaaatgggcaaccagcagcccctagggctgctctgtctatggagtagccgttcttttattcctttactttcttaataaacttgctttcactgtgcaccatggactcgccctgaattctttctcgcgccagatccaagagccctcccttggggtcctgcaacactatcactgttaataaaatgatccaaacttcatcaccgttaacccaattaaccctaaagtagctgaagagtaaaaagttacaggttcccattactaaattagaatcagtaaagaataataagcacgtaactgaatctaattaataaataaaatctctcccttttccatcccactaaatgccagtaatcccactgtaatcccaccataccatctaaaatgtatgcttcaaggcccagggttaaggcccaactacatgaagcctcccagtttcctttgttttctctgaaactggctgataccaccctttccagatctcacactttagttagtagatcgactaacaacacagcaagagcctgtgttagtaactcaataaatactgaattgaacggcttctaagttatcactttataagaatgaatataatcttcttaacattatgacactgatattatgttctcatttttgacgttaggaaatggagggtcagaagattagctggtggtgatagaaccacgattagaatccttatctgtccaattcatactttcatactcttcccccatattccagtatgaccctggaatttattctgtcaaatattattgttttctttctgtttctttttttttcttttttttttttgtttttgttgttttgttttgttttgttttttgaggcaggctcttgttctgttgcccaggctacagtgcagtggtgcaatcacagctcaccgcaacctcaacctcccgagcccaagcaatcctcccacctcagccgtaagcagccgggactacaggcacatgccatcttgcctggctcattttaaaaaaaatcttttttgtagagaagctgtcttcctacgttgcccaggctggtctcaaactcttggactcaagtgatattcctgcctcagcctcccaaagtgctgggattccgggcgtgtaccaccacacccagcggtcaagtattattcctgagtgactttgtacatgaggtttaccttcccaagaaccatgttggttcctgaagaatgacctccaacaccagagacagagttttcaaattgaaatggtactcaagttggttaatttgaacagattgtctcttttgctaggtcattctcaattaagtcttggttgaataaattaataacattacgacaaacaaggattaacttcagaccctaccctcttaatccctgaaagaactggacattatagccctacccataggaagacagtgatagaattttctttaaaactatatataacatattatatgaattaacataattatttattcttgctaccatgcatttacatcaaaccattcatttctcaaggcatagatgcatccaaaatcctcctagattgaaactgttttcattttttattgcaataaaatatgcataaaaaatttactatcttaaccatagttaagtatacactttagtgttactaaatccattcataatgttgtgcaccatcaccaccatccatctctgtaactcttttcatcttgcagaactgaaactctaaattcattaaacagtaactccagttccctccttctttctagcctctggcaatcaccattctactttctggctctaagattttgactcctctaagtatctcataaaagtggagtcatatagtatttgtctttaatgtggctggcttatttcacttagcataatgtcctcaaggttcaaccatgttgtagcatgtgtcttcatttccctcctttttaatgctgaatgacattttatgatatgtatgtatgtaccacattttgttttcagataaatgacatgagggttgcttctacattttagtcattgtgaatagtgctgctatgaacactggcatacaaacatctctttgagatcctgctttcaattcttttgggtacatacacataaatggaattgctggatcatacagtaattctatttttaaatttttgagttgccgccatactgtttgccacagtggctatacagttttacacgtccacgcagtgcacaaggcttccaatttccccacatcctccccaacacttattttctggggttttttaaatagcagtcatcctaatttgtgtgaagtggtatctcactgtagttttgatttgcatttccgtcatgattagtgatgctaagcatcttttcatgtgcttattggcgtatcttctttggaaaaatgtctacttaagtcctttgcccattttaaaatcatgttgcttttctattgttgagttcttaattatatattttgatattgatccattatcagatataaggtttgcaaatatcttctcccatactctgggttaccttttaactgttgatactgtcttttgatgcaccaaattttttaaattttcataaagaacaatttgtttattttttttctttagctgcctgttcctttggtgtcattcccaagataccactgacaaatccaatgtcatgaagcttctgccctatgttttctaggagttttatagtttggggtcttacatttaggtctttgatccattttgagttgatttttgtatacaaacttagataaaggtccaacttcattcttttgcatatggatacccagttgtcctggcaccatttgttgaattgactgtgctttctccattgaagggtcttggcacccccatcgaaaatcatttgaccatataggtgaggttttacttctggactttcccgttgattccattggtctatatgtctgtctttatgccagtaacacactgttttggtcacagtagcttcttagcaaattttgaaatcagcacattgagtcatccagctatgttatttttcaagataactttagctatttggagtccctcaagattccatataaattttagatttttttttccttttctgcaaaaaaacatcattgcgattttgatagggaacgcattgaatctgtagaggcctttgggtaggtaatgacatcttaacaatattaaatcttccagttcacaaacatgggatatgtttccacttatttatgttgcctttaatttctttcagcaatgtttttctgcttttcattgttaagtttttaacctccttgttaattcctaagtattttattcttttggatggaattgtttttgtaatttccttttcagattgttcactgtttgtttgtgtataaaaatgcaacggatttttgtgtattcacgttgtgccccaatactttgtttaattcagttattagcattgatagttttttgtgggatctttaggattttctatctacaaggtcatatcatctatgaacagagataattttacctcttcctttccaatttgtgtgccttttatttctttttcttgcctaaatggtctagctagaacttcagtagtatgttgaatagaagtggtgaaaagcaggcatccttatctcatcctcaatcttaaaggaaaagcttttggtctttcaccagtaagatgttagctatgggtttttcatatatggcttttactatgttgaagtagtttctttttattccttatgtgttcagtgatttttgtcatgaaagggtattgaattttgtcaaaatgatttttctgcttcgattcagatgatcacgtggggtttttttccccctacaatctgtttatatgatatattacactgattgattttcacattttgaaccattcttgcagtctgggaataaatgccatttggtcatggtgtataatccttttaatatgctgctaaatttggtttgctagtattctgttgaaaatttttacatcagtgttcataagggatactggtttgtagttttcttttctcataatatctttgtctggctttggtaacagggtaatgttggcctcataataaaagcattaggaagtatttcttcctcttcaatactttggaaaagtttgagaaagattagtatcagcttctctataaatgtttggtagaattcacctgtgaagccctccaagtcagcttttctctgttgagagattattgattactgattcaatctcctaactaggtataggtccattcagattttcataatttttgtctttcacagttttttatatttccagaagtttgtccctttcatctagggtattcaatttgttgtcatacaactcttcctaatgccctcctataatcctttttcattctgtatgattcataataatgtccctgttttctttttttttttttttttcttttttttgggggggggacagagtcttgctctgtttcccaggctggagtgcagaggcacaacctcggctcactacagcctccgcctcccgggttcaagtgattctcctgcctcggcctcctgagcagctgggattacaggtgcccgccaccgtgcccagctaatttttgtatttttggtaaagacggggtttcaccatgttggccagactgatctgaaactcctgacctcaagtgacccacccacctcggcctcccaaagtgctgggattacaggcatgagccaccacgcccggcccagtaatgtccccattgtcattttttattttagcaattggaatcttcttttttcttagtccatctatctacaagtttgacaattttgttaatcttttcaagaacgcagcttttggtttcactaatctttttttttttttttttttttttttaaagacagagtgttggtcttgtcgcccaggtgggagtgcagtggcacgatctcggctcactgcaacctctgcctcccaggttcaagcgattctcctgcctcagcctcctgagtagctggaattactggtgcccactatcacaccctgctaatttttgtatttttagtagagacagggtttcaccatgttggccaggctggtctcgaactcctggcctcgtggtccaccggcctccttaagtgctgggattacaggcgtgaaccactgcgcccggccactaatctctcctattgctttcctattctctatttcagttaacactgttctaatctttattatttccttccttctgctagctttgcatttagttcttctttatctagttatttcactttaaagttaggaaactcactaattttggtattaacttctttatcagatattttagaattagacctatcgatcatgtcatactttcctcagattcataactgcatgatataataatcctgtgtattcgagtcaaaagacacagggactctaaagcaagttcttcatgctctgaaagcatattattctttccttttgtctttatgtgtcctagaagtcattagacacaaaacatggagtttcaaggttactgttagagaacatatcgtgagtctaatggttaattacttccatattatctaagttttacaaacctctgatgtattcttcctttggttttattgttccaagcttcacatctgggcttctcacaatgcctgatttttatagaaagaacacagtcatataataaaaaacactgatgtcagcacactgacattcaacccagtgttttatctggggctctgcttcaggccactgttgctgaatgctgtggactccattctccaagtgcacgtatttgttttgtgctttaaaatagctaaattattatatataactacaacatagaacttttaaaaattctgtaactcaggattttcacaattcaggttgagtccctctatccagtccaaattcatccaaattttactgactagccctcaaacctgagaaatagaaatgcctcctaacagacacaggccgtccgaaggtcaatcaaatcccatgggaatatgacaaaaagcacctttctctgacaagagagagccagtaattaaggtctcagccttgttcccctcatctctgcttggatcagaattcagtttttcaaataatgccctataaatgttaagccaaaaacataggcaacactctaccggggtcagtaccaggacaaagaacatcacattttatggaatctatctttacaatcgtatttttatgcaaaaaaactcaatgactactgtagctgggacacctcacagttgttcctgctacattcattttcatccttttgacttttataggcagattttttttgagaatttttaaaaattatatataaagacatttttaggaaatctgagctggtgtcctcctttcattccttagaaccagacaagaaggcaggaacagtgaagacaaaatacaatgcgcaagagcaggggcaggcaactgttttctgtaaagggcagccttcacaggccaaaccatctctaccgaaactactcagctctgctgctgtaacaatagacaagacatgatacatacaagaacggcatggctcattctggcacccaggcttatagtttgcctgctcctggccaacaacaaagatatggagtctgatgcccaagtttgaatactaactctgttttttactagctgtattaacactggcaagttatttaatgtttctagtggagtctgatgcccatgtttgaatactaactccgttttttactagctgtattaacactggcaggttatttaatgtctctagtggagtctgatgcccatgtttgaatactaactctgtttttcactagccgtgttaacactggcaagttatttaatgtttctagtggagtctgatgcccatgtttgaatactaactgttttttcactagccgtattaacactggcaagttatttaatgcctctagtggagtctgatgcccatgtttgaatactaactctgttttttactagctgtattaacactggcaagttatttaatgtctctagtggagtctgatgcccatgtttgaatactaactctgttttttcactagccgtattaacactggcaagttatttaatgcctctagtggagtctgatgcccatgtttgaatactaactctgttttttactagccgtattaacactggcaagttatttaatgtttctagtggagtctgatgcccatgtttgaatactaactctgtttttcactagtcgtattaacactggcaggttatttaatgtctgtagtggagtctgatgcccatgtttgaatactaactctgtttttcactagtcgtattaacactggcaggttatttaatgtctgtagtggagtctgatgcccaagtttgaatactaactctgtttttcactagtcgtattaacactggcaggttatttaatgtctgtagtggagtctgatgcccatgtttgaatactaactctgttttttactaaccgtattaacactggcaagttatttaatgtttctagtggagtctgatgcccatgtttgaatactaactctgttttttcactagccgtattaacactggcaagttatttaatgcctctagtggagtctgatgcccatgtttgaatactaactccattttttcactacccgtattaacactggcaggttatttaatgtttctagtggagtctgatgcccatgtttgaatactaactctgttttttcactagctgtattaacactggcaggttatttaatgtctgtagtggagtctgatgcccatgtttgaatactaactctgttttttactagccgtattaacactggcaagttatttaatgtttctagtggagtctgatgcccatgtttgaacactaactccattttttcactacccgtattaacactggcaggttatttaatgtttctagtggagtctgatgcccacgtttgaatactaactctgtttttcactagccgtattaacactggcaggttatttaatgtctgtagtggagtctgatgcccatgtttgaatactaactctgttttttcactagccgtattaacactggcaagttacttaatgtttctagtggagtctgatgcccatgtttgaatactaactccgttttttcactagccgtattaacactggcaggttatttaatgtttctagtggagtctgatgcccatgtttgaatactaactccgttttttcactagccgtattaacactggcaggttatttaatgtctctaggtctcagtttcccatctgcaaaatgggggtaatgaaagtactaatctcatatgtctaatatggagatgtacatataagccagtatgtgtaaagtgattagcacatggtaaataatatgtttactacattaatatgtgagcaaatatacattaaaaaggtgttattttgtgaacttgtaaatagttgaaataatgcattcagcttaggcaaccttgtttcaaaaaaaaaaagtgcaaggtttcagaaaagaagatgtacaaatgaccaataagcctatatataaaacgctcaacatcatttatcaaggaaatgccaactaaaaccacaatataacgtccttgcacactgttacaatggctaaaattaaaaagagactacatcaaatgctggtgaaggtgcggagcaactgctgactggaatgcatcatcactttggaaaatagtttggctgtatcttattttaacatgtaaaaacaagcaaacaccaccaccaccaccaccaacaacaacaacaaaaatgctcttatatgacccagcaatctcactactggtatttatccaagggaaataaaccacatgtccacccaaagactcatacatgaatattcacagcagctttattcacaatacctaatcaggggagacaacacagatgttcatcagcaggtgaatggataaacaaattgtgttatcccaatacagaccaccgctcagtaataaagaggaacaaactactgacacaaacgacatggatgaacctcagaatcattatgctaagtgaaaagagtcagaccacagtctataacgtacagttccatttcttcaaaattcaaaacagacaaaagtcatctatagatacaaagcagatcagtggttgctgcagccagacgtgtaggaggattgataccaaagggacatatggcaacttttggggtcacggaaagttctgtatcttcattgccatgataatcatcgtatattatattcatggcatacatatttgttaatacccaaagtatatacttaaagtttatttaaataaaaaggtacaaagaaaacagaaatgaggaagggagtacaactgcaaacagccaactttaaaaggtgagtaaggagctcagcacagaccaaaccaacaactgggattttcaatgcctcaggtcggcctggaggcccacaagtgctgtgaatgtgaaacccaggaacaaatctcctgggttactctcatgtatgtcgatgtccctttccgtctcccctctgtttaagaaaaaaaaaaaagctgagaagacaaactttaagttggcccctcccctaagacacctagctacctccttggggtgtgcaggcctttgtacaatcccctcgccttgccccttatgtatgggcatgatctgtgacttgcttctaacagaatatggcaaaggtatatgtcactcctgccaattacatttcataaaactccatcttgccatcagatcttcactagaagctcttcttgctgacttaataaagtacatggtcatgtggggaaagccctacctgagaaggaactgtgggtggtctccaggaactgtgggtagacttcagccaagagccggcaagaagccagggccctgagtcctactgatgcaaggagataaattctttcagtggcccaagcgagctgggaagtggcttcttccccggatttccatacgagaacacagcccagctgacaccttgacgagagctttatgagaccctacatggaggatccaggtgtgtgtggacacctgacccacagaaaccatacgattaaaaaatatatgctgctttaggccacaaagtatgtgataattcattatacaaaataaaaaatataaacagaggagaagatacctaaatggttaaaaagaaaaaacaatacacccaataaagtcggcattttcagaacacaagcgctaggcagagctgcctgactgttgtcaggatcatgcagcaacttctttaacaagtcatgctgccctgtgttccttcctgacaccatgacaggagcaaccactcaagtccagcatcctctaggccctaaagtgctactacatgtgactcacagacttcacaacagttctaagagcactggagaacagtacctactgtcctttaaagccagggccttactcccttctgtggagacacacaccccttggctctaagtggccccagtggacatgacacaacaatcccaaagagccacttaagctacaatgtaagattgttgagaccagccgggcgcggtggctcacacctgtaatcccagcactctgggaggctgaggcgggtggatcacctgaggtcaggagttccagaccagcctggccaacatggcgaaaccccatctctactaaaaacacaaaaattagctgggcatggtggcgcgtgcctgtaatcccagctacttgggaggctgaggcaggagaatcacttgaacccgggaggcggaggttgcaatgagccaagatcatgtcattgcactccagcctggcgacagagtaagactccttctcaaaacaaaaacaaaaacaaaaaaaaagattgttgagaccaatggttatgtgcatggggttctactctacagctaaagaggaagtgggatgcaagacaaaggcagttatttaacctctataacatatttagcaggaagctcaaatatgcagactattgaacagggaagaatagagtagggagagaaaagacgatagtgtagtaccatggggaagaacagtccaagaagtgtgaattgctctgccagggacagccctgcctgtgacgcatcacacaacttctctataaaacaaggctttatgatccttaaggcgtcttccaggtctaagagtctatcattctacattatataaaaatctttagttgaacaattatagtatcttggggggaaagtgtactaaggcatcaagaaaacaattttatctgctaagagtacttactcgtagtaagtaagattagtatgcagaattctgagtttagcacacacgatgttcttaggatttgggagcctagtcttataaatgtgaatgccatacattaggttgcaaagaaaaggccattcatatccacgaagataacaaaggaatatatatagtagcatgaggtgattttatttaaagtttaatgtcctcaagtaatcattccatgctcagtttcttataactgtaacttggaaatattgacatttcatatgcaagctataactaaaactaacttttctttataaccagctaggaaaaaaataggcacaaagtattattttataaagtctaccaagtaacgaacatcaaagaaatgcacatgatatagtcaggctttttctagcacttgtcagtacaagccagttagtggagtaaatcggtttggctgaaagtcctatgctgccatgcgacagaaaagagagctaaactatccacattccatagtttaccttctgtcactaataatctccatcatctacttaaaaatcttagagaagctgggcacagtagctacttgggaggctgaggcaggaggattgcttgagcccaggcgttcgagtccagccagtgcaacacagtgaaatctccatttctctctttaaaagaatgttaaagacatctacctcaatttttggcaatctcctactgtagcttgaaatgttaaagcttacatttagactgtgcatgtcagtttctattatcattccactttacagagaattaaaaaaacactgtgcttgcaacttaaactggtattaaactgacccctgctggcctcatcttttctgtttctgcatttatcagatgcttcaagagctaactgcattctatagttcaacctatatttgatcaggctgccacctcaaaaacaaaacgtgggacaaagatggctagttgtaccaaattccaaatggaaggatgccttcctcagacctttgtctattttatttgcaaaaacctagcaattaaaatcacactaatattccaaagaagtatctcctatagcctatgaatttattctaaaacctaatgcactcaatagacatttacagatttctcaaagactgccgggaaataaagatttttctaatcacagcacctgccctccaggtacttacaggcatttatgagtcattgaaaagatacatctgagaattcaattctagcatatcattggacaccacacaggtgagaaggaagtggggtccccattcagcccgtggtagagcctgcctcactggtgccaggtcacttgagattcgttactgaaatggcccaggacaatgtgttctcttccttctttgtgaactcactgtgctttatgaattataatggctgccattgattggcaacctactatgtgccagagactactacagttaggtgctttccacacactatcacatttaccctactcagtaactctgtgagataggtgattttatgctcaagcttgtatcatgggtgagtaaagctctgtgagaatactgatcatatcataccgcaatgtttttcctttaaagagatgtttctcctctaaacaacagcaaacaccttaagcacaggaaattacgttattgtcatctctgtatcctcagaacctcatatacctcagtaaaggcacatagtaggcactctaaaaacatctgcaaaacatacaaatgaaaatattattgaaagaatgtagctactaaatacatactatgggcataacctatgcttaggcactgagaaaacagtggaggaaaagaaagaagaggcaaaggctttgattcctgagcacagacacccatacgtgactatggaaagaaaaggagaagttccaagacataagtaaacagaatgctatgtcaatacagctcatactaccagtcagctcaaaatcaaacagaaaaaggactcctaaatcagaggacaatgacacactggtgctgggctattggaaatgaaacctattaaagaggaaaaaagagagaggaggtagaatgtcattaaattcctttctgtttttgtaacatatctacaagaccaaatgatgtgaaaaatagttctgcaagacggggactatgtgaatccagttttaaaggtccaaatatgtatactttacttatatagatcatggcatagtaggaaagacagaagatcataaaaacaaatataatgtagaggtctaaaaattgtttcctggtcaggtgcagtggttcatgcccgtaatcctagcactttgggaggccaagccaggaggactgcttgagcccaggagtttgagaccagcctgggcaacatggcaagaccctcatctctacaaaaaaaaaaaaaaaaaaaaaaaaaaaaaaaaaaagcaaaaaaattagctgggggtggtgttgcccacctgtaggcccagctactcaaaaggctgagatggaaggatcgcttgatcccaggaggtcggggctgcagtgagctgtgggccaaggtggcgtcactgtgctgcagcctaggcaacagggcaagaccctgtctcaaaaaaattaataataattttaaaaaataaaattatttgttccaaaaaaaaaaagctgcatgtatttttcttttcttttgcttacctatcattatttttccacatctcttttcttggtacttcagacagatgaagataaatgaagcacagtagttaacttctttgtttggatacaaaaaatcttctgtatcaacaatattgttatgcaagcactttaaatgttgcttctagcagatgagacttctgcttcaacatatgttatggggaaaaatgataaaaatttattcatgactagaataactgaacagtcaacaaaatctaactagaaaatgtaataaatcaacctggtttgttgcagttgttaattatctaaagtaaactgaagatccagtctctcactccaaacaagaataaataatcccagattctcagcactgtcaatactttctatatcatcctaccactgctgcaaacttcttccttcagagtgatcggaatttaacttcctctgcctgcaccttccctgagacaggaaaagccacaaaagaaataaggagctctaaaggttcttctgctcaacaatggcaccttaaaaatctaaaacttactgagggagcatgtaaccccccatagaaaataaaacagtggtcaagcttttgggatctggactcagggtggcttgggttcacaccacagttctacaaatgtaatcttgggcatgtcatctactttcctaagccagagataataacattgccaagagtgtaacagtgagtgatcatatgcacagagcttagcattttacctggaacctatgtgtttcatgagcatgagctattgccattattacatcccctttgctacatccctcccaaagtcctaccatcgactcgcaatctgaacaaagagaaaggacctcaaaatccttactctggctaaactgggctttaaatgtgtcagatgtgtccatcttgctttccttcctcaccacccctgcctgccaataatcagagccatggaaaagcttcccttgctcatgcataaataacgtcctcattcatatatacctgtgtatgtttaattacagtaactagaggtctcaaaataactcatatggttctaatttcaaatatttaaagctcttaatgacacttgcttctgtgagaccagaagaaatataattgccacagcgataacatctaaagcccaagatcatttctcccagaacttatagcactcacagaaatcgaccaggatctgcttgcagtatcttttagaatttctgtctcccactgacacaaccgagtcataaacaaaaactgcagcacttgccagctttcacagcccatgacaactgtgagttacacacaaccttcaggtacaccattcaccctaataactgatttcaaaataacaaaaggaagtcaagcatttaaatgtagcacattaatatttgactaaaatagcatatcaaccagtagaaaaatcaaacaaggtaaattactcatgaaagaagaactacatgaatttctcagaaacgaagtcttgctggagaggtacatgccatgtcacttgcaaccaaaagtacttcctcagagccaatatcaaaagcaccggtgagtatgctgcaaaacggcatagcaggctgtcagatgctgcatatcagctacttgagcagttagattaagctttcccaacaggcaagtgctgcagtacttctgcatctagcatctggtaatgtgttgcaaacgcagaacaaagaaagcagcaggctccgaaatctttcagctttcctttgaccatctgcagcacttaaacacttcagggttaccaggtcagcaacgtgaattctctcaataccatgaaacatgagcaaaatttccattctctgaggtttctaattcttttctttttcttttttttttttttgagacggagtctcactctttcgcccagaccagactgcagtggcttgatctcggctcactgcaagctccgcctcctgggttcacgccattctcctgcctcagcctcctgagtagctgggactacaggcacccgccaccacacccggctaattttttgtatttttagtagagacggggtttcaccatgttagccaagatggtctcgatctcctgacctcgtgatccgcccacctcagcctcccaaagtgctgggattacaggcatgagccaccgcgcccagcctctaattcttttatttttctttactttttctgattgtattgagataatcaaatgatttttctccttaagggagtatggtaaattgtattaataggtttctaatgtgaaaccagccttacattattggaagaaaacacaatctggtcatgttgcttttaaattatttgctggattcaggttgctaatattttatttaggattttaaaaactcatgtttactagtgatattgactagtaactgcctttccttttttttttttatttccataggtttttggggaacaggtggtatttggttacatgagtaagttctttagcggtgatttgcgagattttgatgcacccatcacccgagcaatatacactgaaccgaatttgtggtcttttatccctcacctccctccaccctgtcccccaggtccccaaagtccattgtattattcttatgcctttgcaccctcatagcttagctctcacttatgagtgagaacacacaatgtttggttttccattcctcagttacttcacttagaacaacagtctccagttgcatccaggttgctgcaaatgccattaattcattcctttctatggctgagtaatattccatcatgtatatataccacaatttctttatccactcattgactgatgggcatttgggctggttccatatttttgcaattgtgaactctgctggtacaaacatgcgagtgcaagccacatgcaggagaataactggatcctcacctctcaccttatacaaaaatcaactcaagatggattaaggacttaaatctaagacctgaaactataaaaatgctacaaaaaaaaaaattggaaaaacccttctagacactggcttaggcaaagacttcatgaccaagaacccaaaagcaaatgcaacaaaaacaaagataaatagatgggacttaattaaattaaagagttttggcatggcaaaaggaacagtcagcagagtaaacagacaacccacagaatgggagaaaatcttcacaatctatacatccaacaaaggactaatatccagaatctacaagaaactcaaacaaattagcaagaaaaaaacaatctcaccaaaaagtgggctaaggatacgaatagacaattctcaaaagaagatataaatggccagcaaacatatgaaaaaatgcacaacctcactaatgatcagggaaacaaaaatcaaaatcacaatgcaataccacctttctcccgcaagaatggccataaccaaaaaaatttaaaaaaaatagaagttggcatggatgctgtgaaaagggaacacttctacactgctggtgggaatgtaaaccagtacaaccactatggaaaacagtgtggagattccttaaagaactaaagtagaactaccatccagcaatcccactactcggtatctacccagaggaaaagaagtcattatatgagaaagacacttgaggtttctgattctaaagtaaaacctccatcccacaaaaagcttaataaaggataataacaaaaccttgctttgccagcacttttgtttaaatttttgtttttaagttccaggatacatgcgcaggatgtgcagatttgttacataggtaaacacagcactttttttttaatctgacaaatcacaaatcaccacacagctcccatcaatgcctcttaaaaacaaatattttccactgtcttagggaagtcccaatttctttaaaattcatcatacaaattatttcctcaagttttcactcaatgaaaattcctgagtataacacaagactgacattagttctgtactcaaactctcagaaaattagtgctagttttctacagactccctgaaggtctttttaaaaatttttagaaatttgtatgtagtaatgacttgccaatataaatgtaatacagagacactgtttttgttcatctttgtatatccacctagtatagggcatggcacataccagacactcaatatttattaactaaagagtacgtaggtctgctgcctctcaaatatttgataatcagacttttgaattctaaatttcaagtggagaaattttctccattgaccatcattataaaactgtagtggtatatctttggaaaatatatgacctcaagatataataaaaaaatctttttttttgtttttttttttgagacagtcttgctctatcatccatgttggagtgcagtgacggaatctcggctattgcaacctccgccccctaggttcaagcagttctcatgtctcagcctcccgagtagctgggattacagttgtgcgccaccaggaccggctaattttttgtatttttagtaaagacagggtttcaccatgttggccaggctggtcttgatcccctggcatcaaatgatccacttgcctcggcctcccaaagtgcaaggattataggcgtgagccacagtgcccagcctaaaataacattttaaaaaacaacaatcattttagaatttcatgaatatcaattgatcagaaaacattagtgaaagtccagagttgttttaaacttagaaaatattttctaatatatatagttttcggaataataattaggtcaatgagctaaagatttccttttacagtttcattacaaatttaaaaagcttttgtagtaaaaacccatgaatgtaatcactatttaatagtttatgttttctaaaaatgtgtttggcattccatctgttaagttaggactccagaagaacttaccgctatgtccaaactgggttggagggggacaagctgggtttaaattgcgtttctttcacttgctaggtgaccttgggcaagtcatactaaacctcactttgcctattaccacatctctaagatggacatagaaataccaagttttgggaatactattcttgaagtatagtaattagatttgggggggttttgtgtggttccttacacctgaccctgtctctgttttggccaggggcatccatctgcctacgggatattcaggtttatggaaacaggaatacaaagagaaagactcagtgttcaattatgacacctataaatcaatattttcagtcaacaagcaaaattcttgacagccaagctttgtcaagagaaaatgtgctttctaaattcctaaaacactaatttttaaaatgagggctgaaaacggaatgagaagctcaccttgcttccatgagcacagctgcagggtagaaccacctaggaaggccttggaacgttacacggcctggggcccccacccccagacacttagattggtctgggctcaggaactcaagcattggcaagtttttgaaatgccatcaggtaattctttttttttttttttttttttttttttttgagatggagtttcactctgtcacccaggctggagtacagtggtgcaatctcagctcactgcaacctccacctcccaagttcaagcgattcttctgcctcagcctcctaagtagctggaattacaggtgtgtaccaccacgcctggctaattgttgtattttcagtagagacggggtttcaccatgttggtcaggctggtcttgaactccgccatcaggtaattcaaatgtgcagcctggatttagaaccgtagctccacagagaagcttctggtttggttcaaaactacgatccacacacaacaggagggaaaacccagaagtggcctcctggtcccctacagccccatgcgtatgttatgcagtggatcctgagctttcctgtgacccagtgggggtaatgcagagactaagactccccagagtggagagatggcaagaataaaagctaaggctagtccaggcacaagactagataaaccaaccacctggggcagaagagaatcaggaccagtctgcagtcttgctcccattgccatggaaggacaaggaggggaaaatgcaaagaattgagcatttatctgaaaaaaagacaagctacccaaggactttaaactacaagaaacagaagcaccattaaggggtaagtttgtccaatcatgtacattccttacttaactgcttccccagatgggctgaggtaagaaaatgtagttcaattataaaatatttaaaagcctggccaggcacggtgactcacgcctgtaatcccagcactttgggagactgagttgtgtggatcacctgaaggtcaggaacttgagaccagcttggccaacatggtgaaaccctgtctctactaaaaatacaaaaaattagctgggtgtggtggcgggcacctgtaatcccagctacttgggagggtgaggcaggagaatcgcttgaacccaggaggcggaggttgcagtgagccaagattgcgccactgcactccagcctgggcaacaaaagcaaaacttcgtctcaaaagaaaataataatcttaaaaagcgattgttaattaaaattatccaaaacatgaaaaaagaaaaagattagggagctgtgtggccttctcatattactctagagcactgtttcacagcttcacccaaggattatttaattccctagaagaatgccaatgcatttgactttgttacttgctgttagagcacagatagtgtgaaactacaacgttagcttatagatttctgtccagcagaaaggataactctaaaaactgtggttttagtgcatgcagaacgtcaccagttttgtctccaatctagcaatcttattctaatgcctaaagatcagttccttcagtactctggacctgcattaactctgcctggtttcctcattaataagttaatacatctttggcatttcgttttgtatttctgtgagagtcaggttttaacttttcaaaaaatttactttgatagtatattttctttgcatgactggtagtgtatgtaaatctaccactcactgacactgatctcagtggacattttataagataattcgactgcttggtgcagtgcatggcacttggtaaatgctcagtaaatgttactgttcgtgggtgctagtggctagaggagattttacctgcatctaacagtaaccatgaactcaccaatggaggtccacaaccataatccagggcaaccccgggtaagtggatacacagacttcctcagtagggactattcccatatatcataaatatagggagccactctgctcaaaataattcccaaactatcaacacagacagtacgactcacttgtatatatttatcacgagtgtgtgggcctgtgaggaaaaaactatcataacttagcaaaatcagaaagtacacagatctaaaagaagccatctccttggcgaccaaaagtatgctgctccatacttaaaggaatcttcaaatgatgttcaaatatatgatgacaggagaaacagcaacacagcaaaataactacattagcatatgaagagaggaaattggactggggaagacctgagagttttccagcaaaaactggagaaaagggaactaaaccatctacattccatagttcatcttctgtcactaatagtgattattatccactaaactatctaaacttttggccaatttctactgtcgcttgaaattttaaaagcttctttttggactgttcatttcagttactgttctcatttcactagacaagagaagccctgaaaaccctagtaaagctatcagggaagagatatatggttaatttcttaaattatgaactccttaagtatgacttctctacaaaaagtttcttcatcaatgaagtgcacctgtaaaaaccattccttgtctaaccttgaaattggcctgtaacttcaaggcttaactttcgagtgtgagagtttcagacacatcaacatattttcaaggccataaacactgggtaatttttcatgctcaagtgtctggagtttcgttttcctaatatcaataagcaatatcacaactagcaaggcagaaggaataaaagcacctcagcctctcacaatgaactgaaaaaccctatattctttccttttttttccttcacatcccatttcttttaccttgcccagctggtggaaaaaaatctagcttccttctgaactaaacacacataattaaatacacacaatcttaatttaccacactgatgtcttcatcatcagctaccctagcaccatttcaaagcagcagaaagaaatataataatttataagccagctcctgaggttatatatttattttaaaacatgccagtttcaacaatataaaatgctttcccatgtttaaaaaacaagactatttgttaccttgtgatgggacaattaaacaagcttttaagcgtgataaaaaaaaaaatacataggttaataaagtagtcttgataaaaacaaagcaaagatttgaaaacattggtatttccataacctacagaatactgatgactagatggtcaagacaagcatcagttacaaattatgtatacagcttgctaacaaattagggaaacgttcccctctggtttctttcccgactacttgtaaaataatattcgcatacaaatttgcaattcaaatttgatgtcttatgagtgcattttgcagatcatgctctgagaaggaagagagtgagctaagagttgcatggaaagtataatttgctgctggcttttagccagaaacactagaccaaatgtttatggagaccacgaggcacctaagcaagcccagtgcatctggacttctcaatactagttgttgctatttatttatatgttaacctccaaataaaaggtcaaatagagtaatatctacattacacattcatacattttaaaatatatttattttacttacacagtacaggaaaggaagtgatttgccgtcactttgagaacacttgcaatagcaatgacaagaaaaaccagtaatttaagcaacactaataaccatatgtctggacctatgttcaactgtaatttacacattaagtataagcttttattttcatacttgagaaaacatgccaggtattcagtatttataatcatagttaacttgcagaatgaggaagctaattacagtagaaagaagaaaatattagccttgggaaaatatgaatttgacgatcacacaggtaggtagtaaaggagccatttctacctcccatgaccaatgcaatacaccagcatcttagacttactatccaacacaccagcatcttagacttactatccaatacaccagcatcttagacttactatccaacacaccagcatcttagacttactatccaacacaccagcatcttagacttactatccaacacaccagtaccttagacttactatccaacacaccagtacattagacttactatccaacacaccagcatcttagacttactatccaacacacaagcatcttagacttactatccaacacaccagcatcttagacttactatccaacacaccagcatcttagacttactatccaacacaccagcatcttagacttactatccaacacaccagcatcttagacttactatccaaaacaccagtgccttagacttactatccaacacaccagtaccttagacttactatccaacacaccagcatcttagacttactatccaatacaccagtacattagacttactatccaacacaccagcatcttagacttactatcctacacaccagcatcttagacttactatccaacacaccagtaccttagacttactatccaacacaccagcatcttagacttactatccaatacaccagtaccttagacttactatccaatacaccagtatcttagacttactatcactgtcaagtattaaagcagatatgatcactatatggataaatatattgctaataaaaatccactccaacataccagtcactccagcacagcacaatataaattttgtagggatatgctgcagtaaaccatgtgacacagtaaaaggaatgacacattacaagcttcccttaaacagaagaccatgaacacgtattgccaacctattacttgagagcatttgggggcaaaagagtcatgctgaaattggagtctctgcaaaaggaacacaaagggctgagcaaacaacaggaagcttaggcagggagcatggcagacactgaaaaaacataaggaaagggtcaacatatagccatgttcaagaacataattttagttaatgctaagtattaagactgaaaactgaaacatgggttgggaaaaattgctgatgaaatcaaggaagatcacaaagaatcattccaaaccaccatatttggtgggtaaatgtatctgtactgtaaaaacactgtaccataaaaaacaacaactagatcatgtatgatgctattccatacatggtggtaattatgaggccaatttgcatctcctcaccgagaaaggattgtgaatccccaaactacatcatatcaccccctaaagaatgttatgggtccctgacctagtggatgatctctccctctctccatgaggccccagcactgacagatatcttctgaactatatttggtcatgtagtctgaacaacaaatcattcgcttgctacctcatctacatgtattatgtacttggatgttttgctggcaccctagagatctggagcttttagaaggctactttaccataggtgtggtaagtgtgatcaatatatacctttaattaaactgtaacttattttaagccagtatcagaaggcaagttaaaaaattagaggactgtaacttctaagtagtataacacgcacattagcattcacccacgtgcttccacttttgcagacatggagcaaaagcagccctcctgctagtgagactactccaagaaaacccctcccccggcacagtggaaaaacccacgacagtctcagaagaagagcgtctatcccaggattcaaggttaattcctttgctctcaccttctcagaaatatcacttcatcattaataacccttttgcccacttatctttaaatcttcatctttgctggctcacacattcaaatctcttcaaaacaaaaaaacagaaccaaaaactccacactcctaattagtgccctattcttttcttctattcacagtcaggtttctcaaaatgatcaagcactcatgactctaaggtgctctagcaaagctcaccaaaggattccctattattgaactcaatgaaccttttcagtcctcacgttaactgacgtctctgcagcacttgaagctgttgacctccatgaagtgctttttctcccttggtttctatgatatctttctctccaggttttcctcccactttactccctctcagtcgcctttgctggcttctctttttcagcttgccccttaaatgttcctgttccaaagtgttccatccatgctgctcctattttcttttctacctaccctctccctacattccttccacctccacagcattagccatcatctgtatactctagagaatgtcttcctcatttctaaataccggcgtccccagcacatagcactcactcagtaaggtcagatgaaagcctgatgaatgatagacaattacagaagcaaccagggcccactatgttgcagagttagctttagcaaattctaatttcttgaccagattaaatctatctacaaatggtcagtcttactgagggctgactaccattgcctgtaagtgttcagctaagtgttcatttagtcaacaaatatgcagtgcctgctatgtgtcagcacagtgcctactatgtgccagctacatgataggccaaagaattcgtggagaaagccctgaaaatagaaacagacaactctttctgagtccatgtatacatctgtgtgtgatctgggcaaaccaattaagcttcctttttttttttaagacagagtcttactctgttgcccatgttggcgtgcagtggtgcaatctcggctcactgcaacctccacctcccaggttcacatgattctcctgcctcagtctcccaagtaactggaattacaggcacccaccacctcgcccagctaatttttgtatttttagtagagacatggtttcaccatgttggccaagctggtctggaactcctgacctcaagtgatctgcccacctcagcctcccaaagtgttgggattacaggcatgagccatcgtgcccgacccaattagcctttctgcctacaaatgtcttcatatataaggtgagaataatatatctattttacagggttactgtggaggttacatgagataatacataaatctaatatgttgcatattacttatgtctgttattcactgtgaataatatgtaataataaatattttatgtactcctttgttaaaacaagcttataagacaagttaaggcaggaattagtattcccactcagaatactaattctattagtattctaatagcagcaccagaacctaagcaatctccccaagcccactcacgcagtccctaggtggtaacgttctttagtgtcagagaccaaactgtgattctctttacttagtatctcttacagatcccactgctgcccagcagcataaaagatcctacccagaaaagggtctacagttgagaagccaaaggtcctaagatagtagccgaggagttgatgagcaaacaaagtgtttgttttcttaataaagaaaaacagttttctgcttggacacagtgtaattccaactataagaggcagcataatgttttcagtcagggaaaggtctccaatttcataagttttgatttaacaagaagattctaatattaaaaactgtcaggttgccacggtaacaatctatttgcaatcaagatgctggtggtattctgttatatttctctcaaggaaaaagtaaactagatgtagccaaggaatttaataaaagtatctgttggaccaaaaccaagatatgactgtttttaggcaatatgacaggatttaaatatacagcaagagaccctcaggttacaataccagttccatcaataaaattaaaagattttgaccttgacaccagtacaagctatagccatatgatctggaaatctgaatcctctgagcaagaaaaataaatcgttaaacaattgagatgacaggcatgggacaagaaagtcaaaattcatcagaaggagaacaaaatcaatccccaagggaggtatgaattataaagactaaatttctcacagaaaattcaaaggtttgatttgggtgttttgttctgctgttgtatgtatgcatgtatgcatgcggaggtaggttttgcactccaggacattcttggatgtttttaacttgctgctttcatctagaaaatgttagaaggacatattgaaaatgaactgattctagacaggagaggaaggaagtgactgtcaggaattaggccgctctgagtctggacatgcagactatgcagacagagaaacttcctccacaaccaccgaagcctcagtcacgcccatgaaaatcacatggattttctctacagttaagacttttcaagtacttgtttctacaacgattcaagaaatggtaacacttgcccccacaactttagccatgaacaactcatttctcttcaatgtgttaataactttacagaactgtatatgcatgctgaatgtctagaatgacaaccagaataaaaactgcaactcctttggcttcgacaataaattggcttcacaagaaaatacctacattcatgacagaagaaactggctcttgccttaacctatatagttaatgcagatttatatataaataacattatatactttttagaacatatatttttataaatgtatatttatatacaaaataactaaattattttctgaaacagccttgaacattgtgtgtaatctcattttctgtaagtcattttccttctactttctctataaaattggagcactgtcctctacccctccgaaaagacatttgttaaaatcacagtgaaggttcagcataccttagaaaatcagacattttaaattctatgaagttcagacaaaatattaatacaatatgatattcctatttaaataaactcctatttaagtgattaatgaatcatttatgtattattgtactatacttagtacagataacatatttttgttgagatagcgttcttaaagatcacagagattctgaaaatgcttctaggttgaggaacttaggtagaggaagctaacaatcgatgaatacaataaaggaaactcatgagtgatagagatttgaggaaagtgctagataatcatccagactttaaatagtttgggcaatgattcagggacataaatggccagcagttagaaatagagttggaactcaggagggggctctgacacagagacaaaaatttactcattcacaattaagtaatagttgaatctatttagaaaaacaatgtgaaaaagaaagtaagaaagagaaacaaggaccatctttgagagatgccaacatttaaagatccatggaggtgaaacaaacaaggtgacagaggtatcttcaaagtcataaaagaggagtttcattaaggaaacagtcaacaatatatgcctcagaggagtcaaacaggacacagaaagagaacaaaatactgtattcaacatttaggatgtaactagttacgtgagtgaattcacttcagtacggtagtagaggcagcagctagcctacaatgggttaatgagttagcagggaaacaacgcatccaagaatttgtcttatattctaagatcaagaaccctcaacgaacaaaggtaagtgattcaggcttacatcataacccttcctaagttaaaaggacaagagcatttgttcaataaggacagaacctgaaattactggcttgtaatgaaaacgtttttaaccctaaacaagaataaatttcttgactagaatatttttctgatgcatcaaatgtcaaatattcaattattctgatgtataaataccagagattcactgtattgaccagagaatgctatgaatctacccaagattcacaatacttttcaattaaattaagcaatttttccttctaagacttccatttcagttctaaatatgtgttatctccattcatccttgtctcataggacaatgatcttcatattttagaggtagacagctttactctttggtttctgttaacaggacatcttgaatttaattgccaatgttatttatgaattataactgtaagagtgcttttcagtatgatgaatattccatcatctttaatttttatgagatgcttaaaatgaagggggatgggacagtctagctgctcttttcctctcttgctacaccctcttctggaaagacaataaacaacataagctttttcctttgtctatataaacctgcaggttcacagacagtgccacttgtcaacagctaaagagaaataagaaaagaacttcagaaggggaaacattcataaagagcaagagcacactgaggtaaaaaaataataataataaatagaagctattacagcaggaaaaaaagaataaaacataagtgcatactaatatcaagaactacaaaggtggcaaattgaaataatctaaatactgaatattaatttttttctatgaccaaaatcatattaaagcttacaaacccaacctaatgcctaatgaactcatttaagttcaaagtacatgaatgtaaaagaaagctgaatataaagaggctatcttgtgttttcaatacaatttaagtgttattataggagctgccacatttgttcccaagtatcccttcataaaatatcagagacaagatggaggttttgtactaataaagtaaaaggtatacttccaccaggtaaaaactttctggacctaacagctttaaaaataagattgtaccaaaagctatctttatataatgatgatgactggaccatcaagaatatgcaacactccctgtatattatacttcatcatataaagaaggaacagctctacttttaaaagccagagaaaatgtctaggtctgcctagaactgtcatggccttaaaaatttcatggggaaaaaaaagagtcaaagtctcatggttttattatgcaaaacttcatgatttcaaacccaccagaatcaaataactaaaaaatgaaaatgaaaattacaaagaggcattacttatatcacttttaagattggcaaggatgaaaaagagtaacagtatcccgtactagcaaggctgtgagtaagcaagcagtgttcttgtatagggttggtggagtgtaaatgcaatatatattagagcacaacctggcaacatatataaaaatgtaaaatctgtttctgcaacttcatttctactaatttatcctatgtaaaaaccagtttcatatgcaaagatagatgtatactgatgttccctacagtggaaaaaaatggaaatacttcaatagcgtactggttcattaaattttaatgttacatgcagccaacaagtgtatgaaaaaaagctcaacatcactgatcattagagaaatgcaaagcaaaaccacaaagagataccatctcatagcagtcagaatggctattattaaaaactcaaaaaataacatgttggtgaggttgcagagaaaaaggaacgcttacaaactgttggtcggagtgtaggttagttcaaccattgtggaaaacagtgtggcgattcatcaaagacccacaaacagagccaccatttgacccagcaatcccattactgacacatacccaaaggaatataaatcatttatcatgaagacacatgcacatctatgttcatcgcagcactattcacaatagaaaaagcatggacaccctaaatgcccatcaatggtagactgaatttttaaaatgtggtacatatgcactggggaatactaagcagccataaaaaaggagatggtatcctttgcaagaacatggatggaactggaggtcattatccttagtaaactaacatagaatagaaaaccaaacaccgcatgttctcacttgtaagggagggctacataatgagaacacatggacacacggagaggaacaacagacactggggcgcacttgaaggtggaggatgggaggagggagaggatcaggaaaaacgactactgggtactaggctgaaaaatgactactaggtactaggcttaacacctggtgacaaaataatctgtacgacaaaccctcatgatacgagtttacctataaaacagtcctgcacatgtacccctgaacttaaaattaaagtttaaaaaaaaaaaaagttaacaaagtttaacatgttcatacaatggaatagtatacaaccattaaaaaattatacgtggtatgcatgtagctgtgtatatactaaataaagatataaatgtggacccaactgttaacagtgttggtctctaagaagtaaggtttctagggtacttggatttctcatttgtgcttttacttactttaacttttcataatgcacatagtttttttatagaccccaataaacatttcaaatgagtgataaaatgtattagcacagttgaaaatgcacatttgcatgtattatagacaatggcttttgttgtgttgaaggatcaaggggacttagatgtattaaaggtaatgtgatggctgtctatagtctgctgttgttattaccaaagagatttctaaaatacccaaaattgccttcttaggtgtacgggtgaggaaagcggccagcaatgtttaaagtattacctgaatgagaatgctattgatctttgtggtggtgtgggacgccaaggtatgaatctggaattttcaaatgcctctgtgctttccaggtactaaaaacatgaactctaaaattacagacacctaggttaaggatcagttctaccactgactagctatgtggctctgggcaagttccttcatcttcctaggcctcagtcttgtctcctggaatacagggataataatagtacgtacccccatagaactgttgtgaagatttaaaatataatatatgcaagccacagtgcctggaatacagccagtattcaatgttggctcttatccttctcaaagcacatcaagtttgctttttcattactgattacaaagacctcaggaaatcaaagtctggattttattgcaagcaaaatagaaacaagggatattaacttcagatcagataatagaaaacacccagcctgtcagtgaagttcattttctttctagaataatgctacccgtcctaagggtagttcagctttgtagagatagaagtcgtcactgattatcaataccaaccctctgactgtgtgaaaagtattaaaatactaccagtaccaaatgtgcacatggaagactaatgaagagcaaaacccaaatctgcctattaagcataaatgggaacttaagggaaaatctgaacaaagtctaatgaacaaataaaatataaatagacaatgaaaaaaatattgaaactagtccccaggacacttccaccattcgacagattcaaatcagcaaacatttattaagcaattcactgctctcaagaatgttcaattctcgtgcaggagccaagacaaaccaataagtaactgtgataaaagacaggatgagatgagtgctggaaaaattccataggtgcccgaaagggaggtagtacacttcctgcagggacaagggaaaacaataaagctacagtgggaatggttttcaggtatgagtacaaacaagatggccacaaattaagattgattcacctagcaagtctgaagtaatgagaatatgttttaataaactgcatgcacacattttatactgtctattgagagtctgttttataagaaatataatgttacgtgctataagggaacacaataacatttctgacatctcctaagctttacaatccagctggggagcaaattatgcatattgtattgtgaattccccaagggcaactgatgtgtcttttttatctttctattcccatcctcttgcacaatccctgcaacatcactggcactaaatgtctggcaaatgaataaataaataagtgactataatacaaagcagaatattatacgtgtcactgataatccgtattagagaagtttaagagagggacagaaagtaagcaaggaagctgcactatttctgtcatctagcactcactcctcatattcctctgaaaatcatcccttcctcattatctgtctctgtgattccttggaacagactcccagggaggacatgcgagctaaggcaagcacatagaaataccgcgtttccctggttatagcaattgcttcaagagtgcatacctgccccaagccccaccagtgaaatacaatcaccactaatcttggggattatgcttaagcaacaaaataataagttacttttcctgttgaatttggagctgagaggatgaaaacctagaacttttggccactgtcttgccaccctaagaagaaaggctatcagagaatcgaagcaactcacagaaggaaagcctagcaatggggggagaccagaccctaataatgttgtttgagcccctggccttagcaatgctaaaaggaagcatttttcagtcatagccaacaaattccttttgtgcttcattcaatgtgggctggatttttctgtcatgtgaaactgttttcatgaaaagactgaattagatttcatcactgaaaactgcagtgggtttttaaatacagaaggaattcaggtgaaaaaaactgtataaacaataagtgaagtaagaaaacagaagactacttctgttacaatgatttatatatatatatttcaagtttaagttcagatgaagactgaatagaatgggttagggttagctaagtaggctgagtatagcaaattggacagttcatgcttcacgaaggggtggctgctacccagctcaagaaaattactgcgatgtggaaactgacccaatatggccacaactcccaattttccaacaaaaagctcaatctagactttacaagaactggcaggagttaatagcaaaagaatgagtttatagcaacatacagaaccaataagcaagtctatgaggcaggatccagcagttagctttgtgactcagaggttacttaaatggccaagaaagtaaaatcaaatccatacaaaaggtatgtggacccaagtaaaggtttcctaaacaccacaaatatgtgggtcttctacggaacactatatgacaagagaaagaagagagaattgcggatatacagaaaaagcaatggaatgaatagctacagcactgagctcctaacacaacaatagctgaagagcagacagagtctatgctctcaagtcaggctgcctgagttcctacccaggctctcctactttgttgttctgtgactcctttgaccaagtgtcctcaagtataaaattctgctaataatagtgcctgcttcacagagttgctgtgaggagtgcatgagttgatacttattgtggttggcagaattttaaggtggccccaagattcctgcacccctggagtacacactctgtataataaatgagtgctgttttaagccactaagatcatacattcctccctcagtattgactctagcacccctgtggataccaaaatccacaggtgctcaagtcccttagattacatggcatactatgtgcatatagcctgtacctatcctcctgtatactttaaatctatacacttataatacctaatataatgtaaacactatataaattagttgttatactcttttttaaattttatattatttttattgtactgttatttttcatttcaaacatattttatttgtggtgattgaatctatgaagaacccaaagatacagatggctgactgtagtaatttattatgcagcaatagaaaaatgtgtacagcgataaagtacttagaacacagcttgacacataggaagccctcaataaatatcagctattattattggattctatttaagtgtacattctggtacatttaaaatagcattctaattacaaaaattcagtttgtccatatcatgtttgctagcacagaagatgcacaggcagacagatgcatcccagtgatacaaagaactagggcaggcaattgactaaaaaatactttctacaacacgtgtattgagagtgattttaaagtgattttgtagaaggaaactaattattgtgttcatctactttagactggaatccagttggaaataagttcaggatattcaatgatagtctactaacctaaaaacaaaatataacatcacaaagttatttgtaatacatattgggtcaacaaatacttagcagagaacaaagcataataattttactggtaaatgaaattatagttttatgtatgtgatagtattaaataaagatactatatttcagatgctcgtaactaagaaaacaagccataatacaaaatacatttgcatgaactcctatatagcacacgtacaaaacaaatagtataaatctgtataaagcaggcagcaaaatataatgaacttgaagtcattcccatggacatagccataatacatatagaaatttatttcagtttaaaaaactagttcaaagcacattgtaaaaataataaacatgaaagactttcaatgtaatgtgtacatatgccataaaagtacatatttctctgaacattagtaaatgaccagcaactgaaaatatgataaaaatagacttcaatgaatacataagcaggaaaaaaaatagagaggaaaaaggtatcataaagattttgatgtttagcctcaaagccaagtaaagcaagcccaaagcatgaaaatccacttactagcactgctagagtttggagttttctctttatcccaagcatttatcccattagccacacagtcaccattatctttaaaatacaccccctgcagcctaatcgctgtacaactcttgacattaagtttgaacttaatgttctgtcaatgcctctgctgctttctgagccataggctacaaattaataacttcatatgtaaagaggaaaagccccatgataaacctctgtgggctgcggcttgtttgtttttaaaaactaccaatgagacatgaaactttcatctttgttgagattttttatgttcctgcactccatcattaagagcagccttgcttgctacagcccaccaggaacaactaacatatacctgcttggtcttacaccctgcaacaggcacagaagatagaagctaaattctcatacgattacttggaataaggagcatgtgttactttacaatctattgcctaacataagtcccttttcctgaggttgccataagcttacatgagaaggtgtcctaaatctctcacagtaatgctgaatccgaaagggttcggagcactcattttgaggagcacagacctcattcagtgaaacaatgattaaagattctgtttcatattttattctaaaatcttacaagaagatacagaatcgcttccagaaaaatgttgaactccaacaacaatttaatagaattatagaaaatctcatttcaacacaagcctcagcagaagagcttccttgttatcttcaatgtaacacaaatcatctttttaacataaaatattaggaatcatgctaatttcacagctttgttacattagaaaaaaaagttaatggtcaattcaggctgcatccattttataatgtacagataaggggtattttctcataaatctgcttaaaaatgaatattaaagagggataacgtgacaccatgtcaaataaacaaataaggatgataaaggaaatatagctatttgaagaagattatttgaaataacacatgggcttccatagtcatatttagagaaacattctaactaaagtcagactttgtattaattaccacagaattcttaattacaaaatctaacatgaaggaataaaaaaacattttaaggttcctttcttcaaaaagtacacaaagttagcttgtcctacaattttcagtcattatcttatcttaataaatgagtatgatatttaacagcccaactctcctctttaatttgctcttgatgtctaatggcagcgttcaaccatgacaaagcaaaattactaaagttctcaccttcaagtttagaaagagctattgttgataggtgagccatgtactcacacaacttacagtggatttgctgaactctcttggtggcaccacaaaatatatttctgctcctgtcttcattacaaatcaaaattgaaggcttatacaaatttaagctgcattaaaaatattcaacaggatcccagcacattgggaggcggatcacttgaggtcaggagtttgagaccagccaggacaacatgacgaaatcctatctctactgaaaatacaaaaattagcagggcgtggtggcgcctgcctgtagtcccatagtcccagctacttgggaggctgaggcaggagaatcactcgagcccaggaggcagaggttgcaatgggcaaagattgtgccactgcactccagcatgggtgacagagcaagactccgtctcaaaaaaaaattcagcggggtgtatcttcaaactttgtgccattttttcccttgaaataaaaaaaaaattagaaactgggacagatatatttttcctatttgaatgctcatgaataaaactatattttatactctaaaattataataccttaacagcatggtggaaccactaacagatatggcttttcaatggatagtcactttagtactttagtataatacttaagagatcacacaatacataaaaataaacctctatctccaatttattatggtataagtattaccaaaattaaatttgtacaccacttttaaggtgtaatattgtaaaactctgcactacaaagaattaattgaagcaaactcgctcagataagatcattttgacctctgttcttcacgctagacattttcattacagaacaaaacagtcacaagtttactaatcctaaatgacttggcaaagccaatcctaatgacaaggattttgccgagtcatgtaggatttaagtgactctgtggttcctggtgagatacagtacttcaaaacacactggctgatcctcagaccaatgacctgacatcaagtcagatggaagtaactttgagtttcaaacataggggaggatgggtttttcttaagaatgaaaaaaaaaacaactcagcttttcattcagagcaatatattctgagaaacaacttatcattttggtaaaaacaggagaagcctaatcactcagcttctactctggagtataaaatagttttcacacttttagtccacatgaaaaatagctccgctgaatttctaattgctgtatttagtgctgaatttgtccttttatatattggccacctcctttttgaaactctcttcttttatagatctcaaaccacctgagatcccaaatcctgagtcaccttaagtggctctttctcttcatgtctttctaaaaatccttctcagtttattctgaaaagcagaaaacaaaaagcaaaataaacaaacaaaggcctacagccacgtttcccatttgaagaaccctgctctcataaattaggggattcttttttttttttttttttttttttgagacggagtctcgctctgtcgcccaggctggagtgcagtggcgtgatctcggctcactgcaagctccgcctcccgggttcacgccattctcctgcctcagcctcccgagtagctgggactacaggcgcccgccaccacgcccggctaattttttgtatttttagtagagacggggtttcaccgttttagccgggatggtctcgatctcctgacctcatgatccgcccgcctcggcctcccaaagtgctgggactacaggcgtgagccaccgcgcccggccaaattaggggattcttatcaggaagagaaagcagcacgaggagggctcacaaagggaagtgaggctcactagaacagccccaggcataaattgcaggggaaacctgaaatcaactgctcctaacccaaaacaggcacgtccgtcaagcatgaaccagcagcaagaagctccttggcatccagtcacaaggatctaatctcaactccaggtacctcggtagcctatttgcaatggtgactgttaaattctaggaagtcagcactgactcttccacctacagtatcttccattaaaggccaaatcaaatgatctccccactccaaatctccatcttaggtctccgcatcaccattatcgcagtctgctggagaatactgtgagcacctccatgtactgaacgtggaaagcaagatttacaaaaagaaggcagcacagttttgctttcaacgaatcttcaatataactatatttatttatatatttctttcatttatcctaccagacagggcggaaatgaagtcttaattatccttatttctccacatggtgctgtgaatagagtcagtacaaatttgttgaactgaaatttattaaactggttctttctgacctaaaagagccaagtaagaatcccactgctttgttttggccctatttgtccactttttcaatatgccatagaaataaaaggatgacaagtcaaaccaattttcccccacttctttactgcaaacaaataatactaaatattataataatataatactaaatatcacagtgatatagagaatgagggagagagtttcgtcccagaagaaggccctcctagccgactacaacagcaatctctagaaaaaccccctaccaaactgacaaattcaaaacagcaataccatatgatacttaagaggaagaatggttcacatttacaatttatgatagcacaaaggcactccagaattttatgttcagtgtactgaatagaaagcagctgttaggcaaagcatgattaaatgacttcaatatgggagaattaatcacattttcttatactcgggattctgctgtcactcaaaaataaagatggaaaggactgtaaggtcagtatttttaaaaacaacatcaaaatgggcacctaaactagtatccatctaaaaaatgtaaaatgactcacaggcctaagatagtaagattttattatccatctaaaaaatgtaaaattacttatgtgcctaagatagtaagattttattatccatctaaaaaatgaaaattacttatgtgcctaagatactaagattttaaaagcttatttgcactaaaagtttttaagaagcatccgttctgtattaatataattagtagaacatcaaaggtgcctccaaaaccaatatgtattttttaattgtgaaaaaaagtttaatactagcaatactaaaaaaaagttaaaaaaagcttaattgttaaaaaaaagtttaattctcatttaattttcatttcacagactaggctacaattctagcaaaacaatgcatttatcaaaatacatgatcacattatgccatggatgggaaaacagaaatataaaatacatgcagacaagaaaataaaagcaggcacttggattatcatactcctccagccagacgaaggtatagtgaactagagagttcaccacaaacaggaatagaataaccaaaaactccaatacatcaaacatgtcagaactgaatggctgcctgaaaatgaatgcccctgaaaacactatccttacttcctctgtttaccaggtagaaagtttgaggattctattttgtttctcatactctgtgtctactgtggtcaatcaaaaaaatctactgaagttaccgggctttgaaattacattcagaaaaaagcaagctggactgtgggataggtatttatcaatgaaatgctcccaaggacactaatgaggttttagaaaagaggaagccacttgctgagacattgccttcacggccaagagtctttactagccaattccatagcactcttcctatgaattataatttagaaaggcagatcccacccaattctagaaatataagttcaaataggccctaagaatctggtgaactccatttaaaaaatgatttgtctctgcaaaagaaaaaagaaaaagatttaactgactgcaaatgagctttactttatggaataccagacactacatgaggaaatctaggtttttaagacagagcaatgagcttgccaaaataaatcttcttccacaaaaaggttcataatagaaccctgttaaactctaaattttcctagttaatataacctggtatattatttataaacattataagcaatgttttcaggaaaaaaatttgctgtacaatacagcactgaattctatgtttatcattttgctataaagataattagaagtaattagtaacttggcagctccaatgaacaagacctgcttttttcagaaaccattaatcctttgattcttcatagaggacaagagaaatcggaggcaagtctacctgaaaagagagaatgacacgaatagactggaagaaaagagctccaaaatgtctggaggtgagacactgacattcattttcagcagccattcaatcctgatggactggagcttttagctcttcccattagtgatgaaatggccagcttaagatactagcacctaactggaggagcaaaataatggaagttgctgccctttctcttacccacttatattttacacttctgctttcccattcctgtcctaatggacatgtctaagagagttgtgaaaggtttcctagaaaaggcaccatgtttaaacgaaatttgccaggcagagctgaagaaactgtacgagcaaagcttggaagaagaaaaggaatcctgagttttaggggaaaggacaaagagtaaggcttttttttttttttttttttttttctgagagggagtctacctctgtcacccaggctggagtgcagtggcgcgatcttggctcactgcaacctctgcctcccaagttcaagcaattctcctgtctcagtctcccgagtagctgggtctacaggcatgtgccaccacgcctggctgacttttgtatttttagtagagacggggtttcaccatgttggccaggctggtctcgaactcctgacctcgtgatccacccacctcggcctcccaaagtgctgggattacaggcgtgacccaccacacctggcctaacagtaaggctttaaagagcctactcaactaatactgaagactgttagtaaatatgtgacctatggaatgatcacactctatagaatgatcacactgactgagagctctatattattttgtaattgaaaacatgagttgttttcaaaagaacttttaaataccaagatgatgcaagtttaaaccttccttgtcatggagaaaatgcccttccactccaataaactaaaagataatttttaactatacagaacataatgtcttgtttccacaaaatgctaaatactttgcaagattctccttgctgactctgaggtggcagaaagtgacaaatatcatccaaatcttactgatacaaggaaaatattttcagcacaaaaaaaatctttgtagcatcatcattgctctaaagaaaagctagaagcctgccataatgattagcaaactcatatagatatctccaggaaaggatttacaaaatgtcatcacatccttgtaatcatctaattatcaaactcagcagtgttgacaaagcacaagcccactcagctactgctaatgattattattcaaagctacatttctaccaaatcagaataacttacaggtagaagctcattagccttaggaaccaccctccttgaacactcacacgcacacgcacacgcgtgacacgcatacacacacgcgcacgcgcgcacacacacgcacacacaccccagccataactaggccttgctgaattgtcatttgctttcatgaccctccttcgtgtatatgagcagctttacgaattggttcaaaaatacccagcctttcaaaaataattccctatctagaaaaataccctacagacatctatatctagagaaataccctatggacattagtttgctaatgtcatagcaacagtgcggcaggcatcgtcaagctttggtggcttgaagaaacacactggcaatgcaacaatgggaaggagctaaaacgtaatgtaagtgacaatgcaacgtgaaggaatggaggcataaaggcaatgcaacaatgggaaggactgaaagcataatgcaagccatggaggaaaagcatacactcactgaatctccgcaatctacttgtcactacaccaggtgctaggaaaatggttacgaccctcaagctgcttgcagtctatgcaagcagtcagccagctccaggaacgtggcatgagatgaagcttgcagggtcctcaaatgccatacttaaaagccttgatttcatacaaaggcagtagggaatcaacagacatctttttgcaagagattaaatgatcaaatctgggttttttttcaattatctctaatggcaaaatataaaaatgaattgagactcagggaaacagtgagaggcaaggatatgagttagaggccatttaggtgagatcggaaggattttaataataactgggacagtgacaaaacaatataaaaataaaacaatagagtcaagagatctttaaaagcagcataagcagggcatacagaagtttgggggaagaatcagaggtattcctgatattcctggcacggctggctcaggagattgcaacgtcaagagagaagacagcaaaggtggagaagcagtatgctgtgcggaagaaaaggcagagtttaggcactgcacacgacgaatctgaagtaaaaccaggtcacatagatgaagatttttgttggtatatagaaaatatgggatgagctcagaaacacaggcaggcaagtaaagccatggcagcaccatattgtcattcaacaggtaaccagagacaaatcagcaaataacttttaaaacaaactggtgagacaggcagaaggacaatgatgagcaggttaaaagacttccgaaggttaaacactatcacacctcaaatctgcataccttgagatttaagtgggtattgttggttttggtttgtttgtttttcgtttttttgagaccgagtctcgctctattacccaggctgcaatgcagtggcacgttctcggctcactgcaacctctacctcccaggctcgagcgatcctcccacctcagcctcccaagtagctgggaccacaggcatgagccaccacaatttttgtattttttgtagagatgggttttgtcatgttgcccaggctggtctccaactcctgagctcaagcgatctgcccacctcggcctcccaaaggactgggattacatgtgtgagccactgcacctgggcaaagtgggtattgttccataaaatcttggccaaatgggaaacaagaaaacccacagtatagtcacttcttattacagaagacttttgaggcccccaaacaatataccttaccaacttctgctctaacctgaaagacccacagccactgaatgattgtgaaggaggaaaaacagaccctaggacaccaaccagcaagtcacacacgcctctgcagatgctgtattggctgaagaaaatgctgccacccatcggggaaggaaaggaaattctattaaggatatttttaattctgatcctaattcaggtgatcctaattaaacagctctgcataaacagtgtcttgataaatttttcctataagcatcaaaacgaaaaccaaatgtcaatcaaaacttgaaatagcgcccatgactgccaagtctggtcacatgtagctctaatgcttttcttttacttgacaagtatttattcaaaaacaacattttaaaattatttgcctatgtcattaatatcaagtataaatgttaaggtcaaataaatatcactaaaagaaaaagaggtgttaataaggccaaagagtattttcttatacactgcatatatagtttatagcatagaaaatgtttaaatctataaatgcatgtatctatagaatcatagggaaaagcacacccaataatggcttgaaaatgataaagactcaatctggagggctcctgaataattaatgttttaatatgcagtactaaaagattgtagaatgcagatttcaaaaggtaccttaactccatgcaaattccatgtcaattatctttattttcacatacagttgtggcaacatcagcacagaatcatttgacatgaataatccaccctcctcccactcaaactaccagcatttatttagatttgaatatatgaaggacagaggtatgtaaggcatgatgtaccacctggataaaaatagcagaaatcctgattaaataatttacagttttgcctagagcaatactttagtattagagaatattatcaaatattcttatttccatcattctggattttgctaaggcttataatggtccataattagggctctaacagagaactaatataacacagaatgcagtatggtggaatgcagaaaataagaactctggaatgaagaaagccatgttaaagctctgtctcttttacttaaatatagtgtgaccttacgcactttctcatctacaaaggcacgatacccataactcagagggctactatagaagataatgtgaaagtacacattaaagtacttggtagaataaaaaattaaaacaaaggagtgcggcactaggaaacttgtgatcaatccgccaattgtcccttgatctgttgatgtaagacaggtaccagtgtctaatactcatttgcttcctggaaagtatgggccaaaaaatgggaaatacaagacaaatccacatactcaaatatgtaatacagcagttctgtttataactgagttatctgaagggaaggcagacagctggtttgggaagccaaaatcatttaaacacggacatacagaatctctgaattgaaactcatcattagacaagctaatctagtttcaaatgtcgaacgatactattctgtaacttatttttaattttctgcctttacacagataggcttcaatataagaaacagatattgctgaaaggttgtctgtaatttaacttctgtttgctgtatcacattttcacttcaacttagcagctaagttcttgagcacttgggcatcaactaacagaaagggcattagacagaactcagaagacttcagttctagctttcttcctgtcactgggtgactacttccccctctctaagccacaactgatgtattctggagaaagggagaggagaaaaaatgggaaggctatggtatcagagagtttctgtgatctcttcagccctaaagttgtataattttattttgcttaaggaagaaaatggggacacatgacctattttcatgaaatttatagtctaagtgggaacctaagaaaaaaggacagacaacttagaaagtaggggatagtcacagttgtcaaatgcttggcatagaaaataacagtgactactgattttacaaaagggaaagctcaatcctaaccaagtagatttcaccaaagatctgagtagaaaccttaagaataagcaggacctcaatagagagggcgagggaagataaactacacccttccatgatgcaccagaaatatcacaaactcacaaattcaaagagcagtttacatatcatctaggcctaccttatagagacaacccatcctgacacgtaattctaatcctcagtgaaactcttccaggaagaagtagcttccagctgtaccaggacacgctgatacgttgttggaacgctctggttataaagctcttctagataataaaacagtatttttgtcctttcttcatcatgctttgtaaatagacatttatttgaatatgtctctttaaacatgtaacattaggtactaaacacagaaactgtaatgaaaatcaacttttgaagatagaaggaagactcttcctctttgattaagatgctttaaaagaatctggtttggcgaagccatccccaaactcgcctgcttacctttatgatataccaagtcatcttattttccacatcaaatggcaatgtctgatttttgcccctaaaaaaaacactctgtttctgcctattacaaaatttaatagagcagtttatcacagtttttcatcactcttaatattatatctctaaaacatatttgttttttcctcccatgaaaggtccttcttatttgcaatagaaacagccaaatcataatttaaagtttgagggcaataatccacaatctaagaaaaatcaaacaaaaactttgaacctgagttacataaccacaatatttctaatagaaaattttatctttatgtttcatttcaaaacaaaataacaaaatataacacctttaattaagaaccaaaagcatgatagcacatgtctgtagtctcagctactcaggagactgaggcaggaagattgcttgagcccaggagtttgaggtcagcctgggcaacatactaagaccctgtcttcatgggtttttttttttttttttgagagagtttcactcttgtcgcccaggctggagtgcaatggcacaatctcagctcgctgcaacctccccctcccaggttcaagggagtctcatgcctcagcattctgagtagctgggattacaggcatgagccaccacgcccagctaatttttgttgttttggttttttttttttttttttttgtagagacggagtttcaccatgttgcccaggatggtcttgaactcctgacctcaggtgatccacccaccttggcctcccaaagtgctgggattacaggcgtgagccaccgtggctggccaagaccctgtcttttaaaaaattaaaaattaaaggccaggcacggtggctcatgcctgtaatcccagcactttgggaggccgaggcgagcggatcacaaggtcaagagatcaagaccatcctggccaacatggtgaaaccccatctcaactaaaaatataaaaattagctgggcgtggtggtgtgcggcctgtagtcccagatactcgggaggctgaggcaggagaatcgcttgaacctgggaggtggaggttgcagtgagctgtgatcacgccactacactccagcctggtgacaaagtgagactcctactcaaaaaataaataaataaataaaataaaaatttaaaaaaaaaggaaacagctaagaatgacagtttaaaatattaagacaataaagtccctgctttttctattttataatttctttctctctttagtaaaataattgcagttttcttactataccattgagataaaacatttttaaattattgaattaaattggctttagagtaaaacaaaaattgactcaaaaaacaattactgtgtgtgtactgtgctcagaaatgtgaccagcaatgtaaaccgacagaaccaatggctttttagaaaataacaaagtatttccgatccttttttaagtagagaattttctcccagcacatcctatttccaattgtgtgcaaaaaaccttccagcttacaaatgttaattcaggggttggcaaataaaggcccagaggccaaatctggcccaccacctgctcagtctgcaagctaaggatgttttcttacatttttaaatggttggggagaaatagaaagagtatttttgaatatgtgaaaattacatgaaaaatcagtgttcagtgtcaatgtttctttggtatacagccacacccattcattcacgtattgtacacggggcctttcaggctacaatggcagagttgagttgccacgataagcatgtgaggtaatgcatatgttaatttgctccatttagccactccacaatatatacgtatttcaaaaaatcatgttgtacatgatatatataatttttatttgccaatttaaaataatttttttaaagaagcagctaccacagagaccataagtagcactctctttacacactacaaattgtcatgaggcagttgtgactcacttttgtctcctgcctggaaagcctaaatatttacaatgtgagcttttagagaaaaatgttcttcaaacctggaataattaatatagttattcatcattccttgaagaacttagtataatggcagtctctatgagtcagagctatcaagtaattactagatttcttgaatcttatcatgatattagtgtttctttttgtcaagtctcatatatttatattatgtattaatttttaaaaatacattatctgggccagctgtagtggctcatgtctgtcatcctagccctctgggaggccaaggtaggagaatcacttgagcccaggacttcaagaccagcctgggcaacatagcaagaccttgtctctacaaaagtaaagcaaaatattagcaaggcatggtggcacacacttgtagtcccagctgggcaggggaatcacttaagcctaggagttcaaggctgcagtgagctatgatcacatgactgcactctagcctgggtgacagagcaagatcctgtctttaaaaataattttttaatgaaatgaaataaaatataaaaacatttatcaaagtgtgctccacaaaacggaaaagggatactgttttctcacattccttcaatccgtcaaaaattaaagacctcctgcatacaatgaaggttgctaggaattcaaaataaataagatgtaattcctggctccacgtaattgcattctagtagagagacacagtattccagtagattgttgtcactaaaggaaaagccaaagcaatgacagtaacctttgccatttcataatgtcatacagacatttaaaaaatatcacctctgtctgcattaatggcaagttatacacttaaatagataaagcaacaaggcttgacaaacacatttatccatcaatactttcaagcaaagcattagccttacataagcaattaaccttgaccaacacgggtataaacaaaaatgctgattaagaacttactaattatccttcccaacttcagaagtttagctggcatctggtttttaactatgataaatatacaccaactcatcataggttattaacacataagtgaaaagaaatatttaaccaaatggctacgaatgaagaacacgataaacaaatatcatcattaaaaatccaaacaatgagttgttttctttgaaagcccaagtgtcctacaaacatcactttatttgaaggtagagaaatatttctgagaataattgtctcctgaatcaacttcgagattcaatctgttgtaataaagacaacatatataaatcatagatgcatgacaccgtttcataattagaatgccaggatctgcatgcagttaagcatcctagctgtttgcctgctttacttaacaccagaagagaagtataatcccaacagctaagtattctagcagctgttgtgagcagagtagagagatgtggcatgtagcagtcaccaccacacgtaaacacacaagcaccccggtgactggaggttagcaatcctggtgtgcctgctcgcttttagtgttaaatatttaatggcatatttttccttaatggaacccaggcacatctgatcagtcactgggatcatttagtaatgcagtcaaagttatcatactgccatttcacatcaactttgtaattagataatccatcactttattaattcaaaagattgctttctttactaccttatagcaggctacagcagtgaaacccaacagagctcatcaacaaaaaaggctctaaaatctggtcctacatgaacttgaaaccctcaagtgacaaacatatacacactcctgacctttcaaaacaacagaggtaatactcttcccacaaattagcccaccaacaacaatgaagtaacagagcaccagtgtatccagaatgagatggttaacagaactgaaaatttaagcttaaaagctgaatataacatgatcaactttgttctcgctttttattgaggtacactgttcaccagaggatgaaaaggatacacaaaaaagtcatttagtaattttccctccatgctgatttatatacttcactaaaattatgagggaggttatagcagaatatcacatccattatttatgatcactctaaatgtaaaggcacataccggccaaacacaagcatgtaatcttgaatatagtatcacgattttctcttgctttatttctaacataccacaaaatattaaatcgcgatttcttatcgtattgtgaattggtaagattctcgttttaacaccttcacagcttctccaatttaaaaaaaaaagaatcctccaataaaaaataatttactcagaatgaaactgtaaaatttaaatatcatagtaccaaaaacaccctctaaaatactcactttccaatctatgcaaccagtacatattgcaaaaccagctacagctaatataattaaaaattagattttggaaaagcaagctccggaggtcacatacgtgccctaaagaacaaaaataacatgctaccaggagaattattaatttgaaagaaagaaggagagaacatcttctcaaacagatgtggaatttctaatcaaaaaaattctgtggcagttgcacaacattataaagttcagcagtactttgcagagctccggaaacactaacaatggcatatgttctgtggtcaggaaggtcacttttattcttgttgccgccaatctaatgcctgtttttgaaacattctatgcaactagtctattttctattttattgttcagattttaccacatttctaatcaggctgccaaataaatttttagaaaagaaagttataagcccagaaaaaaaaattatatatttttctagaactctgtacaataatccctaaagaaatcttttatgtgcataaaaaaaatctcaaaacaaattctactgaaattacgttgagactatcaataaccattgccaataattatcaatggacattttaagggatagaatagagaaatacaatacattccatggcgtttcaattaattagaacatgacaactgaagcacgcttaattccatccttttaagatgcatgtgtgagaaagatttccatcatcaagggaagcctacttttacatttcccacgtgaaattccaagaaactactttgataccatggagtttctaagaatgttggcaacagtacatgatttctgtccacaatggctatgactgaaactaagcctcaagaaaagacaccattgcctgtttgcaaaatttcttctcaacaaaacaggtaattctcaggatctcaagagacaccagcactgggcacaactgtgagcaaccatctgagactctagtttacaaacagtggcagactgcgctcttggctagatgacagcacagggagatttaaaacaccaaagttctataatccaataaaaataaagctgagaggtgggagcaacagtagtagaaattaataatatgtgtcagacactactaagtacgttatagttgatcctccttgaaatctatgaagtagatattagtatttccatttacagataagaaaattgagatggagagaattttatttacttgactgaggaaaatgacctaaccatcatattattcagcctcccatttaaatttggcctctctctaactgtaatttttgtttgttttgagttggggtctcactccgtcccccaagcagcactcatggttctctgcagtctcaaactccggggctcaagcaatcctcccatctcagcacaccgagtagctaattgtaattttctgagtttcgaaggatatatttatgcttaggagtatatacattttctatatttgtagcaaatgtttcggacccaatcagtacaccgaatcacagcatttgtcatgccatgataaatttttttgagacagggtctcactttgtagtccaggctggagtgcagtggtgagatcacagctcactgcagcctcgacttcctaggctcaagcaatcctcccacctcagcctcccaagtagctggaactacaggtgtgtaccaccctgctctcagctaattttttttttaagtttttttgtaaagatggcatctcgctatgttgcccaggctgatctcaaactcctgggctcaagtgatcctcctgcctcggcataccaaagtgctaggactataggagtgagccattgtgcctgaccaataaatccatttcaaaatctaacaggtgctgggtggggtggctcacaccagtaatcccagcactttgagaggccaaggtgggtggatcacttgaggtcaagagtttgagaccagcctggccaacatgacaaaagcccatctctactaaaaatacaaaaattagcccggtgtggtggcgcatgcctgtaatcccagctactcaggaggctgaggcacaagactcaacttgaaagccaggaggcagaggtgcagtgagccgagatcacgctactgcactccagcctgggcaacagggtgagaccctattcccaaagagggggaaaaaaatctcaaaggaaattttgtttgaaaatggaagtggagatttaaaaaaaaaaaaaagtgtgtggtagagaggagaaacagcttgtagagatggagacatacatcttctcttctctaaacaatgtgaaaaagagccagcagagatgaaattggcctttattttttatatgcatataaataatcacatctcctgtgttcatctgtatatccccggtgcacttcctatcctttcaacaccttcattgctgtctgtggaaattaacacctttcattgctcacactttacacttttatctccgttcagccacacactccccagggaacatacaatctaagttttttaaaaaaaacaaaactatccaaataaagctgcaagtaatttgctctagcctctccatccaacagattatcactcagcatcccctcctctagagaaattctgggagtatccctaccctcactttctattacatttagtgcaaaacaaacattttaaacatcaagctcttattctaactctactgtaattactaaatataactgaaatctgtattccacaggtaacaacttcctttgaaaaccttctccggaggaggttgatatatttccctcaggaggttggaggaatcaacaccctcactccccaacagcatttctagaccactgtatatcactgtttcccaacaccagcctcgcttttgaaatttacgtcagtttccacttctgatatgaggtcctccttgacacccacccctagaaaaattcctccttcctatggctcatgttactcagtttttacagccaggcaacaaattcataagtggacaggatatatctatatagaaaactccacaatcaaactccaattgctattagggtgtgtgtgtattaacactggtgctaagagtcagagtcagactaacactggtgctaagaagtggggtgaaaaggaggaatatctgggaatatgaccgggaaaattacaagtaacagaagaaattttccaggtaaaattaaggcttacgcagcagatgcacgttcagcattgagaacccggtccgacaggaaagacacaccatttttccgccagaaactccagtgttcaaaatacaaactgccaacttttcaggcaataatcatgagcttccattagaaaaagccatcagctcaccagacgacgaaatatgctctcgggattaagaactttctcatcctccctgagccctttcctttcaggggaagtgcaagtttgataaagatatgcatattcttcaagtaagacttttgacctgctgaagttttctgccttgatagataattttgagatttagaattagccacatacttctacaaccctgtgtcaagagtattttgtacacactagacctgcaaataaataaataaaagtctgctgtacttgctaagcaaattcagattcaactaacaaacacctctcagcagggcaagagacttggtaagaaaagactaattctaatgaaggtttaaaactccgaagagaaagaacatctgtgtgaactgtaagtattaaaaatgacagatataaaatgagtctgaaaattagggaaaccagctgatagaaacatgaagattcattctactagtccctctatttttgtgtgtgtttgaaaatgtccataatttaaaagtcaaaaaaattaagacataagcaattttagaaaagctctcagaattccatatgcctttcaatgaaaattagatggtctaaaactggccgggtgcggtagctcacgtctgtaatcccagcacgttgggaggccaaggcgggcggatcatccgaggtcaggagattgagaccagcctggccaacgtggtgcaacgttgtctctactaaaaatacaaaaattggccaggtgtggtggcaggcgcctgtaatcccagctccttgggaggctgaggcagcagaatcgcttgaacccgggaggcggaggttgcagtgagccgatgttgcgccactgcaccctagcctgggcgacaagagcgaaaactccatctcaaaaaaaaaaaaaaaaaaaaaagatgggctaaaacataagcttagtatgtctattatctgcacagaacctgaatgaatgtaaatgagaggaaccaaaagaaaaacaaaaaacaagatcttgtttattgaggccaggtatagccagccttgttgacagcgtaaattcagaagtcagcagcttcctctgtatgtacaaactgtcagtcagggatagttgcatgttgacccgctttccacagcctaatgaactgacttttgaattttcgctgtgaagaaggctggctttacctggcctcaataaacaaaatcctgttttatgttatttttttatggtgcccgtttcttctctttgattaattaattttataccagagtaaaatgaggagaggagcagtagactgggataaaaatctctgcccagggatcttcacccagttcccgtgtgcttgatgtgacttgcaccatcacacaccgtcaacattctgggctcagtgactcatccctgaaagctgcaggatctatttaggttaatttaggatctttcatgaacaaggaaggagaaggagtcagggggcgggaaggagggagaaggagtcgggggagcgggaaggagggagaaggagtcggggggcaggaaggagggagaaggagtcgcgggggcgggaaggagggagaaggagtcggggggcgggaaggagggagaaggagtcgcgggggcgggaaggagggagaaggagtcgggggggcgggaaggagggaaaaggagtcgggggggcgggaaggagggaaaaggagtcggggggcgggaaggagggagaaggagtcggggggcgggaaggagggagaaggagtcgggggggcgggaaggagggagaaggagttgggggggcgggaaggaggggagtgatttaaggacaaatttataagcagaaaaatacaaattaaaaacattaacaaaactttcaccagaaagtacagaagccataggttattggctgctttcatctgattattaacctatattttaatgcagaagtgacacactaaggccaattatgcccaaaaatctcaaaactgtgtattttctagcaataacaaatattatgtggggagaagggtaagcattatattaaaaattggtacacttaatcatagcaacagaattttccccctatacaacatggagataatttcattataaaatacatgagactaaaatcttcagaaagaaagaagaactaggatagtaattcacattttacatgtagcaacagaaagtattttaaaatatttttcatggatattaataacatcagtaattatcactggaacattttccaacaatagaaataattaccacagaatagccacaaacttaacactaggaatgaggtaataatcatcataaggtatatttttatctttcagtaggtgttcgtgtttatagtgttgaacatgaaaacagccttgggcacggcacacgatactactacaggttataattttcagaagcatatgaaatagatgagaaagttttcagatgcactgtaagaaatcagtaaattttgaaatcaattttaaattatagataaccagaatataatgctaagatgacattaatcagaaaatcataaaaatgtaccatacagaataaaaatacatttgagaaaaactggaataaatctccagcaatcaaaccaattacatttaatttttcagaaaacagtaaattttaaaacatgccttaaaatattaatggcataaatatatcttcaaacgtgtgcttacaaattacaaaataagtggcaaaattgtcaaaagtaaagttttacttgttattaaattgtgatcaacattaaaacaaatgcaaacacacaatgtgagaaagcgaggacagcagatccatagcagtgagggggtgtttctgtcatccctatcccagggtaaatatcaagaagcaatcatttcatgcctatgggctagtgaagaaaaaaaaaaatcaatcatcgcactcttcctccctaggccaagataaaccctcggaatcatttaaaaaaaaaaaaaatacttcaggaggccgggcgtggcagttcgcgcctgtaatcccagcactttgggaggccgaggcgggtggatcacctgaggtcaggagttcaagaccatccgtctctacaaaaacaaaaaaaaaaaaacaaaatttagctgggcgtggtggctcatgcctgtaatcccagctactcagaatgctgaggcatgagactcgcttgattctgggaggcggagattgcagtgagccgagatcgcaccactacactcaagcctgggtgacagaacgagactctgtctaaaaacaaaaaagaaaagaaaagaaatggatttcaataaatttttcatttcaaagacaggctctatgcttaaacaaccaccataaaactcaatgaatgcaatgcaacggcaaacaagtccattcacaaaaaataatgggatatgctattttcttctgagaaaagaaagcatactctttcttccaagggtacactttgagaattcacaatgaacatactcaggcaataacaagaatattaatcaaacagaaaaattcatacccttctcaatgcacacaatacattctctcatgctctactcactatgataaggaagtaatataaggcattaagggtcttgaatttcctgtcaagattctcgacatttttgtaactaacaacaaaataaggagcaaatggttgatgtatggaattagcaaagagcaaacttaacacttacttttgcaaaggcttcaaaaaggtcaaaggcaggtggcagctgagaggcatcctgtatttcttctctcatgaaatgttgaaatgtcattacgagttgcctgaggccctctttcttatcttcagtcagtttgttaatatcttttttaaagagaaaataaatagcacaatctcaaagtaaacttctgaaggataattttcaagtgttcaatgctggctgttaaaccagatatttcctaccttacattggattttgacaaagagcaaatacatattgttttatcttttgacaactaaatatgatgcatatgttatcaattaaattctgccaaattttgtctgcaatgtaagatcaaacacctatcaaaacataagtacgcacatatatgaaaaagcattaaaaccaaaatcactgagattgtgtgttaccagattttctacatcattctgtacacacatacaaacaattatcagttcttattaagtcagtaaacttaagcagacttttccatgaaataatttacaactaggtcatgactaaactaataaacagcatcacctctaaggcaaaaagacagaaaataagaactaaaaagttcagataaagttcaaataggttaaatttgtcatatggctagtacatcatgaatagaacagggatcaagcacagcaatttcaacttcaagttatctgagttgaataaacaagataaaggagcctggcgccgtgactcacgcctgtaaccccaacactttgggaggccaagacgggcagatcacttgaggtcagtagttcgagagcagcctggccaacatggtggaaccccatctctactaaaaatataaaaatcagcagggcgtggtggtgtgcgcctgtaatcccagctactcgggaggctgaggcaggagaatcacttgaacccaggaggtggcggttgcagtgagccaacatcgcgccactgcactccagcctggacaaaaagagagactccatctccaaaaaacaaagacaaaaaacaagatatgatgtggcatcaacccaaacagaaggagatggttctaaaacaaaagaagaagaaaagttctaacgccaatactacccccttaaatatcattttcaatcataccacaaatggggtgttaaggctgaaaggatacaacaggtcaattaataacatgtgagagcatttcacttaaggtcatgtgtatgacactagtactgagtagggctaatgtgaagagtaaaacccatggtaacagatgttatttacctagcagtaatataacaagaaaatttgaatactttgctgtcttttaaaacttgaaaagatacatcaagttgaactacagcataactctgttgcttatgtctatgcatatcctttagattacttattcaacagaataacccaatgatttctttttttttctattttatatgcttgttaatttttttttgatggtaaatatatgtttttttattttatttattttttcttttattattattatattttaagttttagggtacatgtgcacaatgtgcaggttagttacatatgtatacatgtgccatgctggtgtgctgcacccattaactcgtcacttagcattagatatatatactaatgctatccctccccactccccccaccccacaacagtccccagagtgtgctgttccccttcctgtgtccatgtgttctcattgttcaattcccacctacgagtgagaatatgcggtgtttggttttttgtccttgcaatagtttactgagaatgatgatttccaatttcatccatgtccctacaaaggacatgaactcatcattttttatggatgcatagtattccatggtgtatatgtgccatattttcttaatccagtctatcattgttggacatttggcttggttccaagtctttgctattgtgaatagtgccacaataaacatacgtgtgcatgtgtctctatagcagcatgatttatagtcctttgggtatatacccagtaatgggatggctgggtcaaatggtatttctagttctagatccctgaggaattgccacactgacttccacaatgggtgaactagtttacagtcccaccaacagtgtaaaagtgttcctatttctccacatcctctccagcacctgttgtttcctgactttttaatgattgccattctatctggtgtgagatggtatctcactgtggttttgatttgcatttctctgatggccagtgattgtgagcattttttcatgtgttttttggctgcataaatgtcttcttttgagaagtgtctgttcatgtccttcgcccactttttgatggggttgtttgtttttttcttgttaatttgtttgagttcattgtagattctggatattagccctttgtcagatgagtaggttgcaaaaattttctcccattttgtaggttgcctgttcactctgatggtagtttcttttgctgtgcagaagctctttagtttaatcagatcccatttgtcaatttttgcttttgttgccattgcttttcttaaataataatttattaccatgggaacttcagatcccacaaccttatataaatctgtactagatcatcttcttgtctccatccagaagtattaaactgtgcagcaaatttactgtatgtgccctggctagttttgagttgaaatcacttacaaccttaacgaaaaggatctgcgccaatacaaaatcaaaacgaaacctacctttgcttagcactcagatatgggaagctttttaagtcatcacaagaaggtggctacctacatggtagtttcagagaagaatgatgcttcacactgccacagagactgagtcatctgttccttctaccttccttaatgtctaaaagatcagtaaccctaaaagctctgtggaatccccctgttcactaatcactcttctctgacatcaaaaagaaaacagaacaggaaaccaagagacagaagaagggaaacagggaagaaaaaaagaagaaaaatgattttgtcaactggactaatggttacactaccccatgtaacctgaacatcttcatggcgctttactaacccttatcaggacgaagctaccctggaataagtgaaataaaccagtgtgacagttgtatataaaaataaattttgttaggtttgcatcacattataaagaaacagaaaaacatagttaaaaataaatccattcaccaactcagcaaacaaattatagaaacttttttaagatgctgatagacaatcacttacttgactccagatcataaaatgagtaaagcttctctgattctgaaggtgctccatccatctgtgaaggaaaaggggaaaacgccaataacaatttcaagtgttccaatatataaacaaataagtttgagtacctttgtatatttaaatgaaagtccatcaaaaagaacattttctatatattctttctattcatcactctcattagactgaattaatcaacaactttaaaataaaaatctaacttgtatcttcactcaacagtttaatctccaaatgcaaaactcttgtacaaaaagttcccatatttttatattcataaaaccctctataaaatcgtgtaccggccaaaagagtcagtaaacaataggaaaaggtggggcatggtagctcacacctataatccccgatactttgggaggccgaggcaggcagattgctttagcccaggagttcaaggccagcctgggcaacatggcgaaaccctatgcctaaaaaacatacaaaaattagccaggcatggtggcatgcacctgtagtcccagctactcagcaggccgaggagggagaatcacttgagcccagcagttcaagcttgcaatgagctatgattgtgctactatactccagcctgggtaacagagcaagtccctgtctcaaaaaagaaaaaaaggagaaggacaaatcgggagcctacaataatttgagaaagatattcacactaaagatgggtaaaaaaatctaaaaggcttcaccacagcaagatttcacagagtttactgttttgccacttatgaaaaagggccgaagaaatcacttcagtgaattttaggaaataagataagtactcttccagtcaatactaattatgtatgtgtatcttccttgaagaggaaagtagaaaatgacatgctcgccctgtgcattagtttacaatacccaagttataaaggcaatgtaacagagattactaccatctcatacctcagagatagaacctcctccatctttattcccacaagaagatagcagggccttcaaagagagactgtgtatttcttcactgctacagattccatgattaataggaaaagaacaaatttttttgtctaagacactccctggaataatctaccttctacattaacatggggttaatttcagccttaaataggaataacacaggcatacctcattttatcacacttcactttatagtgctttgcagacattgcactgaagatttacatcatcgaacaagtctgtccataccatttttctaacaacacgtgttcactttgtgtctatgtgtgacattttggaattctcacaatatttcaaacttttggttattattatatctgttactgtggcctgtgatcagagatctttaatgttactactgtaattgttttggggtaccacaaaccatccccatataagaccacaaacttaatcaataaatgttgtgcgtgttctcactgctccgccgaccggcttattcccactgcctggctattcccctatctcttccctctcctcaggcctctgtattctctgacacaacaatattgaaattaggccaattaataactttacaatgacctataagtgaaaggacgagtcacacatctctcattttaaatcaaaagctagaaaaatgagtaagcttagtgagaaagaaatattgaaagctgatatagaccataagtcaggcctcttgcaccaaacagccaagttgtcaacacaagggagagttctgaaagaaaatgaaaagagctactcccatgaacacatgagtgataagaaagcacaacagtcttattgctaatctagagaaagtctgagtggcctggatatagaagatcaaaacagccacaatattcccttgagccaaagcctaatccagaggaaagccctaacttgcttcaattctgtgaaggctgagagaggggagaaaattgcagaagagaagctggaagttaacagaggttggttcataaggtttaaggaaagaagccatctccataacataaaagcacgaggtggccaggtgcggtggcttacgcccacaatctcagcactttggaaggccaaggcgggcagatcacctgaggtcaggagctcgagaccagcctggccaacatggtgaaaccctgtctctactaaaagtacaaaaaatttagctggccatggtggtgggcgcctgtagtcccagctactgaggaggctgaggcaggacaatcgcttgagcctaagaggcggaggttgcagtgagccaagctcacgccactgcaccccagcctgggtgacaaagcaagactccatctcaaaacatacatacatacataaatctaaaaaagtgcaaggtgaagcagcaagtgctgatatagaagctacagcaaatgatccaggagacctaactaaaataattgaatttggctacactaaacaacagatttttaatgtagatgaaacagccttatattggaagaagatgtcacttaggactttcatagctagagagaattcaatgcctggcttcaaagaacaagtggacttttttttagggactaatgcagctggtgactttaggttgaagccagtgttcatttaccattcctaaaatgccagggcccttactatttgtggtaaatcgactttgcctatgctttaccagtgggaggtcaaaacagcaacatgaaccggagttcagaagattcagaagaacttggttccaaccttcatggataacactgaggggtcaagacttcagtagaggaagtaagtgtagatgtgatagcaagaacgaaggagctggaatcaagatgaaaacctaggaaatacccttctacacatcagtcttggcaaagaatttatgatgagtcctcaaaagcaactgcaacaaaaacaaaattgacaagtggacctaattaaaataaagagcatctgcacagcaaaagaaacctgcaatggagtaaatagacaacttacagaatcgaagaaaatattcgcaaactatgcagccaacaaaggtctaatatccagaatctataaggaacttaagcaattcacaagtaaaaaacaaacaacctcattaaaaactggacaaagggccaccacagtggctcgcacctatataatcccagcacttggggaggcctaggtgggagaatttcttgagcccaggagtttgagaccagactgggaaacatgatgaaacttcgtctttccaaaaaaaaaaggaaaaaacacaaaaactagcggggcgtggtggcatgcacctgtggtcccagctactcgggaagctgaggtaggaggactgcttgagccccagaggttgaggctgcagtgcgccatgatcatgctactgcactccagcctggggcaacagagtgagaccctgtctcaaaaagtgaaaataaaaagtgcacaaaggacaagaacagacacttctcaaaagacaacatacaggtggccaaaaaacataggaaaaatgctctacgttactaatcatcagagaaatgcaaatcaaaaccacaatgagacaccatctcataacagtcagagtggctattattaaataaaaaaaaaacacatgctggtgaggctgcagagaaaagggaacacttatctactgttagtgggaatgtaatctagttcagccactgtggaaagcagtttggagatttctcaaagagttaccattcaacccagcaatcccactgttgggtatatatccaaaggaaaataaatcactctaccaaaaagatacatgtactcatacactcatcacagtgccattcacaacagcaaaggcatggaatcaatctaggtgcccattaacagcacaatggataaagaaaatgtgatacataaacactatgaaataccatgcaaccattaaaaagagtgaaatcatgtcttttggagcaacatgaatgcagttggagggcattatcctaagtgaattaacataaaaacagaaaaccaaataccacaggtttttactcacaactgagagctacatattgggtggacatggacacaaagatgggaatagcagacactggggaatacgagggggaggtaagaagcagggagtgggcaagagatgaaaagctagctactgggtaccatgctcactacctcggtgatgggatccatcataccccaaacctcagcatcatgcaatatacccatgtaacaaatctgcacatgtaccccctgaatctaaaataaaagcaaaactttttttaaaacagagagaagtagagcctaaagaattataaattaactgattaaaaattaactgattttctgcaatctcatgataaaacttgaaaagatgaggagttgcttcttatgaatgaacaaagaaggtggtttcttgagatggaacctactcctggtgaagaagctgtgaggcatcatatgttacagtgaaatcatttgcgaaaggaagaggcaatcaatgcggcaaattcgactgttgtcttattttaagaaattgccacagccaccccaaagttcagcaaccaccacttgattagtcagcagccatcaacatccaccagcgaaaagatgatgatgcactgaagggtctaatgatccttagcagttttagaaatatattttttaattaaagtatgtacattgttctgttggcataatgctactgaacacttaatagactacggtataatgtaaacataacttttatatttactgggaagccaaaaaatttgtgagactcattttattgcaatatttgctttattgtggtagtctgaaactgaacctgcaacatctctgaggtataccggaaaatgcaattgcatatgtttatttaaccaaaacccagctatatttcatgagttttatactcacaagtttgaagacaactctgccaagaagtcgaacggagtctggaggatatctgggtttgcagcttttaaggcatttgcattcccgcttgtggtctggccaagcttttttctattaaaacaagagtggggagaacataggtgacctaaaatttaactttcatttatactggttttgaacatcaagagtcataaacattaaattttaatagtccaaatgtaactgcacaatagaaaataaaagcaatattctaaatctgaaaataatccaggatgagtctttgccaaatatgcaattactatgcaaggacattaaaagcctcagcttcacctctgtgctttcatttgtcccctggttattacctggctagtggagtccaaagaaagagccattacagcttacttaataatgtataagatggtcttggaactgattaaacaggattcaacaatagtcattttgaatacaaaaggaaaatgtcactccaaattagaaaataaaacgtggttcagaagactcaaaatagggatgacagccttctgaatttctgtgctgctacagaaatatcaggagggctaacacacccccaaatataaaatctctttgttttaaaagcaacataaaaagaactattagctaaaatcattaaatgtccagtttgtcctggatgtgtctaggtttgtatctatgtcctggcttaaatattaatagtgccccttttcactctgaaaagttctggttttgatgacaaattatatggtcacctaagccatgatcctagccatgtgttgatgtggctaaagagaccattgagtcagttgccaatgtacagatgaatggactaaagggaaggacactatccttgagccttggatcagaaaggcgacggctcctttcacacggaatcactttcatatggaaataaaatccagatcatctaatatttagccctggtgagtagaagaagcctcaatcaaatgtctctcgtgttatattctgaaaattggaatttccattactgaaatgcctgataccacttactcattcttatttcaaaaattataaatctgctcctcaatttctgggtctacaaaatcaatgtgctgttcataatttttgttttagcatttacacttcactcacttctaaacaagactgagctgattcaaagtaaagatgtgtatgaaataagactgcaaaaccagaaacagaacatattaaaattatggaagggggaaaaaggaaagcacgctagcatttacttagcattctacaaggtactagatacatggctaagcaaataacgaagcacgtttcacttgattttcgtaacaatccaaatggtaggtattatccctctattacaaataaaggctcaaaagctgatatctaactatcaaactgcccaaatacaaaaagagagagtaaaaattcttagcatgctaaacatgagagctgaataatttctgcattacatttgagtatttgtacgtcacatttatttgagatgccttacaagcaaggcaaaaaagaaggcataatggcttatataatcctcaactgacagaaagtaaaaacatacagtttcaccaagtattaaatcacaggagggatttattccaagaatgctaatcaacacactgaacaatgtccttaacaacagttcacaactataatggcctttcatatgacttctaatatcagtactcactgaaaggcataatattaaaatacaactcagtgaaagaacaagcttctgttgctcagggggctagtccttgactagcaattagcaattaccaatgtgtgtaagaggcctaaaatatacatggtacaattgtcaagtaagttttaaaaacacaatatcatgttgaccctacttagagattcaaaatatacttagcatcctaaaagttctaaaagtctatgcactaaagaaatgtgtataaattatttaacacagtttcccatgcttgttattgtcaccctttagagagttaggttggtattcactaactcagatatatctatatattttttttcacctggtctttgtatgtgagtgggttaagctaacaaatttacattcatttgcactcacaagaaacaagaatgttaacttttttggttttttactgatagaagggagaaccataactttggcgttagttttcctttgattatagaagttgagaaacctgtcagatgctctcatggacagagcgtgtaggcaggaacggataacatagtgccagtgggtctatcagaaagtaccttaggctctgttcaaatgcctcagtgtccagctgaacagggctcacactcagcaaaacaaggcagagataatttgaggcaaaagaccttaagagcagattttaatcaatgctcattttaattacaagagatcatccataacccctctgttaaaacctaaatatttgagcagctcagcctcctgatagcttaccagggtgagataagtacaaaacgtacaccagataatgaacaaccgatcagttagatgacagcatttggaattaaacatccaaattttggaaaattcctgttaaaacaactttaggtccttaacataattgatatagagctccttttctcaacaataactagaaactagacaaaatgtttcttaaacttattcctagatcattgcctgaaaacatacttattttctcatttgcttcagcaaaaatatgttcattatttccatgaaaagccaaatcagatcatttaggcataaatagagaaagcaatcataccacttaaaattggtctgtaatatggtaccacatatcagcccattccttttctttttaaaacattaactgttaaaatttatcattcagcttcacctatcacatcttaccataagggttacgaatacaagcataccatagaaaaggcttacaaagaaatctttttacgcagctcctttgactttgaagcaaaacgtgacaatcatacaaaaacaaaaggcattatcttcactcaacaaactaaccttggtcaagacctcgatgacacatttgtcatatatatttgccaatttctcaaaagacaaccttcctgatttacattttttcctattttcttacattacttccaatacaggatataattaagattttgctcataacattggctgtagtattttcttttgtcatagctgaaaattaacaatgatgtacaataagcatgaactggcttgagagacaaaggaaattaaaatactacattaagaagtaaaaacaaaaggagacaagagtttcatgctggaaaaaaaggaaatgacatctataacacaattctttcagtgcatgcatgactcaaaaaacaacttcagaatctatacagtttcataatgtatttttatagtatttataacagttcacgacataaactcattaaccacaccagtagttctcaatgggagtgacgcctatcttgagggttgtttgagaaatttatgcgggtatttttatttgtcacaaggtttatggaaaattacaggcacttaatgagcaggaaccaaaggagccagacattctgtgtcggacagttctccacaatgaagaattatccaaatccaatgcaactttcaagtgtccaaccaaattccatgacggtggaaaacttgtttataattgtctgagcctagaactaaatctccttttacatttaaaaacaaagagctcgtttttacataatcctaacagcactgaattttctaggtaaatcaaaggaagactgtattttaagaattttacctaaattactcaattaaagccatatcactgaaggcaacaccacttagagtacttgagttaccaatacaacacggcttctgacccgcatctctacttcccttctcacagtgactctatgtataggtgcaaatatgtgactaatgatgtcttccagtctaatacctcagcatttatatactaaaatacatattattttatcataggttttaattttctttttccttatattccaattatggcattatattaatgttttgaaaatatgtaactaggtatattgcactacctgtaaaatttcatttcaagatagtagagagggcaataaaaatagttctcacaaaaatggggagttgggtctgaaaagaactgagaagcccagatctaaaaaaatgctacacagttacacatgccacacacatacacaagaatatatttttaaacacatagcctaacacccaccctagggattctgacactacccatgagacagaatcaagcatcccactgcagggctgctatggtttcaatgtgtacctcaaagttcatgtgctggaaacgtaatccccagtgcaacatgttgagaggtggggtcgttcagtagcacagcgctcacgaacggattcatgtcactattgcaacagtgggtttgctataaaagagagtccggccctctcttgttccctctcaggagcacgctcccgtcatgtgacgccttctgccatgctaggatgcagcaagaaggcccttacagatgtaatccctcaaccttggacttcccggcctccagaaacaccagccaaataaacttctattgtttatgaatgacccagtctgcggcactctgttaatagcagcacaaaaacagatcaagacaagggcattccatgagtagctaaagttgaaaaaccactgagttaaactaaattacaaaggaggtcgttatatatactaaatagatgaaacaaaatacaattctataattatcattgaactattgttctatagaaataaatattgtataatattaaggtggaaaaagtgttttaaacagaacataaaatgtaaaaaccataaaggaaaataaatatatattcaattacataacaataaagaatttttgtcttgggggaagaaaaccagaaacaaggtttaaaggtaataaaccatgaaacagtctaaaatacatatatagacacagtgttaaatgtctccaatatacaaaaaggccttacaaataacttttgaatatttcaaaaaatataaataaaggtaaaggaaatgaataggaaattcatgactgaaaaagaaaaaccaatagacaactaatacaaaccacaccagtgctcaaagacatgataacagaaactagataacatagtgtcccattaatttggcaaaaatgaataaaactggcagtatttagaagcatctaggatttggggaaataggcattttccagccttgttagtagagttgtaggctgctctgatctttctgatgggtatttggtaatgaatatcaaaattgtaatgtgcatattgttgacacagaaatattattcataaagtaatttattttaaaaaatttaaatagtataaagaaataaatttaagaatgttccaccctaagcaacatagggaaatcccatctctataaaaaaaaattttttttagttagccagacatgatggcatgcacctgtattcccagccacaccagaggctaagaggagaggatcactcccagctatgctggaggctaagatgggaggtcgagactacagtgagccatggtcacaccactgcattccagtctgtgtgacagagtgagaccccaggtctcagggggaaaaaaaaaagaatgctcacaatagaagatgattaaaatactgaaagttaacttttccagcttttcctaaaagaaattgctatttttgtctttctctttatagctttccattactatttaaattttctacaaagagcatggagtttatgaataaaaacaaatataattttatgtgtagtaactgagaatcagggagaagtacttttatacgaaagggacagcaaaattactgtttaataggcactggtgcttcttaactttttaatgtttattttggaaatctagttgcaactcaaagcatgatttaaatgtgttaatttttaaatgttaaaaaatgcttcagtgaactgttctgtaatgctgatgcaatcttttttaattcagagattcactcagtaaattcttttattagtttggctatattcatgtctgtttttcttaaatgagtatagtaccaattaagtacaccttgcatgaaacaggtgttcaatacatattttatgatttattctaaaaccagtaccattcagggggtaaaatttactatatattatcattatttgaaattaaggccatacaaaaagaagaaatgaaagtagactctcacaattctttctttgaccaataagagatggtcttgattacatgattatgaaaggagtgtattgatgagatgttacactaataagagaaaatcaatttatttctttcttacgcaaaataacatttgcactattatcatatttccctctcctctttacatacaaagtccctattgctcactcaagaacccatttaaatgctgttaaacaccaagttttggttggagtggatatccattttagggtagctcattattgtttgggatagagtgtaagaagggtcatcctgtattgaaccttggattgggtaaaatacatccaattcatgacatcagctcactaggtatttattccataagaagattagattcaaagatctgcaaggcagtcttccaatgataaaattctgagtctgtaacatccattcctaacaaatatctgaattatgtcaaaataggtttgaaacctgcttgggttaggcttacaatcattgaaaatttgcaacagtattttcctcagctatttggtcattaaggatgaagaagctgtctttaaaaatatagaaaagaaaatgaattttttgagcccacttattcaacagtttcatataatattaactaaacatcttctacgtgaaatatcacagtgatttttttcctacatattcaggacttactccactcacaaacaatcatctacagaggtttcctatgggcaaaacttaggatagttgagctgccacgcaacttgcaggaaataaaagatactcgacagttttccatttacatccagtttgcttgatagcaaataaataatgcctcctcctttatccttgaaatgtagtccaatattgaattacagattgtcagatgcaggcagatctgaaaagctggaatctgggaaaagaaaactggaaggctaagcaggttgtctaacagctacagttgactgacaggtattgattaagatcttgcaaaaaaatctctttagagcacactagagattagtgatagatatgagacttctcactttaaaagcttactgaatgctgtatcaaatgtagagcaagagcatcttctcactagtcttaatcaaattagatgaatagagctaaatataaagaaggaatgtgccatgaaaatggtcttagggcataaggttgacaagaggaaaaaaagaacgtgaataaatgaccatttcttgggcaaatgggaattacggtctcctgttaagtgaggaacctataatatgagacaataataacaacagtgcccccaaagtaagtcaatcatcatctactgcagggttccaaaaatatatggctcataggtaaaattcattttacatttttacatttatgtaaaattcaaattcatgtacgttctaattcgtgctacatttttagtaaaattgtacattacagggatagagccacacttattagttacattcattcatttcatgctacatcagagttgaacacatacgacaaaaatcatatggccacaaagcctaaaatatttactatatagttctttacagaaattagccaatgcttgatctaatgagagatcatatgaagacgaaatgacttaattgatagtttggctggaaagcaaaataaatcatgcacttccacagacttccaatcttatttggaaaaagcatctatcctagattaatcaaaatatcaacaccagcttctagctgaatacggtaggtgagcacatgtattttatttcctcaaaacaagtaattatcaaattttttactcccaaagtgaactggaacagccatcaatggatgagtggcagggaaggatgtggttagccccatttgagagtgaaaaagtggtggtaagaggacaggctgcagaagcagggtcaaagaggccacatgtagggacagtcccatctgagagggaaggtcagcctgccaagcagaattccagaaaggatctagaatcaaagactatacattggtagaatggaattgaaaaatagatgagaaagagaaaattaaccacaagtctgtatgccaaagagtctcaaaacaccccttctctacttttggcttgattgagtaagcaatggaaggttaatgtacagaatcttgttgaatttgatgctaagattatctctgatccagattattgctatagcctcctatttggtcttcctgccctgactcttacccttctacaacggcttcttcaaacaatagtctaattctttgagtggcttaaaaattgtgatcactgtattacagaaaaagaaataaaatctatgcatacttaatagctctgtggtgaccaatatgtttcaaactacttacttgaaatataatttacattattaaattatatttaggttggtgcaaaagtaattacttttaatggcaaaaaccacagttacgtataataaaatgtatccattttaacagtatagtttgataaatttttgtttttttgagatggggtcttgctatattgtccaggctggtctctaactcatgagttcaaacaatcctcccaccttagcctcccaaagtgctgggattacatgcacgtgccaccacacccagctttgataagttatgacacatatatctccatataaccaacaccaaaattaagctacagatgttagtactccccaaaagttcccttgtgccccttacattcaagtcctccatcccaggcaactcagtggttttgtctctataattgtaagatcagttttgtctagcctagaacagtcttacttcttttcatctggcttcattccctcagtacagtgttttgagattcactaacgttgcggcatgcatcagtagtttgttcctcttaatggacaagtaatagtacagtatgcatctctttattcatttacctgtggatgaatatttcacttgtttccaggtttggaacattgaacatttatgtacaagttgtttttgtagatgtaagttttcataactcttaggtaaataactaggagcagaactgctgggtcatacagtaagtacacctttaacattattacaaactactaaactttcccaaaacaatgataacgctttactttctcaccaccagtgaacaagagttccagttgctccatcaccttgccagcacttgacaaagtcagtccttttaattttagtctttctagtgggtgtgtagtaatatctcattatggttttaattttcatttatctggtgaccagtgacaatgattatcttttaatgtatatcttcttaaagtatctattcaaatcttttacctgttttactcagttttcttactactgaattataagtattctttataaattctggaaacaacttcttggttggggtgagagagagagaaggagggagagaaagagaaaaggagggaaacagggggaaagagaggtctcaaatattttctccatgtctgtagtttgtctttccaaggagctgaagggtttaattttgatgaaaatcaatttatcaatttttcttggaggcttagtgctttctgtgttctacataggaaattttatgtaccccatatccaaagagtttctcctatgttttctcggttttatagttttagcctttaagtttaagcttattgaacctaaatcttattaaatctagtgaagaattgtttttacttttatcatttattttccatgtgcatattagcacaattttttgaaaagatcatcctttcattattgaattatgttggcacctttgttgaaaatcaactggccatatatgtgtagggctatagtttttatatttttatttctgaatacaggttgagtatgccttatttgaaatacctgggaccagaagtgcttcaggttttggatttctttggattttgaaatgtttgcgttatacttactggctgaaccatcccaaacctaaaaatccaaaatccaaaatactccaatgagcatttcctttgggtatcatgctggtgcttaaaatgttttggattttggagcgctgcagattttttgatttgggatgctcaacttgtattatgatgtgttgacattttaaaaacctttctgactaaggagaagactgctcctgctcctcccagggacagccaattctaagaaatagcaaaaagctcaatcctgagcatgcctttgataggcaaactaaatgatccacagccatacatcctctgtctggccctaacaccctaagaggcaatattcttctgccttaatcatcccagggccaggtaccaggcaaacagagaccacccttaaaccccaggatcccctgatattactcaaactagccaatcctaaactgagaaacacctatgaatgccacagtccagggacaaaggctcaccaaaaacccaagacctaatcatagaactatagaactggccgggcacagtggctcacgcctgtaatcccagcactgtgggaggccaaggggggtggatcaagaggtcaggagatcgagaccatcctggctaacacggtaacaccccatctctactaaaaatacaaaaaattagccgggcgtggtggcgggcacctgtagtcccagctcctcgggaggctgaggcaggagaatggcgtgaatccgggaggcggagcttgcagtgagccgagacgttctactgcactccagtctgggcgacagagtgagactctgtctcaaaaaaaacaaacaaactaaaaaagaactacagaacagttcctctcctcttacatcttgccatcacactactaaaggcctatttacagtggttccttttacatcacgtctagctatcaagaaaaaactataagacatactgtattagtacattcttatgctgctatgaaaaaatactcaatactgggtaatttataaaggaagacgtttaattgactcacagttccacagggctgtggaggaaacttataatcgtagtggaaggggaagcaaacacatccttcttcatatggcagcaggatggagaagtgcccagcaaagcaggaagccccttataaaaccatccaatcttgtgagaactaactcactatcaagagaacaggatgggggatactgcccccacgattcaattatctccacctggtcctggtccctaccgcgacacatggggattatgggaaccacaattcaagaggagatctgggtggggacacaaccaaactatgtcacatactaaaaggcaaaaaaacatagtttgaagagacagagcgagcattagtaccagactcagatatggcaaggatgttggaattatcagactaggaattttaaaaaactataattaatatgctaaggattccagtggaaaaggagacagcatgcaagaacagacaggggatataggcatagaaacagaaattctaaaaaccaagaagaactgctagatcaaaaacaccaacaaaaataaagaatgcctttgatatcttattggcagactggacgtagctggagagaagaatctctgagctgaaattatctcaatatggtaaccaccaacattaagaagcaaagacaaaaaaagactttataaaaaaaaaacagaatatccaagaactgtggaatgattatataaaggtataagatatgtgtaataggatatgtcagaagaagaataaagagagaatggaacagaagaaatacttgaagtaataatgactgagaagttctcccagattaatgccaggcaccaaaccacagatccaggaaactcagagaacaccaagaaggataaaagtccaaaaatctatacttaggcatgtcattttcaaactacagaaaatcaaaagttttttaaaatactgagagaagccagatttttatagctaaagataagtatatgtctgttttaggtgtttatagatactgaaatggtttcagtaatatgtcattttctgaaaatctcaaaacacttgaaaggtgtgtgcaatggtttgaaggtctgtaccctccaaaactcatgttgaactttaattaccattatatcagtgttaagaggtgggaccattaagaggtgactcagccatgaaggctctgtcctcatgggcaggattaattccagtatttgatgccctcttgtctcctggcccttccaccatgtgatgtcacagcaagaaggccctcactacatatagccatcttaatatagaacttccaggcctccagaaatgtgagtcaacaaatttccgctcttcacttatacactgatggtgggaatgtaaattagttcagccactgtggagacagtttggagacttgaactaagtcttgaactaccatgtgacccagcaattccattactgggtatatacccaaaggaagataagtcattctaccaaaaagacacatgtacccatatgtctctccctgcgctgttcacaatagcaaagacagggaatcaatctaggtgcccatcattggtggactgaataaagaaaacgttatatatatatatatatacacacacaccatcaaatactatgaagccataaaaaagaataaaatcatgcccttgggccgggcgcattggctcatgcctgtaatcccagcactttgggaggccaaggcaggtggattgcctgaggtcagcagttcgagaccagcctggccaacatggtgaaaccctgtctctactaaaaatacaaaaattagccagacatggtggcaggtgcctgtaatcccagctactcaggaggctgaggcacgagaattacttgagcgtggaaggcagaggttttagtgagcctagatcgtgccactgcactccagcctgggtgccagagcaagactctgtctcggaaaaaaaaatatatatatatatgtcttttgcaacaaaatggatgcagctggaggccattatcctaagcaaagtagcacagaaacaggaaatcaaatacagtatgttctcacttacaagtgggagctaaaattgggtacacaagtgtataaatatgggaacaacagacattggagaatataaggaaggggaaggaggaggaggtgcaagggttgaaaaactaccttttgagtactatgcttactttttgggtgacaggttcaatcatactcgaaacctcaggatcacacagtatacctttgtagaaaacccgcacatgtacccccagaatctaaaataaatgttgaaaacaaattaaataaatttgaaacaataaaaataaatttttttctttataaattactcagtgtcagttattctattatagcagcacaaaacagactaaaataaacaacttacatatagaggaacaaagaatcatagccaacttctcagaaaccatgtacaagagagtggaatgaaataaagtactgagagaaaaaaaaattactaatctagaattctgtaccctgtggaattacccttcaaaagtgaagggaaaataaagactttttcaggaaaacaaaagttgaggaaatgtattgccagtagacccacccgcatgaaatgttaaaagaaattctgtagagagaaggaaaattataaaggttagaaacttagatctacataaagaaagaatgagaatcaaagaaggaataggtgaaggtaaaataaaaactttcatttttcttattcttaattgatctaacagataatagtttgttcaaaagactgctaatagcatcaatgtatttaattatgtatgtttatgtataagctaaataaatgacataagagagggagcaggggccgggcacagtggctcaggcctgtaatcccagcactttgggaggctgaggcaggtgtactgcctgagcttaggagttcgagaccagcctgggcaacatagtgaaatcccatccccacacaaaatacaaaaagtagccaggcatggtagtgcacgcctgtagtcccagctatttgaggaggtgctgaggaaggaggatgagttgaactgaggaggtcaagtctgcagtgaggggtgttcaggccactgcactccagcctgggtgacagagagagatcccatttctaaaacaattttttttaaagagagggagcaggaattaaaagtattttgttattctaaggtactcattctacctgtaaagtggtaaagtgttatttgagagtaaacttggattcgtcgtaaatgtatattgcaaactctggggcaatcactaaaaaaggagatatatctatatctgatgttctaatgaagagaaaagaaatcatacaaaaggctcaactgaaaccacaaaaggcaaaaaatagtgaaagacaacaatcagaacaaataacaagggcaacaaatagaaaacagatacgataaatattaacccaactatatcaataatcactttgaatatcaatgatctaaatgcatcaattaaaagacaggaatggtcgcagtggatcaagacacaaaacccaaccatatgtcatccacaagaaacccattttacatataaatagattaaatgtacatggatggagaaagatataccgtgctaacactaatcaaaagaaaagcagaaagagctacattaattctagatttcaggttaaatgtcacctctacaggaaacccttctgtatccacctactcacaggtgagtttgtgctcaccccaatcacattcaatcatataatcatgggcatttgtcactgtctctctactccataacagaagctttatcaaagtcaggaccttatttacttgctcactgcctattacttatcataccaaccaccaggacttagagcataataatcactctaactcctgtgtagaaaataaattagaagttggaaagaatcgtagttaacaatgcagctaatccagaaaagagaccatggtaacaggtagtactaaagaagctgacgagaagggaaccaattcagatctttaggtagtaaaatagtaaaatcagcacgacatgatgactaaatggatctgtcgccaagaaaggatgagaatcggagatgacacctggcaactcagactgctgggtggctggtgaaactgttcactgaggctggaaaacatgaagggaagtgggtctgggggaagataatgtactcagatttacacgttacaccagagacgcctgtgcaacagccaagtggaaatcaggagaaaggaggctggagacggagtcttgagaaggattaatatacagatgccacttgaagtcataggagcagataacatcacacagcaggcaaaggtaaagtgggaaaagaaaaacttccggctccagacacctgtggaggtcaaaaactgaaatacgaccaaatcgttttaaacttcatgtagtactccctttgtgttgacagttagatacaaagctgacttatctacagtacattccgtgcaaagcctatcagtttcaggccgaatttatgaagtaaacaaagcttgacttccttcattatcactgctttggttatggtagtctaagaaccagcctattaaatcactctgttaagtgcttactaatgtgggattaattttctacccatcgaatatgaatcaaatcattccacaactaagcataaaatgtaaacccaaaaatacgattcacatttttaaagaggtctataattatcaatataaaatagagcttgtatctgctaatacagtgcttttaaaaagtatataaattacaatttgatggagtgcctaactccttattttgctcagcaattaattcattcaactagaaatgtatatattatcaatcatattaaatcctcaaaaggtaaaataatacttggtgaattacttgaaattgacttacttgctatcaccactgctgccattttttgttttgaaaatgcttttttataagaaattttagcctgctcctcctctttgatctcataatcatgtgtgatgttctgtttatagcaatagagaaaaaagactggacctccttctatgaaattatatgatagacacctgataataaggtatagaccagaatataaagccagtgatgacaaaaatattttgaccagtaacagaaacagtactgtacacaggagtaaatacatatgtcgatgtgtacgctatatatgatgcataaaccaatagtttggtgtatatcctccatccataaaatagacacatatggattatctctgaaaaacagaagtagaagcgggggaaggaagctggggaaagacttttatgttttaccctgtatgattctatatggtgtttttataataaaaacatatccttgtattgcttatgtttaaaaatgaaatgtgcaccagatgcggtggctcacggctataatcccagcactttgggaggccaaggctggcagactgcctgagatcaggagcttgagagcagcctggtcaacatgatgaaaccccacctctactaaaatagaaaaaattagctgggcgtggtggcacatgcctgtagtcccaactacctggggaggctgaggcccaagaattgcttgaacctgggaggtggaggttgcagggagctgagacggcaccactgcaccccagcctgggcagcagactaagactctgtctcaaaaaaaaaaaaaaaaaaaaaaaaaaacataaagaaagaaatgtgaataccaatagcactgacaccatcctgtgggcacaaggtacatgttacacctgcaataccccaatagcctctctcagacaacttgatgccatggtcccacacatcaaatgctaagctagtgaaccaaaatcatgtccccctggggtatacatattatggattttatactacagatttacatcctctgtttcaatttccattccaagtgcttttgcgttctgttcatcactgttcacagttcagtatgtcatttaattttgcgtagttttgtgggtatccacaataattacaatgtttaatgttgtattttaaggttgagataaacacagcagtttaaacgcatatgttctggccaatctttaactccccctccacacacacaaacacatactctagctgttattacatatatccttcatcttgctagctgttttcctgttaccttccacagtatatctgacagtgacattgttattgatgccacagtaaacagctaatatatgtagtaaaaacacatgcactacaggtaatcaaaatgacatacccacccaccaaactcctgctactcattctaatcagataatggcttttctcttccctgagtgtactacaaaaggatgatgtggcactagaggaaaaatagtcacaaaacaggggaaaaaaatgttttattaagtaaactgtttattaagtgttttattaataaactgtttaggtcattgagattagaaagcaagtttgcctagacttgtgtcaaataatatgataatctgtcgcttctctatgtactctgtttaatctgaagttcctagaaacaaatagctgagcttcacgtgaataaaacacctagaacatcaccataaaccaagctttctggaacgaatactgtataaaaagcagtattaatgtttcactttttgcttttagttactcttgttggtaacaatcttacataaatcagggatctttctagcttcgacaaaacttttgtttaaaaaatgaggtagaaataatattattgttttgaaatttcctatcctattttaattagaaagtgttatactggctgggcacagtggctgacacctataatcccagcactttgggaggccaaagcaggaggatcactagagctcaggagtttaacatcagcctgggcaaacagtgagatctcgtctccattaaaatttttttttaaattacctggccatggtggcacgtacctgtagtcccagtggctcaggaggcagaggcagggagaccgcttgaacccaggatttcaagactgcagtgaacttgataacaccactgcactccagtccaagagacaaagcaagactgtccccaaataaaaacccaaaagccaagaaacaaaagaataatacaatatataatggaaaactagacctaatcagaatgttagagcaagaacagaatttaggtttaaaagagcagttaaaagtctgaatacctgggtttcattcctgaaacttcagagcctactagttacagaatatttggcaagttggctgtctctctgtcctcattgtccttattaataaaataaaaataataatagtacctaattctcacaagactcttggaaaatcaaatggaataatacagtgcctggcacacagtggatgcctaataaatattaactcttattgttagtacagattcagaaactgaggcccacacagtgtgtgttttccctgagataatttaaccagcaaatgccagaattagcatgagaacctggaacccctgatatttttgaacttttgatttcttttccattaagaccactttttgtgtcgtctcaaattactttcaaaggataaaatgagagagaagaaaacccctgagacaagcatggcctaaatttaaaagaaggaaagaagaaactctggaggtgtgtgtgcatatacaaaacataagaaacaaaaaggatgagtggagggtggcagggaggaggcaagtgacatagacacaaaacctctaattagacttttaataagatgtaactcattaggacataattacatttcttattaaatgattaatcataaggttagaagaaaaggtcatgctgaatgttaattatacatcctttcaagaatttcaaagatgttaacaacagtactcgtaaattaactcaaactcttggcaggatatttggcattatctttaaaaattcaaaaggcatatatcctttcaacaatcaatacaataagaatttatcctactaataatttggggaagtgtgcaaaatgtgcaaaacaggatgtgaagtgcattattggcaataccaaatattagaaaagtgccaagcattcattaacaaagaaattattattatggtcaattcatacaatgaaacatatgggatacaaaatgttccccaaagtagatcgttaaatgaaaaaaaaaaagtacacaagaattcatgccagattaaactatatctttttttttttaaacataggatgtagatacacaaatatgtctgcacaagcaaatgctgcaaagacacatgagaaacttaacagtgattgcctgtggaaatgagaattgaagtcggggggcaataagatggggaggaatagacatttactttcacatagtagacatatacacacacacacccaatttttaaccatatatatttaacatcagttttaacattttaatgtccctggcaacctgtgtgactcagcaggtgaataacaagtaaaagtaaattaaaggctgtaaagaagtagacacaggccaacaggtatagtgaaggacaaatttaagagtaaagaatttgaaagcttcacttatatatggctgaaaagtcttacctgacacttagcactacagtatttggcgacgcggcactgagagcatcgcatcagcttttccttcctgtggggaaaaaaattaattctgcattaagaaatgagtgggaaacatagtacatagttgaagaaagaaaacataagtcaacatacggacacccgtatgttctgtttactccattatgtacagtcccttaagatttggattttcacactgatgagcctcctcttgaaccttccatgtgagacactgatagaaaaactaagtccttttgtctgacagaagatggcggggaagaggcaggaccagcttgcagctcccgatcggacagacagagcagcgtgtggggactcacactgtgaacttttgatccaacaactgccacagcaacataccaggtaaactaagagaatccacagaccctctgaaggaactgtatcgccactgcaggctccctgagactctgaaaagatgtgagctgcctgcttgctcagcagggaggctggcggtctggggcaagttctcagccacagtcaccagctgcctggaaacagactccgtgctgctgtgggggcacggtgggagtgagaccagcctttaggactgcgggctgtgtgggagtgggatgaggcctgtgactgctggctttcccccacttctctggcagcctgtgtgacccagcagaagcagccataatcaccctgggaacataactccattagactgaaaaccacatccccatcccaacagcagccgcagcaatccccagccaaggagaatctgagctcagacacacctatccctgccccctggtggtctttctctaccagccctgggtgccaaagacaaaggccataatctcttgggagctctatggccctgcctaccacctaagaaacctgaataggtaaccaggcgaccttagggcaagtttgcttcctccctgtaggaccacagctgatgtgttcctgaaagcaccaactcctggctggaggccaaccaacacaaaaccagcacactaaacaaaaatacaaccaagggcccttgtagagtccacttcacgcccctgctacctccatcagatcacaggactcttagcagtcactccccagtaccagcccagagcccagtacctccactgggtggctagacccagaagagcaaaaacaatcactgcagtttggctcttgggaagctccatccctgggggaggagggagaacaccacatcaagggagaaccccttggaacaaaagtatctgaacagcagcccttgagtcccatgtctcccctctgacacagtcacccaaatgagaaggaaccagaaaaacaattctggtaatatgacaaaacaagctctttaacaccccccaaaagatcacaccggctcaccagcaatggatccaaaccaagataaaatatccggattgcaagaaaaagaattcagaaggttaattattaagctaatcaaggaggcaccagagaaaagtgaactccaacttaaagaaatcgaaaacctgatacagaatatgaaaggaaaattcttcagtgaaatagcataaataaaaaatgatcacaacttctagaaatcaaagaaacacttagagaaatgcaaaatgcactggaaagtctcagcaacagaatcgaacaagcagaaaaaagtacttctgagcttgaagacaagtcttttgagttaacccaatccatcaaagacaaagaaaaaagaatttttaaaaatgagccaagcatccaagaagtttggaactatgttaagcatgcaaatctaagaataattggtgttcccaagacaaaaaaaagaaatctaaaagtttggaaacattatttgagggaataatcaaggaaaacttgtctgaccttgctagagatctagacatccaaatacaagctcaaagaacacctgggaaactcatcacttagacacacagtcaagaggttatccaaagcaaagatgaaggaaagactcttaagagctgtgaggcaaaagcatcaggtagcctataaaagaaaacctatcagagcaacagcagatttctgagcagaaactgtcagaggcatgcatgtgaaccagggcaactctatcttgaataggagctgagttaaatgaggctaagacttactgtgctgcattcccagacagttagggcattctaagtcacaggatgagactggaagtcggcacacaatacaggtcataagtaccctgctgataaaacaggttgcagtaaggaagcctgctaaaactcaccaaaaccaagatagtgataagagtgaccagaggtcactggtggtcctcactgttacactcccatcagtgccatgacagtttacaaatgccatggcaacgtcaggaagttaccctatatggtcaaaaaaggggaggcatggataattcaccccttgtttagcatataatcaagaaataaccataaacatggacaaccagcaggcctcggggctgctctatggagtagccattcttttgttcctttactttcctaataaacttgctttcactttactctatggactcaccctgaattatttcttgcatgatatctatgaaccccctctgtaacaaaaccctataagctagaagggattggggtcctatttttagcctccttaaacaaaacaattatcagccaagaattttgtatgcagcaaaactaagcttcataaatgaagtaagatacagtcttttaagacaaatgctgagagaattcgccactaccaagccagcactacaagaactgccaaaaggaactctaaatcttgaaacaaatcctcgaaatacaccaaaatagaacctccttaaaacagaaatttcacaggacctacataacaataacacaataaaaaaaacacaaggtattcagacaacaaacagcacaatgaatggaatagtacctcacatctcaatactaacattgactgtaaatgacctaaatactccacttaaaagatatggaatggcagaatggataagaattcaccaactaaatttctgctgtcttcaggagactcacctaacacataaggactcacataaacttaaggtaaaggggtggaaaatgacattccatgcaaatgggcaccaaaagtaagcaggagtagctattcttatagacaaaacagactttaaagcaaaagcagttaaacaaaacaaggagggacattatataacaataaaaggactagtccaacagtaaaatatcacaatccaaaatatatatgcacctaacactggagctcccaaatttataaaacaattactaatagacctaagaaatgagatagacggcaacacaataatagtgggggattttattattccactgtcagcactagataggtcatcaagacagaaagtcaacaaagaaacaatggacttaaactataccctagaacaaatggacttaacagatatttacagaacattctactcaacaactgcagaatgtacattctattcatcagcacatggaaaattctccaagatagaacatatgatagggcacaaaacaagtctcagtaaatttaagaaaatcgaaattatatcaagtactctctcagaccacagtggaataaaattggaaattaactccaaaaggaaccctcaaaaccatgcaaatatatggaaattaaataacctgctcctggatgattgttgggtcaacaatgaaatcaagatggaaatttaaaaagtctttgaactgaacaataacagtgacacaacttatcaaaacctctggaatacagcaaaagcggtgctaagcagaaagttcggagcattaaatgcctacatcgaaaagcctgaaggagcacaaatagacaatctaaggctacacctcacaaaactggagaaacaagaacaatccaaacccaaatgcagcagaagaaaagaaataacaaagatcagagaagaactaaatgaaattgaaacaaacaaaaaaaatgcaaaagataaatgaaacaaaaggctggttttgaaaagataaataaaactgatagaccattagcaagattaaccaagaaaagaagagagaagatccaaataagctcaactggaaatgaaatgggaaatattactgataccacagaaatacaaaagtttattcaaggctactatgaacacctttatgtgcctaaactagaaaacctagaggggatggataaattcctggaaatatacaaccctccaaaattaaaccaggaagatatagaaactctgaacagaccaataacaagcagcaagactgaaatagtaattctttaaaaattgccaacaagaaaagtctaggaccataaggattcacagctgaattctgtcagacattcaaagaggaaccagtatcaatcctattgacactattccagaggatagagaaaaagggaatcctccttaaatcattctctgaagccagtatcaccctagtacaaaaaccagggaaggagttaacaaaaaattaaaactacagaccaatattcctgatgacacagatgcaaaattcctcaacaaaatacaagctaactgaatccagcagcacatcaaaaagataattcatcatgatcaagcgggtttcataccagggatgcacggatggcttaacatccataactcaaatgtgatatgccacataaacagaattaaaaacaagaatcacatgatcatctcaatagatgcagaaaaagcatttgacaaaattcagcattcctttatgattaaaaccctcagcaaaatcggcatagaagggatacaccttaaggtaatgaaagctatctaagacaaacccacagccaacattacactgaacagggaaaagttgaaatcattccccctgagaaatgaaatcagacaaggatgcccacttttaccacttctactcaacatagtactggaagtcctagccagagcaatcagacaagagaaagaaatcaaaggtatccaaattagtagaggaagtcaaactgctgctgtttgtttgctgatgatatgattgtatacctagaaagccccaaagactcatccaaaagctcctcgaactagtacatgaattcagcaaagtttcaggatacaaaattgatgtacacaaatcagtagctctgctatacagcaacagcaaccaagctgagaatcaaatcaagaactcaatcccttttacaatagctgcaaaaaaataaaataaaataaaatacttaggaatacacctaactaaggaggtgaagacctctataaggaaaactacaaaacacagatgacacaaacaaatggaaacatgtcccatgctcatggatgggtagaatcaatattgtgaaaatggccatattgccaaaagcaatctacaaattcaatacaattcccatctaaacaccactatcattcttcacaaaactagaaaaaaaaaatcctaaaattcatacggaaccaaaaaagagaccacatagccaaagcaagactaagcaaaaagaacaaatctggaggcatcacattatccaactccaaactatactacaaggccacagtcaccaaaacagcatagtactgttataaaaataggcacaatgaaacagaatagacaacccagaaacaaacccaaatactgacagctaactgatcttcaacaaagcaaacaaaaacataaagtagggaaaggacaccctattcaacaaatagtgctgggacaattggcaagccacctatagaagaatgaaactggatcctcatctctcaccttacacaaaaatcaactcaagatgaatcaaagacttaaatctaagacctgaaaccataaaaattctagaagataacatcggaaaaacctttctagacattggcttaggcaaagacttcataacaaagaacccaaaagcaaacgcaacaaaagcaaacataaatagatgggacttaattaaaccaaaaagtttctgcacagcaaaagaaataatcagcagagttaacagacaaaccacagagtgggagaaaatcttcacaatctatacatccgacaaaggactcatatccagaatctacaaagaactcaaacaaatcagcaagaacaaaacagttccatcaaaaagtgggctaaagacatggacagacaattctcaaaagaagatatacaaatggccaacaagcatatggaaaaatgctcaacatcactaattatcagggaaatgcaaatcaaaaccacaatgtaataccacctcactcctgcaagaatggccataatcaaaaaatcaaaaaaataatcgacgtaggcacagatgcagtgaaaagggaacacttttacactgttggtgggaatgtaaaccagtacaaccactatggaaaacagtggagattcctaaagaactaaaagtaaatctaccatttgattcagcagtcccactactgggtattctaccaaaaggaaaagaagtcattatacaaaaaagatacctgcatacacatttatagcagcacaatttgcaattgcaaaaatatggaaccagcccaaatgcccatcagtcaacaaatggataaagaaaatgtggtatatatatacaccatggaataacactcaaccataaaaaggaacaaaataatggcattcgcagccacctagatggaattggagaccattaatctaagtaaagtaactcaggaatggaaaaccaaacatcgtatgttctcactcatatgtgggagctaagctatgaggatgcaaaggcataggaatgatacactggacatcggggactcaggagaaacgttgggaaggggtgagggataaaagactacacattgggtacagtgtacactgctcaggagatggatacaccaaaatctcagaaatccccactaaagagcttattcatgcaaccaaacaccacctgctccccaaaaacctattgaaattaaaaaagaaaaagaatctcagagaaaaaaataataacgcatggccctggacccatagatctccatgtactacaggagaatgctgtggtacgcacccccagcaccgcccccacaaaaaaatgtcctttttaaaaactttggtagaatatacgtaacataaaattcactattttaaccattttaagtgccctacttcacttcatagatactgatctctccatatcaaattcaaatccagtccataaactggttaaaagtattttatacccttcaaatatacaaattttgtcttaaattatcatatagtttaattatgaatatactcctcctgagaaatggttttaaaattccatttaattcaattactactttagacatgctgagttgagatgctttaactatctcccccaaatcacctgggtgacaaaaaagcagatatttttaaaaacctgaattatagctctccctctccctctccctctccctttcccacggtctccctctccctctccctctccacggtctccctctccctctctttccacggtctccctctgatgccgagccgaagctggactgtactgctgccatctcggctcactgcaacctccctgcctgattctcccgcctcagcctgccaagtgcctgcgattgcaggcgcgcaccgccacgcctgactggttttcgtatttttttggtggagacggggtttcgctgtgttggccgggctggtctccagctcctaaccgcgagtgatccgccagcctcggcctcccggaggtgcagggattgcagacggagtctcgttcactcagtggtcaatggtgcccaggctggagtgcagtggcgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcccagccgccatcccatctaggaagtgaggagcgtctctgcccggccgcccatcgtctgagatgtggggagcgcctctgccccaccgccccttctgggaggtgaggagcgtctctgcctggccgccccgtctgagaagtgaggagcccctccgcccggcagccgccccgtctgagaagtgaggagcccctccgcccggcagccaccccgtctgggaagtgaggagcgtctccgcccggcagccaccccgtccgggagggaggtgggggttagcccccgccaggccagccgccccgtccgggagggaggtgggggggtcagccccccgcccggccagccgccccatccgggaggtgaggggcgcctctgcccggccgcccctactgggaagtgaggagcccctctgcccggccaccaccccgtctgggaggtgtacccaacagttcattgagaacgggccatgatgacaatggcggttttgtggaatagaaaagggggaaaggtggggaaaaaactgagaaatcggatggttgccgtgtctgtgtagaaagaagtagacatgggagacttttcattttgttctgtactaagaaaaactcttctgccttgggatcctgttgatctgtgaccttaccccccaaccctgtgctctctgaaacatgtgctgtgtccactcagggttgaatggattaagggctgtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgtgagaaacacccaagaatgatcaataaaaaaataaataaataaaaaggaaaaagaaaaaaagagagagaggcaggaggcttagagtcagagaagtcaatgtggtgctgggatctgagaaaaagaacctggaagatggtcagttgctggctttgaagatggaggaagacactgaaccaagggatgcaggacaagctggaaaaggcaaggacacagattttccctggagcttcccagaggaagccaacatctggattttagtcccataagactcatctcagatttgtgagctccaggactgtaaggtaataaatgcgtgtggttgtaagccaaaaaaaaaaaaaaaaacctgaattgtaaaataaaaacaataaatctgatggtaaaattcacagtgacaaggatcagacgggactgtgtatagtttcaaggtggtcaagggctctaaaagtcaacctataatactaacatcaatgacaaaacagaacagctctttctaagcacttctgatatgacaggcacagtacgaagctctttacatctattaactcacactaaatttgaaacagttctgtataaggtaagcagtcttattatgccgactttagagatatttcaatacgttttcaaaagataaaaagtagatggagtagtacacactgctaaggcatcacaccataaagtgaaagtggcaggtgatactgaaaggataaaaacggaatcctatagagaatcagaacttgaatacatcaggtacctcacccctgaaagaacagaagtgagttatgggacgtaaaacatggggagtggttaaaagtctaaataaagcaacatcaaaaaattccatccacccccaagtgcagaactctagcttctaggtatcaatactccagcaacaagccaaacccaaacaatcgggccctagagttcttgattgtaaccacacaccacactaccattcttcagtgaaactggatacaatcaagtcaacacttagctgttcatgagacacacttcaaacaaaaggacatgcaatggtggaatgaaaaggatagttcagacaaatatgaactcaaaaaaagcctgtgtaactacataagtttctgaaaaaaagagacttgaaggttaaaagcattaatagagataaagccaatacacagtgacaaaagacttccatcaccaactgttacatacaaagtaaccaatatacccagtctcaaaatctataaagtatacatcacagatctctaaggaaaaaatgacccatatacaataagttaaagcagggcctggaatacagcaggtaccatataagagttagacattataaattctctttcagaaattcatagatctagaagataaagaataagtagataaagaagataagaataagaccagtctgggcaacatagtgagccctcatttctacaaaaaaaaaaaaaattaaaaaattagccaggcatggtgtcacaagcctgtggtcccagctacttgggaggctgaggtgggaggatggcttgagcccgagagactgaggctacagtgagctgtgatcacaccactgcactccagcctgagcaacagagtgagaccctgtctaaaaaaaaaaaaaaaaaaaaaaaattaggaatataagaatattactcaagattcagtcgggttaaaaacaagggaattctggggaaatgatggcagtgatgtaattttttaatctcctcgactctccccataaaaaaaaagtaggacagtaaaacctaatcaccactccccaccctggaaaacatcaataacaaacctcaaaatatgactgggtggaaaaaactatgagtggttctgagagcagaattaaatcagtatctttattgtaggaaacaaggcaacttaacttccaacagacctgtaaacaaggaggccccaaatcgccaaaagctgtccagcatagaatgccaagccaatctgagaaccgcagccaaaactgggagagggttctttctttagcaaacctctttaagatgaattccccagggctgctctgaaccctgccttccctagacctggctcctcagattttctcacttccctctctcttgtctaagttaatcagaggctatgtctgttggctaaaaataaagatccacaagtacatacaaaatgtttgttcttgattttaaaaaataacgagcagaatcaagatacctaagaagctcaggtgatgaacacctagcaaatatcaatccttcatttcctcctccctcccatagctaccaaaaaaacgctataataaatgttgacacagaagtttggtaaactaactaacaagataattcagagtacttgaataatttatgtgtcatttaaggtgtgatggcaattccttaacatgagttatttaaatgtttgggattgtttttacatattaaatgactaaataaataaatctaaattcttactttcaaaaaaaaggcaagttgagtccaagaaaaaagtgatgtgtgcttgattaaaccaactactgaaactttgatatgttactgcttttctctttggggcatggttcagagcagcagccccctggcaggctcccctgcagagaaaatacttgggcagcagtgagagggaacaggaggtcagcagaaacacagccaccagacagtacgagaaaaccttctttttctcttaaaaaaaaaaaaaagcaagagggccacatctgtaatttcaacctcagtgacacgcttggggagcatagaatcatctcaaaaacaaaattggccaggcacggtagctcacgcctgtaatcccagcactttgaggtgggcggatcacgaggtcaggagtttgagaccagcctgaccatggtgaaaccctgtctctactaaatatacaaaaattagccaggcatggtggtgtgtgcctgtaatcccagctactcaggaggctggggcaagagaatcgcttgaacctgggaggtggaggttgcagtgagccaagatcatgtcattgcactccagcctgggcgacagagcgagactccatctcaaaaaaaaaaaaaaaaaaaaaatcaccacatgtcatttcaaattgaacaacaaagccgtattttttggggaaaaaaagagaaatgtctatgtcaaatcaaaaacataattaattagcagtttatagaaaaaggaccacttattttaggtagcttcagaggctaaaacaagaaatagtgaatggaagttagaggagggcagattttacctaaattgtaacgatttttctggtgacagcaactgttcagaagtctaatgcaatgccttgagaagcgtagggttcccagtgacttgacatgtttaaggagaatctagtagtaagtatatttgctagacatgaggtaagagaatttccagtattgcaaaagagaaggagttagataagttttcttccaactccaaaattatttggttttgtttctcttgtgcaaccaataaatataaactaaatttgaagatgacagaaattgtgcatattttaaggcaaagtatggtggtctcagaaaggtagagaacatgctgtttgcagagtgtttgtctaaaaagtcgatccagaactggagtttctgaatgaaaaaccgcaacctctgcctcccgggttgaagcaattcttatgcctcaacctcctgagtagctgggattacaggcgtgcacaaacacgcccagctaatctttgtattttagtagagatggggtttcactgtgttggccaggctgctctcgaactcctggcctcaagtgatccgcccacctcagcctcccaaagtgctgagattacaggcgtgagccaccatgcccagccaaaaaataatcttaaaaaaataagtgaggaatgtatcagtcagagaaaagtgatttttaccttttttcccttcatttcaaagatgaatattagcattgtaccaccaaataagagaagatattgatattattttttaccaaaataaatgggatcgttagcaacccaccctcttcaaaaaaagcaaaaaggaatcccctatcacttgttcatacaaacctgactctagagaacggagtgtcatatcaaagaaaattcttaggttactcagtgtcccagacacagtggttcatggagcacaagttaagtcctctcttctgggtataggctgggccataattagtttctccaacagcctaagctactgaaatgtaaaaagaaaataaaaactgggcaaaattaattgttcttcagtcttccagtatacaaattaaaaacttagatatgggtatagcaggaacaaccatctctaagaaatttttaagaagtggggcgtgaaattaattgagtcactcaaatctcaactatgggggtactatcttagggaccatctctctatccttcttgggtgtcagagggaaagagtatgtccatgtttagaaactctgtgctaaaaccataaaaccagttaccagacagtaggaaggaagtttcctggaatggatatagaaaacaaaaaaatcctagtgactcccaaattccccccagccctgggacccacagaatccactttaaacttcctatagagaaaaaaattcatctacaacacattcctatataatcaactcattattcagagctccttcctagtaacatgtcttaattacctaaaagtctctgtgatggttaatactgagtgtcaacttgattggattgaaggatgcaacatattgttcctgggtatgtctatgaggttgtggccaaaggagataaacatttgagtcagtggactgggaaaggcagaccccccctcaacctgggtgggcaccatctaatcagctgccagcacagctagaatcaaagcaggcaggagatcgtgaaaaggctagactggcttagtctcccgacctacacctttctcccatgctggatgcttcctgccctcaaacatcaggctccaagttcttcagttttgggactcagactggcttccttgctcctccgcctgcagatgacctatattgggaccttgtaatcatgtgagttaattcttaataaactcatatatacagatagaaagatagatagatattccattagttctgtccttctagagaaatctgactaatacaaccacttagcagctgtgtaatactaagcagtttaacctctcaaaaccactgaactaaaatgagcataaataataataataacattacatgggccctgagatttaaatgaaacttaaaaacttaatatcatgcttggttcacagaagtgctcggtaactattactcattatcatcacagttttactattattttaagatttttaaattgcaaactttcaagatgtttctagatatcatctgaaatatcttagtactaacagattaaacaatactaatatattaactagtttagccactgtacacaaattcagaattttataaacctttgaatgtttataatccttagaatatttttcctagttatttttgggaaaatttcagaatttttaaaaattgaagtgattacacccaccatccacctatcaaatggctattaacacacaccagtagatgtggtcaaaattgtacagactcataggaaaatagaattgatttggattcatttttctttcttttttatttttgagacagggtctcgctctgttacccaggctggagcacaatggcacaaacacagctcactgaagcctctacctcccaggctcaggtgattctcctacctcagcctcccaagtacctgggaccacaggtgcatgccactacacttggctaattttttaaattatttgtagagacagggtctccctatgttgcccaggctagtctcaaacttctggactcaagcaatcctcccacctcagcctcccaaagtgctaagattagaggcgtgattagattagagccactgcacccagcctgggattcctttttctacattccatttcatcttatttcacatttctaacacaaagtataaaacaaaaaaaaaaatgtaatggttagtatttcgaggaaaattaatctatacttcactggcaccataccttcctaggagaaacacaagcaccttaaatccagcactttgggaaaagcacagcaaaatatgtggacccagttagaatccgagaggcagaccagctgcttgagtactccccttccactgtctgcaaccctctaaactaaagctaatatccttgtggagcctgtgccatctgataaacacaaaccccaggtgtgaattcaacaagtgctcagcaaccggccaccatgggcatcatcgcataacgtcccgggtggatgacagtggagagggtaatgcagtcactgcttcttggagatggcaatcaagaaaggcagaccaacacacatcacttgcagaatgaaccataatacaaaaccattttttgagaagtgacacagactatacaggaccccagttcaggtgaaggaaatgtcactttctgatgaataaagagtgagtggcagagaatggtaggactattttgggggacaaggaaataaaaggttttagtagtttagggttcaaaacctgcaatacttactaggggcgtacccttgtaacatcttgtagcctcaatttcctcctctgcaaagtgggaataagtgacttactcacgggactgcaaggcaaactatgagataatctatatggagcgcctgctaacacagcaccaagcaaagtatttagtgcagagttaaaactgaggctgctgggtgtattctcaaattgttcaggatagttttgtccatctctatcagaaaagtttcttctatatcacttccatggttactaaaaacggaaaaaagctacatctacgtgtgtcacaaatgtcgtcatctccacacaggtacacagaccatttattaataccactttttgaaacccacatgtagccagactacttggctctaatttcaaattttgactagtatcctaagtatttgatacctcaatctacattcactgaagtcataagttttaatgtgatcagaataactgacttcaaagtggtctaattcaagaagctccaactttaaagttgtaaaaatgctttttgaaggttgcatttgtagaaatgaaatttgaaaagactattaaatattcaataatattaaaaggcaattacaactcctaacattctgtttgctttaggcaaggtaatgtctgtaacaagctaaggagcaaattaaaacgccagggtccttatgttttataacaacacggttctaaactctcctcatcatactaacagtatttaaaagattatacactgcctgttgtaagtcactcggacagctaatcattggaaataagtgaattaagaatcggtattaaaatacactggcttgtttttcaggtggagcacagtgagtagactggagaaagctgtgaccaagatgaactgcagaaaaggaagttttttctagtaacaacacccgtccctaaataagcaacctcttcagtctagtctagtaacacaactctgatcatctaagagatgtgttcaatttccctaagtcttcttgaaatctaaaataatttttaaaaaatgaggaagaagaaaaaaatctgatttttcccaaagattgaaatcaaacaccctttaggtgtataactattgctagtacaaatatcacagtaaatacatttttaaaaagtaccatgggtaaaatttcaaataaggtataacaatatttgatcaatattttcataacatactatgacgtaagccttcaaaatggcaacagatgcccaccttgagttcagttccagaaaatattttgtcactctagaaaaattctctctcttacttcctccaattagaaaacaacacatcagcaccatgcttccacttcagcttcgggggtgggaaaatcaaaagctaaattcactaattggagtcgtttgttcatttaagaggcctgaagccatcttctccttctgcctgctttaaatatttgctcttctgttttacaattatgtataatactttgtttaacttttaactgtaaattgcctcaagtctccttggaactaagcaatgacaaaatctcaattaattcattctctcttttggaaaataaaatgacactttaagtttataaagaaagactagcatgctgcctagttcctaagtaaagaaaccttcaaagaagaggccttaagagacatggaattaaatgttacagctgcaagtgcactataattaattacaaattctcatcgatttttattaagaggtcaatcatctgctgatagccatggaacgacagttaacgggggttggtgcaagcactttgatgcctgctgaccctcctctagtgagcatgttgtatgcccaagagaaggctctccatggccctaaaataccactcagatatttttcttatcaaacacccatctgagtttgagcatatctttttattctatttttttagcacatgtctgtagcagccagagagtttaagaataccttgagatgaagtatagacatccctctaaaaggctatgactacaagtcatttgcacttagtatgaattaatttattcagataatcttacttcctttttccacttagctgagattttaggaatagagattttgcatagagtaggtacagaaagaggagataacagtgctgaacatttaaaaagcctagaaagaagcctgtaatcccagcactttgggtggcggaagtgggtggatctcttgagggcaggggttagagactagcctggccaacatggcgaaaccccatctctactggccagctgcagtggctcacgcccgtaatccaaggactttgtggggccgaggcaggcgggtcacctgaggtcaggagagaggagaaaatgcagtataacaaaaagggagttagaatgtataagaacatttcattttccataaagtttggagtcaggcccaacatgctctcaagtatgaaatacagaaagtacaaggaggaggaaaaattctaagagaactgaagagaactgtactttaagcctggctgcttcatttactgctctccatctacaggcaatgaataaatgtatccacccctaaaggtattctaatcataataataaaagctacctagaatgtcaaaaggaattttcatatcacatatacattgtaaaattaagttttttcaatgtattaaaaaaaagactgaaaagaaatagaccaaaatattgatttttttctttaaatgatacgaattggggtgatttccccctccttttattttttccatttttcagttttatataacaagattattttacttccatgatcaaataaacataaacattaatgaaaaggaaatatgtattatttaacagccttaaattgtgtctagtctaacgcagggcatagagagaaggacagacagacagataggtatgtcagctttaattacaatttattccaatgtttagaatagtaaacacaaatatatactttattcaaacataatttaaattaaatattctttattaattgaatttatttctaactggcattagctacaaaggatgttatcaaatgaaatatttcttagtttttgataacatgagaagctgacaacttacaataataaaatcagtatcatatgctaaatacaaaaatctaatagttctggatttaatatcttccacaatataaaaagcaatcatttcagaaaagaaaccgttattaaaaagaagaaaagcttttgccatatggaacttgggttgctcagcctttttctgaaaagatgtctcaacttcatctgatggttcatattttatcattttctttgacttatatgaacttgaaggtcacccagataaagtaaaactttattcttttatattaacttttatttgatttggagttagtcaatcaaaacattacttgtttgaaaatatagacatggagaaatctttaacaagcaagatatgacagaaattaaaggctattccacaaaacaaccctgccattcattcactgattcattctttcaacaaaaatatactgacccccttccaaatgccaagcacttaattagaaacacagtgggcactgtccattgtttacccaaaaaccaccccactctttcctagcatgaagaaatactgtgatttgctgatgtagcaaacacagaactcttgatttcagggagaggagattgccagagccggggaataaatcatgattaatctaaacttaaaaaaaaaatgtatccctcatgggcactggccactctaagaacaagccatgtggcccggttttggctaatgacctgtaaacaggtacactcacttctcattattcatatattccatatttgcaaattcacttattcacttatatttatctgtaactccaaaatcaacagtcacagcatgtctgcagtcagttgtggacagaagaggaaaggccaaaaatgtgtgtcgcccaatatgtatgttcccagctgaagtcaaacaagaagacactgccttctcagctctcacagtgtaagcgtcctttttgcagaccacttggtgctctgtttttctcatttttctcgatttgactgtataatatggcccctaagcacagtaccacagtgctgtctcgtgtccctaagcacaagaaagttgtaatatatgcctcacagagaaaatgcatgttttagataagcttcactgaggcataagttatggtgctgctgaccctgagttcaatgttaatgaatcaacaatatatattaaataaggtggccgggcatagtggctcatgcctgtaatcccagcaggagtgtgaggccgaggttggtggatcacttgaggtcaggagttcaagaccagcctggccaacatggcaaaaccccatctctactggccaggcgccgtggctcacgtctgttatcccagcagtttggggggccgaggcaggcggatcacctgaggtcaggagttcaacaccagcctggccaacatggtgaaacctcatctctactaaaaatacaaaaatcagcagggcatggtggctcatgcctgtaattccagctactcgggaggctgaggcagaagaattgcttgaacttgggaggtggaggttgcagtgagccgagatcgcgctgttgcactccagcctgggcaacagagtaagactccgtagcaaaaattaaaaaaaataaaataaggtgtctttaaaaagaaacacataataaaacaaggttatgtactgatcaggtgacaaatatgttgtgactagaggctttcaggaacctaatcctgtatatctactaggaggaatgaatggctcagtattggctaattcagttttcacagtaactttataaaacatacctactggaaataataaaaatgaactacatttctaatgagagactttttttttttttttttttttttttttttttaccaattttcaaccttctcagcacaagacacaacatgagagtaaatgccaccactctgttacatcaaatagccaacttccaatttttggatgagaaaaataagttaactatttgtttaagccactacagtggaagtgtattcacaaagatgtaacaaaatggtgcttcctccttgtcagtaaacagtacagtggtcctgaaagaacacagcgaagatgttctacattctagcataccaagtcttacatatgctgcttattttctagtcaaatagagcagcacgtgttaatacttatatttctgcccttcaaaattaaggtcaaaagatcggcaataatgtgaactggctaaaatctaatttttttattgttgttgtttttgtttttgttttgagacagagtcttgctctgtcactcaggctggagtgcagtggcatgatctcggctcactgcaacctccgccccctgggttgaagcaacaatcctgcctcagcctcccaagtagctgggattacaggtgtgcaccaccacgcctggctcatttttgtatttttagtagagacggggtttcaccatgttggccaggctggtctcaagctcctgaccttaagtggtccaccagcctcagcctcccaaagtgctgggattacaggcatcagccaccacacttggccttaaaatccaattcttaataaagttttggactttattattacttagaaatatgcctagcttctcaaaaaaactattttgacacgtgataaaggaatgtctggaaaacagatatggtctgattaagatataaatatgatggtataaatattacagtattacatatatatacacacacagctctctacgtgtcttgctatttcatattgatagaaccgatcttatgttcatattgatggacattagtgttgataacaatgttttaagctattataaacaagcagggcacagtagctttgggagcccaaatcctagcactttgggaggccgaggtgagcggatcacctgaggtcaggagttcaagaccagcctggccaacatggtgaaaccccatctctactaaaaatacaaaaattagccaggcgtggtggcaggtgcctgtaatcccagctacttgggaggctgaggcaggagaatggtgtgaacccaggaggcaaaggttgcagtgagccaagatcacgccactgcactccagcctgggcaacagtgcgacactccatctaaaaaaaaaaaaaaaaaaaaactaaacataaataaaccagtataaacaacattacaatgaacacatacttgaactgtgcacttatacaattctttccaaaactttctggtctcagtcctgacttaaaaattactgaaggatcttaaagaggctttacttaggtcgacttctctactgatatttaatgtattacagattaaaattaagacgttaaaaaaataacgtattggccgggagtggtgtctcacgcctgtaataccagcactttgggaggctgaggtgggcggatcacctgaggtcaggagttcaagaccagactgggcaacatggtgaaaccccatctctactaaaaatacaaaaattatctgggcatggtggcgcacaactgtaatcccagctactcaggaggttgaggcaggagaatcacttgaacccgagaggcagaggttgcagtaaaccgagatcacaccattgtactccagcctgggcgacagaggctttgtctcaaaataataataataacgtattaattcattcaaaagtaagaatcctattacatgtcaacatattttaataaaaaataactaaatttttcaaaacaaaaataagttagtgaggaaagtggtaatgttttacttttttgataatccttttaatgtctggcttaatagaaagcagctaattttttttatgtttcttcattcaatctactgcaatgtagcttctggaagacccacagtatactcatgagataataagaataaaaaaggcaaataattctttttttttttttttttgagacggagtttcactcttgttgcccaggctggagtgcaatgacgccatctcagctcaccacaaactccgcctcccgggttcaagcgattctcctgcctcagcctcccgagtagctgggagtacaggtacctgccaccacacctggctaattttgtatttttagtagagatagggtttctccatgttggtcaggctagtcttgaactcccaacctcaggtgatctacctgcctcagcctcccaaagtgctgcgattacaggcgtaagccaccatgcccaaccataattctgaattattatcatgaaaatagttttcacttaaatccctgaaagtcccatgggtactcccagaggcctccggactccactctcattccatttctttaaagtatgtattcctagaagtaaaactgctgagttgcaagaaagcacaacttgaacaattttgcatattgacaaacaggtctccaaggcagctggaggaatttacactctcacagccatataatgagagttcccctaaatctgtatctcatcacctcttgataccgtcatttcacattctgccggtctgatgggtgaaaatgttatctcaatgtgctttcccttgacaaatggtcagggtttgagcatcttttcatgtctattcaccatgcataatttcccttttatcaactgcctgttcatagcatttgcatattttctactgagttttcttagtgaatttaatcatttgttgagtgcctgttttacaaactcatttctcacagactgtgtctgtatttcacaactaggcactatgaaagaatataatactgtaattaaatagcttacactagtgccacgtggcctggaattaaaatttagttgaccactgtgatggttgatactgagtgtaaacttgattggattgaaggattgatcctgggtgtgtctgtgagggtgttgccaaaggagatgaacatttgagtcagtggactgggaaaggcagacccacccttaatctgggtgggcaccatctaatcagctgccagcacagctagaataaaagcaggcagaaaaatgtaaaaagagagactggcctagtctcccagcctacatctttctcccatgcaatgcttcctgcccttgaacatcagactccaagttcttcagttttgaaactcggactggctctccttgttcctcagcctgcagatggcctattgtgagaccttgtgattgtgtgagttaatacttaataatctccccttcatatatatatatatacacacacacatatatatatacacatatatatacttaataaactcccctttatatatataatataatatattatatattatatataattatatataatatatttaatatattatatataatttaatatatttaatatattatttttatatattatatataatatatttatatagtatatataattatatataatatatttatatagtatatataaatatattatatatataaagcaatctccctgtttatagctcatttataacaatcctcagaaatggaaatttgtaattgatcaaccttgactaaacaagaagattcccaatggcaataaactataacatctatttccccccagagaaaatgagaaagaaaacaatattttatatatatattattaagtatatatatacttacacacacatacatacacacacacacacacacacacacacacacacatatattccattacttctgtccctctggagaaccctaactaatacaaccatttagcaactgtgtaatactaagcaatttaatctcttgaaaccactgaactaaaatgataataaataataataataacattacatgggtgtaataagaataaaacttttaaaaacttaatatcattcttggctcacaggagtgctcagtaactattactcattatcatcacggttttattattaagatttttaaattgcaaactttcaaaagctgtttctagatattatttgaaatatcttagaactaatagattaaacaatactaatatattaaacagcttagcctttctagaaaatcagaattttataaagctttgaatgtttataactcttgggatgtttttcctggttattttcaggtccttcacatatctaacaatgaaaaattactgaattaacgtaacagttgaagttattcgcagaagtaaccataggtatagctaaacagtaactacttcttagcctgaaagcaaccaaatatgaatacaataacaatgaacctaatgtttctggaaaaatcattaatccaactgacttttaaaagttttgaaaaggccgggtatggtggctcacgcctgtaatcccagcactttgggaggccaaggcggatggatcacttaaggccaggtgttcaagaccagcctggacaacacggtgaaacctcatctccactgaaaatacaaaaattagtcaggcatggtgacacacacctgtaatcccagctactcaagaggctgaggcaggagaatcacttgaacctgggaggtggaggttgcacctcccagggaggtcgagatcacaccactgcactccagcctgaggatcagagcaacactctgtctcaaaaaaaaaaagaaagaaagaaagaaaaaaaaaagttctgaaaagtcaacgtccatacccaaatagatggaaaacttctacacatttttctcatatctcagaaaaatattcagagataatacagtacattaaatacttttatttttctacctagataataaggaaggctgagaaaatcttaatgcatcaccttcatcctctcctatacacactaggctaatacgaatagttttcaatacaggagaaaaaagataattaactcttttcaggtaaactaacccatttcactaaaaagcaatctccctgtttatagctcatttataataatcctcagaaatggaaattcgtaattgatcaaccttgactaagcaaaaagattcccaatggcaataaactataacatctatttccccccagagaaaatgagaaagaaaacaacttttgaaatgtcattacttgaatgctttttaaaaactatgtgatattttaaatggaaaatgttaattatcttttaaagaccttcttctgaatgccatatccttcctattgttgctgttctttcattactggtcccataaatacactaagagtctttttgtaccatggctctggtaggttctggatatataaggatcaataagacagttcctattttcaaggactgttgatgctacgacagaggcagaatagcaggaacagcaataatgctcaccaagcgcctattatgtgatgtcaggttctgtgctagatacctgtaacatgcagttgttgaaaagtaggaatcttgaaattgagatatctgaagtaatagttactgtgctggggtgtggccatgggtatagccatgggctactgtcctaggctatggccatgggaagaggtagctagggtaaggtaaaggcaaagagaattggaagtggggacaaacagcccaggtgtcagatggatgctcaattcgctaagaatgatgttgccagtaatgataaagaaagaaaaagtgagccatgaatgttaaggaataactggaaggtgaggtaatggggagtagaatggcaaatgcttcagaggagctggcaattttgaggaagaggaaaaatggtgtaaatggatgaagaggagcaaaactgacactctctgactctctaggcctctagtcttaaaggacttactctcactggccagaactcagtcacatggccatgtctagaaagtcggaacatttcattctttagctgggcttactgccacctcgaataaaactgaagttcttttattaaagaagtgcccagcgaatatctggtagataaccagcagtttttccataaaaaaataaaaacaaaacctattatgatacctgaaattattttaacaggtataaatgataaacttgggatggcattaaagtgattaaagacactacctggtgagaaacagaggcgaacagagaccaagtttatcgatgcttttgtgtaaagttgcatacacaaaccgcaatcaagtcaaaacagaagacttgaagatgttctcataccatgaaggaagaccaatgaactcagactggtcaatgtactggaggcaacaaggacttccttagaggagtgagtacatccagtacctctttatatcgccatccatgtctcccgcagtgccctgcatattttatacagtgaataaatgtttgctaaagaaacaaatgtgtttacatatggaagtattttcaaccaggccttcaacaccaataactgttgacacttttagaagaaaatcaaagcagcccctgcagcctcagactcctccagctgtcacctatgggatccagcctccaggccaaccgcaggctccaggccagctcctgtagccccagacccctccagctgacacctatgggatccagcctccaggcccaccgcgggctccaggtcagttcctgtagccccagatccctccagctgacacctatgggatccagcctccaggccaaccgcgggctccaggtcagttcctgtagccccaaatccctccagctgacacctatgggatccagcctccaggccaaccgtgggctccaggccagctcctgtagccccagacccctccagctgacacctatgggatccagcctccaggccaaccgcaggctccgggccagttcctatagccccaaacccctccagctgacacctatgggatccagcctccaggcccaacgcaggctccaggccagctcctgtagccccaggattcagactgaaacccaaagactcagcctccgggcccagtccagccccatgtcagccgctacaactctaggttccaggctcactagaatgccaggtcagtcctcacagccctagactccaggccagcacccatggacccacgctccagcaaacccaggacccatgcccactctatagactcagagtccaggcctgcctcagtaaactcagcatccacagccttaggcaccaggctagcacctgtgaacccaggctccagaccaagccccgtggacccaggctcaccccagcaccaggccaatcccaggctctaggctggtccctgtgaccccagactctaatagacccaggatccaagctcattccagcagacccagggtccaagtccaccctggtcaaccctagtgccaggttgccccacagatccaggctctaggattgcccctgtggacccaagatccagacaggtccccacaggcccaagaaccaggtctctttctgcatactcaagctccaggctcaccccagcaccaggctaacccccatggactcaaactcaaggcccatccacatggacccaggcacccagacaatcctagtgccaggctggcccccacagactcaggctcaaggcccactccagggccaggctggccagacttcaggccagcccctacagacacatgctccaggctcgcacccatgagctcagtcaacagactcacccagtggacctcaccaccaggtttcccccatggacccggggtctagtccttcaaacccaagatccagacctgtcccagtgggcccaggctccagacccacccccatggacccaggtcccaggcctgcccacctattgacccaggcacaaggctagcctgcccaagaacttgaggtagccctccttccctcaggaggcggaaagaaggcaaattaccttacaggcatgaaagacaccaaaggaatcatcaacttggcctctgtttacacagcaggatctaccagctgggaatgcatttgaatgagtgttggggatgggtagatcagagatctcaatattcagtaaaaagaatctttctgagaacgttctcctcccaaaagggcagaaggccacaactactgaaacacaaagcctgacttcatttgagagactgactccaccccagaccaatgaatcagaatctacatcttaatcaaatgtctaggtgattcatattgcactaaaggtagaaaagcactggtctaatatacaacaacaacaacaaaaagccatatctgaaatggaattacagacaattattttggatatgaagcctctttggtttaaaaatgcattatcctttaaactgcaggcagcaagaggtaatacatcacatgaaataaaagctgttatgatgctttttggaagatgatcaaaatatcaagatggggtcaggcatggtggctcatgcctgtaatcccagcactttgggaggccgaggtgggttgatcacttgaggtcaagagttctaccaaagttaacaaataactcctttcagcaaaaccctgctcctttttcttaggccagaataaatgccaacatgtttgtttctcctgccatgttaaatatattacaagcttgctagctttcactctgttattgatatcttcaatacatgaagaggaagtgcaagataaacagaaacatttatagtcaagggaaacacaaaggcattaaataaaattaaaagatctggaatggtgagtctgattagtcagggagcagacacctggtgtcttagacaaaacaaccattaaaaaaaaggaggatggaaaatggaatgactcacttttactatatatgtatctcatatgaagtattttcttctgggtaaactagaaaataaaatgcaactattttggagcaatattataatatggaagctgagagataattatccttcagatatctttttctgtcaggctaaataatgtgtttcttcatctttccctaaaatcaggtctcataaaccttcagagtttccatttcatgtataggttgagactaaatttagaaaaatcaggtcccataatgttctaaacagagatggacacacacacaaaaagaaaatgtaaccattgaacaaaattagattatatttagaaacagaattttttttttttgagacagagtctcactctgtcgcccaagctagagtgcagtggtgccatctcggctcactgcaacctccgccacccggattcaagcaattctcctgcctcagcctcccaagaagctgggattacaggtgcccgccaccacgcccggctaattttttgtattcttagtagagacaaggtttcaccatgttggccaggctgttgtcaaactcctcacctcaagtgatctgcccgcctcggcctcccaaagtgctgagattacaggcgtgagccactgcacctggtctaaaaatagaaattttatgtgtgtatatatatcaataaaagtatcacaattactgtccttaaaaagcctaggtttggaagaaaaattataatgggaaacatactgtgacagctcagtaaaagacaactaaggtagttaactgattctcctatttactatctgtcaaaagacattatttgtagtagctgaattgagctgattttcttcatacctcagaaatatttcacccatgggacattacataatattctctaggacttacgcagtgataaatacctgaccaaatttataataaagaaatctttcattcatacatttaaaaaaaatgaaacaaatcaaaatcatgcaggataaagcttaggtattttctgcctaagaattttactgaataaaatcttacaagactaggtttttcctatgtgctcaaatattgaaaatttatcttttgtctccagcatgtctttcaaactgaatttaattggtaaattatttaaactatgtgcataacacaatacttacttgaaaattgatctgagtgaatcatgagcatgtaacatttgagacagagaactacatgcgaattttaagtactaggaataaattgaaatacttcggatatgcccatttcctaagtatacttaggatatacccatttcctaagtatttcaatttattcttaatacttaaaattcacatggcactacgggcttttaaagtattttataaatataaatattttaaaaatattaaaatgttataaatattaagccttactgcatttctgctcccacctcaaatctgtgtatactgcattaagtcatattcctaggagagaaaggacccaccttctgtaacttaaaattaacactagaaatgtttccagtaaaggaaataaaaagaattatctgagtgaaagaattcagtaaagaaccccgtataaatagtactgccctccaaactgtgcattatattgtctatgaacaagaaatgaaatggacatggaccatcaaaagcgggaactgtgtagagcggtgcttttcaaacaaatcacttttttaaaacaaacacaatcactaaaaatgcagattctaactcagtaggtctgaaagtggggcttttctgcacttgtaacaagcttccaggtgatgctgatgcctcctgtccacggaccatactttgagtaggaaggcagtagaacacatacacctttttttttttccgccactctttcgcccaggctggagtgcagtggcacgatctcggctcactgcaagctccacctcttgggttcacaccattctcctgcctcagcctcccaagtagctgggactacaggcacctgccaccacgcccagctaattttttgtatttttagtagagacagggtttcaccgtgctagccaggatggtctcgatctcctgacctcgtgatccatccgcctcaaccttccaaagtactgagattacaggcatgagccaccgcgtctggcctaaaatacatacatgttatctggaggtgcgaaagcccagtgccagaagaccaccagttaggtttatcggcttgctacagtaaaaggagaatgcgtactctaggaaactgggcatttctgcaaaggggagttaaaatgaacttgctatagagattgtgttttctactgggtgatatgggagaaggtaaagaaaacagaagtctgttgtgaattcagtgttgtcaggaaccaaagattactggtagactaaacattttaataatttttatccagggagcaggaggaacaaagaggcgctaaagttgataaaaaagcaattgtcagccaggtgcagtggctcatgcctgtaatcccagcacttttgggaggctgtggcaggaagattgcttgaggccagatgttccagaccatcctggccaatagtgagatttcacctctgttatcttttaattgttaaaaaaaaaaaaaaattgtcagtcactcatgttactgaggagaccatataagaactgagactgacccaagaacaacaaactatgttttacctcttggtctctatagacaatatgacaatgagagaaagggtgggagaaattgaccacttattacatagtttacccctcccgccgtgtatgatgtgaatcctgttatacattataagattgttatacaatcctatgttatacaatgttatactttctgatataaaaaaaaaaaacctttttgtgcacagaatatgaaaaagggactacacaataagcgagagtcttcgaggtataggccagtacattaatatcctttggggaactacctatgttatatgactctcatgaaaaacgcacaagaaaagcagatagagaatacagcaagcagactgctttgcacacggtaaagggcagtgctcagaaatactattaagaaataatattaccatttagaagcttcctttaaatgaaaataactgtggataaatatcccttctaaccaccgcatgaggcaacgtacttagcatatggtatacggtatgagctttagacatggactgagaatcttggcttcacacttaatatttataatatttagaggacaacttagttaacttttctagcttcagacttcttatctataacatggaggcaacactgttaactttgttttaaggagtaaataaaatatgcaaaacatttaatgtattaagtacctcacagttggccctcaacggcatttaaagtgaacatggtaccaaaccagattcaaaatgccagtttaacatttattcatcccacagatatttgttaccatgtgccagacattgtgtttagaaagaaatgtaatattttaaaagtacctggcttcctggagtttacagtctagcataaggacaattaatctgacaatagaaagcacaggatattaccagaacacagagcagagagacctgaagcaaagcagcagtgtgaggcagggaagtctcctcggaggaagaaaacctgaaggaaaagtaagagttctgaaggacttctagttacagctatgtggagaagtcagtaatttgttactatataaaacaactataaaatttggaaaaaattatattaaaaataacatttcagagcactgaaaatagaccaaagcagagaacaaatgaaaaagcattcattcttgaaaatcacctcgaggttgaagtcagtttctggggacctccttgtagaaagcattcattctggaaaatcacctcgaggttgaagtcagtttctggggacatccttgtagaaagcattcattcttgaaaatcacctcgaggttgaagtcagtttctaggggacctccttgtagaaaacattcattcttgaaaatcacctcgaggttgaagtcagtttctaggggacctccttgtagaaagcattcattcttgaaaatcacctcgaggttgaagtcagtttctagaggacctccttgtagaaagcattcattcttgaaaatcacctcaaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctaggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctggggacctccttgtagaaagcattcattcttgaaaatcacctcgaggttgaagtcagtttctagaggacctccttgtagaaagcattcattcttgaaaatcacctcgaggttgaagtcagtttctagaggacctccttgtagaaagcattcattcttgaaaatcacctcaaggttgaagtcagtttctggggacctccttgtagaaagcattcattcttgaaaatcacctcgaggttgaagtcagtttctagaggacctccttgtagaaagcattcattcttgaaaatcacctcgaggttgaagtcagtttctggggacctccttgtagaaagcattcattcttgaaaatcacctcgaggttgaagtcagtttctagaggacctccttgcctcaggctgcttctaccctacactcagctgccgtggtgaaaactttgacaaacttggggctgtctgcaaaagccagtatctttgctaccagaaggggcagatctgctgcgggatggggggcaaaactccaggtctttatcagctaaagtagcaaatgtggtgggagacaaaaagggaaaaaccttacctttgttccctaacgctatagtccaagttggggcaagtggtaggaggatcccttgagcccaggagttcacggctacagtgagctatgatcatgccactgcactccagcctgggtgacagagcaagattctgtctccaaaaaaaaaaaaaaaaaaaaaaaaaaaagcaaactccataagaaggaatactggaaattgttgatatgtaggtaaatataaaagcctgtatattatatactgtatttttaatttctttacaaatcctaagattggcttaaggtaaaaaccattattcagtggataacatatatagatggacagtacatgacaaaaatagcacaatgcagaatggggagggatgaagctgtatgggaacaaagttaccatacttcactagattaagtaactataaaactttcagattatgctatgttcaagattcatcctgtaatccttaaagcaatgctatccaacagaaatatgagaaccataaatataagtcacatatataatttttaattttctagtaatattttaaaggtttttaaaacatgaaactttaacaacatattttatttaatccaacatatccaaagtattatgacaacatataatcaatacaaaaattatgaatattttacattccctattaagtcattgaaatctgatttgtatttcactttagcacacataaattcagactagccacatttcaagtgcacaacagccacatgtagctagtggctactgcagtgggcagtacagcactagagcaacaacaacaacaacaacagatgacttttaaaaaaatcaacagatgaattaaaacggtacactccaaaaatatttaacgcaaatgtaatagaagaacagaggaagacaaaaaagacatcaaacctatagaaaacaaaaatcaaaatggcagacataaatccaaccatatccaaaattacattaagcatgaatgtaccaaacattcacatcaaaaggaagagaccatcaggctggagttttaaaagcaagcttcagctgggtgcgatggctcatgtctataatttcaacactttgggaggtcaaagtgagaggatcactcgaggccaggagttcaagatcagcctgggcaactaagcgagactctatatctgaaaaaaaaaaaaaaaaggcacagtggcatgcacctatattcctagatacatgggaggcttaagtaggagaactgcttgagcccaggagataaaggctacggtgagctttgattccaccactgcactccagcctgagaaacaaagcgagaccttattgagagagagagagagaaagagagagagagaaagagagagaaaaagagagagagagagagagagaaggagagagggaaaaaggagagggggagagagggagagaaggagagaggaggggaaaggaaaagagaaccaaaaatgcaagactcgaccatattctgtctataggagatatatactagattcaaagatacaaacaagttcaaaagaaaacaaaccagtaatcataagaatgctgcagtgactatattaatatcaaacaaaatacactttaagacacacatattactagagacaaggaggaacatttgataatgaaaagtaacacatttcataatgaaaagctaaatatgtaaaaaggagagagggaagaattttctgagcattaaagatccagaagcaagagaggtgctttcctatttggtactcccgtctccagctgttcatatcacattcccaactcctatcagcacaacccatggcagcatcctataaatctcatcttaccccgaacattcaatgtcttcaaattcctatgcctttgaacatacccttgcactatccataacactgacctcaatatttgcatcagaaactcccactcatccctccagtttcagcttatcaccaaacccttctctgaatacttcaccgaagcttgcaaatacctacaataaagctctcattgctctccaactatcatttgaatttccctccagactttcatcctttttttttccagtttgcagcatcaggttctatcacaaaacatgacacataataggcattcggtaaatgcttgctaaatgaaggataaacgaacaaatgaacaattgaacacatgtaggaaggaccaaggttggtgaaaatgggagttgaagatttttttcacaactcatatcagaggaattaaaatagaatgaccaggaaacatgaaacgcatgaaagaattactttaggcaataataacaataataaccaacatgagaggagcactcactatgtgtcaggtactgtgctaagtatttcacatatatcaattatttcaatcctcataataactccattatgaaggactacttttgagggggtttttagacacaagatctcactgtcttgcccaggctggagtgcagtgtggctcactgcagtctcaatctcctgtgctcaagcgatcctcccaggttcacctcccgaatagctgggactacaagaacacaccaccacatccagctaattattaaattttttgtagagatgtggtctcactctgttgcccaggctggccttgaactccaggcctcaagtcatcctcccacctccaccttcaaaagtgctgggattataggtgtgagcccaccatgcctggccttgaaggtactagtttttagagatggttcaacagcaaaaaaaaaagaaaaagaaaaagaaaaaaaaaaaactcaattagaataaagaaacatttcactaaaagaagatacacaaatagtcaataagcatatagaaacatgttcaacatcatcaatcattatggaaatagaaatcaaaaccacaaagacaggcgacttcaaacacactagaaggctgtagtttaaaaaacagagaatacaggtgttgacaaaaatgagaagaaagatccctcatacttactggtgggaaagtaaaatggtttatcacttaggaaacaacctggtagtcccacaaatcgttaaatactgagtaattatacaatccatataatgagtacaagttttattttagaaagaaggaaaatgttctaaaataggtaatggctaaacaactctgagactatgttaaaaaaaatacacagaactatacaatttaaatgagtgaagtatatgagatgtgaattatatctcaatgaagttctttttttaaaaaactaacttaaaaaatgtttaagcttgaccattataatccagttactcagtgacagaaccagaggctgcctgatcccgtgttcaggattcctacatacatcacaaaatcactaagagaagcatcacaattagctcattttcaaaaaggacttcatctatttctctcaaccaaagcaatacattctaacataagcactttgtgtactgatgtaatatttctcaaaaagttaaacagcatgagaaatttataatattagataaaattacaggctaggcatagaattgcctagtggctcatacctataatcttggcactttgggaggccaaagtaggaggactgtttgaacccaggagtttgggaccagcctgagcaacatagcgtgacccccatctctaaaaaaaaaaaaaaaaaaaaaaaaaaatttaattagccaggcatgctggcaggcacctgttatcccagctacttgggaggctgaggtaggaggactgcttgaccctgggaagtgaggctgccgtgtgccaagatcgcgccactgcactccggcctgtgcaagagagcaagaccctgtctttataaaaaaatctaaaaacaattgtcttatttctaactctgaactactttctatgctttggtgacatctatggtgaaaattgaaaactagcattaacagctagaaagaagcaaaggatttttccacatgaattccatctttcttagctttgcttttatttcacagaaacagaaaataaagaaaacctaatcagttaaattactcctctctggtgtcacatcctaataaataactgttatccttatgtccttcaagaaagaaatgatactagtaggacaatcatgtatgttttctgattactcttatcaataagtacctaaaatattaggcaaactaactcatatatagcacagctatgtagtatgtataactgacaaaacccaagatctctaacacattggaatgtaagtattcatttcctttaagaatagaatccaaacagctgtttctcaccaatatacactgtgagagaactcctgtgtacctccttgccataacgaaaggaagtttaaccccacagtacacaaacctcactgcacacacaagatcctgatgtcagaacaccaatactgaggggcgtacaatgtaaacatacagcaggaacctatggcagaggccgaaccttaatcatttccaccaacctttggaattctgctttggatttcactggaacacaggcttttgacagagaaatcagaatattcgaaaacaagaaatcaccaatatcaggctcttaagtcctattgttgtaaagactgaacaatgaacatagcagcaatcaactcccaaacttagctatgctttattatatgagagcctcccgaactcagctatgctttatgatataagagaggctcccgaacctagctatgccttattatgtgagaggctcccaaacttagctaagctttatgatatttgagaggctcctgaattcagctatgctttatgagataagagagcctcccgaactcagctactctttattatatgagaggctcctgaactcagctatgctttcttatataagacagacccccaaacgtagctatgctttatgatatgagaggctcccgaacttagctacactttattatatgaaaggctcccgaactcagctatactttatgatatgaggctcccaaacttagctatgctttatgatataagagaggctcctgaactcagctacactttatgatataagagaggctcctgaacctagctatgctttatgatataagagaggcaattcggtcacttgttgggtagaacctcctgggacaagcagtcaacagcaagaaagcaattcctgctccctccattttaaaacagaaggctctatttttaccactatccccaagcaaccaaaccagaaccaaatagcatggatcttttggaacgaggaaagctctaaatgccaaagtccaagtgtagaaatatatcttaacattttgctccatccttcaaatgtttcaatgaaatgtttcaatgctgtctgaatagcaacctcaataccaacatctctcatgcagtccaagtggaaatgttccgtttcttctattttccttcagcctgagacaaattgattcttttcaaagagtcatttcaatcatcctcacgggttctcttaaaatagacaaggcaaaaccactggctgttacgtgcctctcacaagttccacctttttcacaagtggacaatgtgcactactactgcgagtggacccccacggtcagacagggaagaggaacccaccatggctggacagggaagacgaacacaccacagtcagacagggaagacgaacccaccacagtcagacagggaagacgaacccaccatggctggacagggaagacgaacacaccagtcagacagggaagacgaacccaccacagtcagacagggaagaggaacccaccatggtcagacagggaagaggaacccaccacggctggacagggaagacgaacccaccactgtcaggggagaggagcccgatcgctgcctctatgctctgccaccacctagtgaataagaacaagaaaatcacatggcaagagcctgcagacgtcaagacacctatgatagacacctaagatgatagggtggcttttaaaacctgattttaagattacaaggttagctaaatatctgaggtagtttaccaggaaaaagaaaaatgtttagaggaagaacttggtcaagagcctttatgagagtgagggtcactatatctcatcatgtaaggggccttaggaacacaccccaaattatcggacagtctagaaaaatactatttactttaggatggaagtatgagttgctcatatataaatgacagaaataaattagcttttgcaaattgggctttataggtatacgtacatcaatatcctactggtacatgtctccatttttcttgatcctatactgtttggaaattttagtgttagcttctcagctagctgattattcattatcaaagcttttttgttcccaacggctcacttactaattatatatcaaaccacaaagctctcgaagtttctgctccctccttagcatcctatctggaccatcagacagcttctggatcagaactggatatacatcatcaacgcacactggactaattcaggataactttcctaagaccaaagaacaaactattatgcaacatcggtttattttgatacttaagataaccagtgctttcatatactcaatgatatggtttggctctgtgtccacacccaaatttcaagctgaattataatccccagtgttgaaggagggcctggtggggcacgactgaatcatggggcacattcccccttgctgttcttgtgacagtacgttctcacgagacctggttgttctcctgccagccatggtgagatgtgcttgcttccgctttgtctttcactatgattgtatgtttcccaaggaagcagaagactgtatggcctacagaatcattagctgatgaaagctcttttctttataaattacccagtctcccatgtgtctttatagcagtgtgagaactaatacactcaacaagtacaaaaactacggcttaaccacagcaacaatatttatttaccaagcatggctgaagatactaaaggagtgtgtcactgtgatgtagaatttctagagattaggaatccttaggatgggtatgctcttcggaaaactgtaccatctctttgcctgttcatggaccactgtcagtctgttgcctgttagaaacctggctgcacgacaggaggtgagtagcgggcaagcaggcattaccacctgagctccacctcctgtcagatcagcggcagcattagattctcatagtagcataaaccctgctatgaactgtgtgtgcgagggatctaggctgcacactccttatgagaatctaataataaatgtaatgtgcttgaatcatcccaaagccatcccctgtcctccagtctgtggaaaaatgatcttccaagaaaccagtccctggtgccaaaaaggttgggactgctggtacatcatatattagctctgtgaccttcttaactatttcagatgataccttttgtgctctcggttgaaaaaccatctccgaagataggagctattttaacacagctatcctaaattccttacttatccatcatggaaaaaaacaaatgtttattattgccaggccctcaagaagtgaatggtctagtaggaaaaatatacctagacagatgtagtcacctgatgggttcttcttgcctgctgcacagatagagctgattcagagacaacagtataaatgacagcagtggagaaagaggttacaaacacagagccagccaagcaaaagaacaggagtttattactcaaatcagcctccccacaagctcggggaccagggcttttcaaggataattcagcaggcagggggacagggaatggggaatgctgactggtttgggatgaaatcataggggtgtagaaaacaggccttgtgtgttgagtcggcctctggggtgggggcacaagactggttgagtcataaaaaaaaaaaaagcaagaaaagaaaagaggagaggggaggggaggggagaaagaacaacaacaacaacaacaagactggttgagtcctgggtcgtgggtctgggtggaatccgtcaatcactagaatgctaaagtctgaaaaacatctcaaaagaccaatcttaggctctacaatagagacgtcatctgtaggagcaattggagaagttacaaatcttgtgatctccggaacaatggctggttatggtctaactatccctacatctcagcagaatttcaggctcttcccatcatcctaatctcatcggctttcattaattttacaaaggcagcttcagtccctgagcaagaagggagttaatttgagggagggactgttttcatccttgctccaaggttaaacgacacactcaattcttcccgtggttagtttggcccacgcccagaaatgggcaaggacagcccgcctgtgagcttagaaggcggagtcagccatgctggacttctctgtcataatcattgcaaagctggtttcatagatgagaatctataataaggtatggtaaaagctaccatagagagatgtacaacatgcagtggtgatgacctctacttgggaatagcttcacaaatgaaatacttagagtggttcttaaagggcaagggttaaaccaggctgacaaggaaaagcatgtacaatggtaaacagtacattcaggggactgtaaatagtatagagtgactgaagcacagagcacaaagagggagacactggggctcaggttagtcagatcagcaggagccaaaaggaggaggagactggaagagaaaaactgagaatgaggtatgcacaatggaggaagataaacaggtgagagcattcacagaacccaaagaaacagaattcaagaactagtgatgagtctgacaagagctatataaaatagacagtatcaaacaacatccaacacccagccctctttctactattaataaaaagactgattgcccagcgtaattagtcataccataaaggagtagatagttgtagattttctcttgagatttcaactgtacacaaatttttcatatattttatttttattttatcttatttatttgttttgagacagagtcttgctctgtctcccaggctgcagtgcagtggcatgatcctggctcactgcaacctccgcctcccaggttcaagcgattctcctgcctcagcctcacaagtagctgggactacaggcatgtgccaccacgcccagctagtttttttgtatttttagtagagacagggtttcaccatgttggccaggctggtcttgaactcatggcctcaaatgatccacctgcctcggcctcccaaagtgctgggattacaggtgtgagccaccttgcccagccccatattttatttttatttatttatttttgaggcacaacctcattctgtcacctgggctggagtgcagtggcatgatcactgctcactgcagactccacctcccaggttcaagcaattctcccgcctcagcctcccaagtagctgggactacagatgtgtgccaccatacctggctaatttttgtattttttttacttctttgtacttttgggtttttccacattgcccaagccggtctcgaactcctgggctcaactgatctgcccgggtcagctttccaatagtgctgggactacaggcgtgagctaccatgcccagcctctcatttttaatagatactattttaaaaagtactgtgaaaaagaaacaaaaatgaaaaagacacatgcctatccttaaggaacttatgtcctaccaaactataaagtaagccataccatttatggatttgtagcaacatgtcatcctgtcaactttattactgaggctatgagatgtattaacattggctttcaaattatttgtattagcaaacataaaattcaagcatagaaattgagtctgatctaaaaatcagcaaattacaattatgaatttgttatattctcactgtatccacgtcctcaaaactctgacattagcaagccattaaacaagaccactaagattacattaattttatactaaagttgtatgctaaaattttcatctttctctgtttcatctttctctgttttcccaaaagaaaaaaaaaggtaaagatcaaaagttatatatttcagatatataatcctaaaaaatgctccattgctaggtgactaattttaagacactgccatcagtttaacaggtcactcgttcatttattcatctaacatttatttacccacatactgtgataggcagtgaggaataagcacagaacagaaacagtgcctgccttcacaaagcttagtctagcaggatagtaacttaagacactgaaacagtatattaagtgccttttacaaatattcttcgcagctataccagctactacttgcatttcaacattttatttcaaagccattatttatttgtttgtttattttttttgaaatggtgtcttgttaggttgcccaggctggtctcaaactcctgggctcaagcagtcctcccgcccgagcctcccaagtaactgggattaccggcacatgccactgtgtctggatccaaaaccatttttttaaaattatttcagtgttaagacaactttaagaaacaatattatgattggtatcggtcattaattgtgctattttatgacttcaatcttttgatgcagtatagtttcctggccatttccaatagaaaattccttgcccctttcaggctactgtagttgagatacaagacttgagatatttttctaagagaaaacaaaacaaacaaagcagccaagagaaacaatatcagccatgtaataaaatacccaatgtactttatttcattatcctaggcaaataaaaaaaaaaccactatgaattatacagtatacaaatatgttttcttcggaaaacactgaaaaacagattcatgtggaaagaaattactttattcctaccactgtctttttcagacacactcaaaattcataaaattcacaaaatctgaagctcataaatcaaaagaaactgttcatacatcatgaacactatactaactttttaaaaagtattcgaggcagctgaacatcatcacagtatcttaagactcatatttccttagattaattcagtgatcactttcaaagcaaagctttttatgaaagctaaaataaaatttctaggtaaccaaggagagtctttcaaatggaaaaaagctgatgatattaaactctaaaaaataaggcccaggcatggtggctcacacctctaaatctcagcactttgggaggccaaggcaggagtatctcttgagcccatgagttcaagaccagcctgggcaacacagcaagaccccatctctatttaaacttttttttttttgagacacagtcttgctctgtggcccaggctggagtgcagtggtgcaatctcggctcactgcaaactctgcccctcagatttaagatatcctcctgcctcagcctaccaagtagctggattacaagcatgtgccaccacacctggctaatttttgtatttttagtagagatagggtttcaccatgttggcgaggctagtcttgaactcctgacctcaggtgatctgcccacctcagcctcccaaagtgctaggatacaggcatgagccaccatgcccagccttaaatttttaaaaataaaaaatagagtatgtaataatcatataaagttctaaaacatccagtagcaatgttcttaaatcccagtaattcaggtgcttttttttttttttgagccagtttcactcttgttgcccagactggagtgcaatggcacgatcttggctcaccacaacctccacctcccaggtccaagcgattcacctgcctcagcctcccgagtagctgggattacaggcatgtgccaccacgcccggctaattttgtatttttagtagagatggggtttctccatgttggtcaggctggtctcgaactcccgacctcaggtgatccgcccatcccagcctcccaaagtgctgggattacaggcgtgggccgccgtgcctggcctcaaatactattttaagattgttcatccataatacattgtagtctgaaagaagaataacctctctaaacagtacctattaccttcatcctctctttttccaatataatggcaaaagacagagttgtgatatttttactgtaatcacagaaacatcaattcaacatatataggattagcatatcacacatttcagcaaatatcaaaatacagatgtttcttcatcctgatgaacaaatttattattaaacttgccaactattttccaaatttataaaagaccataataaaatgtgaggcaaaactgttcaaaccagttaaaatgagtctcgatcagctaaaatgattaacaacgccatcttaaagatgatcccatatctgagcacgtgatacctctgtgatttcagggcacaaatccctctatccatcaaactaaatagaagggttagagaggttaatcgagacagagtgtctgtaacagacttctgcatttcattctccactcaatatacttcaaacatcattgaactatttgttatgttcttatgaatcaatgctcccttcacagtcaagatagaggctagaagccactgtgtgaagtaataaagcttacctttgcaaatcctcatcaagctgatctgatgattaagtctatgtgaggcttcctaaacaactgaagtgtaatcacaactttaattagaagctcaaatggcactgctaaacacctaaataaaacatgagcaagtacaatagccacctgcaacgagcaatgccattttccagcctccatttactataaagagatttttctctattcagctgcacaatcacttgggctacatgatctctggcctagcaatagcagtcaataatttaaaatcatgaaaataaattttcaatctatacttaagttctattatgcactggtggtagtcaaaaatgtcacagactgaataaaaatgaagctcactcatttgctaggctggcaccccattctacccgaactgtccattaagagtcaccattaaaaacaaacaaaactcatatggcaaacttctgataaaccaatttactctatttgtggctgattaagggtgatcctggactacatggcttttttagttcctccctgactaatggaaaattactagaagagtaaggactacacagaactagttgcataaattacagttggccaggtgcagtggttcagcctgttatcccagaaatttgggaggccttggtaggaggactgctttaggccaggagtttgagaccagcctgggcaacatagtaaggccctgtgtcttaaaaaaaaaaaaaatttaattagccagaaatgatggcacatgcctgtagccccaagtactcgggaagttgaggcaagaggattgcttgagcccaggagttaaatcagatggcattagtgatggttgcacataccaagaaaaatatatcccagtttccttctttactccctgttttaaacatatatcctatcttcctagttcatctcctctggtctctccttctatgagatatggataatttattccctatccttgctgccttctaacagtagtataagagaaggtataatcagtggtaagaacatttaactaggaaataacccagaggtccactgacagaaaaactgataaagtgtggtctatgctataccacagaatatcacaaagtggtgaaaattaataactaatgctatgtgcaataacacatacatgctgaaaatgtaatgctgagcatttttaaatttcataagactatattcagcaatgataccatttatagggctcaaaaaacaagaaatatatatccgtgttcaagcacacatacatttgtgacaagcatagaaaacatatacaaagcatgtgaaacgtctcagataccctgattcaaagtcaagggtctcatggaaatttattcaggtttggatgcacacctgacttggcatgtatgctgctctacataggacacacccaacacaaccaacctagtgttgctctaaggccgctaacctttaaaataaataaagccagccagcatatcacccttcattgacctatcttaaattcgaatcacaatgatagctgtaagtggaaattttttgcttttcgttataaaagctttacacataccctggtggccaccgctgctgaggtcagcagcaccacggcagctgtgaaaggttagcagttttgtttttgtgtgttgaggccttggctcaagatcccatctgtgctgacttcagactgaagggaacacatttcctccagcctgaaaactgaaacatatgccgcaataattagagcttccttgagtcagttcagctgaacccaggatgctgagactgataacctgtgagcacactagaagacttcacatacggcacccacctgctagacaaagacagacatgaagacatggccacgaggcctccatatccaaaaagacagaagtcccatcatctatatgtattatgtctatatctgcttgcagactcctgcttctgctaaaaagtacagtgaggagtttgcaagttaaagagacagaactaagtcaacaaaactgcagcatttagaaagcccctgcaagcacttgatctctgcgtcctctttacttgatctctgtgccctctttacgtgatctagacttgtgctctccaatactggccacatttggctagttaatgaaaattcaataaaattgaaaatcaacttcctcggtcacattagccacatttcaagtgatcaataaccacatgtgactactggctgattaccatattggacagagcaagtataaaacctttctttcattacagaaagtgctttgggcagtcctgacttagacactaatccacttttttactcttattatattgactcataataattgtaaacatttatgaggtacagcatgattctttttttagacgggatcttactttgtcactcaggctgaagtgcaatagtgcaatcacggctcactacaacctcaacctcccagactcaagtcatcctcccacctcagcctcccaagtagctgggactacaggtgtgcacgaccacacctggctaatttttatattttttgcagagatggggtttcaacatgttgcccaggctggtctcaaactcctggactcaagtgatctgctcatttcagcctcccaaagttctgggattacagggatgagccaccatgcctggccatacagtatgatatttttacacgtatacacaatgtgtaatgatcaaatcagagtaaagtagcatatccaccacctcaaacatttatcatttatttgtgttggtaacactcaaaatctgcctttctagctactggaaaatatacaatacgttgtggttaatagacactaatccacttttaaaacaaaaccaaaaccgccaccagcatgctgaacatcaaaatcccagagctagccagaaaatgtcaaggattagtcacccagcacaattaatctgagatggtccacaggcttccagggttgaggcttctcttaagtggtgtctttattttatttcattgtttactgtcgcacagcgattaaaagaatggactctgaggccaggtgcagtggttcacgtctgtaatcccagcactttgggaggccgaggcgggcggatcacgaggtcaggagatcgagaccatcctggctaatacgatgaaaccccgtctctactaaaaatacaaaaaaaattagccgggcgtggtggcgggcgcctgtagtcccagctacccgggaggctgaggcaggagaatggcgtgaacccaggaggcagagcttgcagtgagcccagatggcgccactgcactccagcctgggcgacagagcaagactctgtctcaaaaaaaaaaaaaaaagaaagaaagaaagaaaaaagaatggactctagaattagacggtttgagcctgaatcgctgcaacagtctgttaattattcaaactctctcattctcctgtaggttaaatcgctgcaacagtctgttaattattcaaactctctcattctcctgtaggttaaaatgggattttttttttttaaatagagacagcgttttgccatgttgcccaggagcttgaactcccaggctcaagcaatctgcctgcctcagcttcccaaagcgctgggactacaggtgtgagccaccgcgcccagccaaaatggggatactaatagtatctacctcatagatttgtttaaaaattaaatgacacaatgtttgtaaatctattagtaccatgcttggcatagagtaagagctctataattgttagctattaactattattatccttgccaaaaggaaggagaagaaaagcatgaggctgaatttttgaattttgcccattaaaaaatatcggagctctggtaaagatgcactatgagagaaaatcaacacatatgatctgtttcatcttcagccttgtagtttaataatttcctttctcacctttaaaaagcttgtccttgccttttcgctcttcttgtaagtctctcttcagtgcaccgtgtccatagtgctacgtgttaggcactattcaaagcacatgacatgtaccagcttaataaattctcacaacaatcctacaaggtagatactcaatgtgcctatttattttcaagtgaaaaaacggagacacttagaggttaggtaactagtgcaggatcacatagctagtaagtgacagtgtcactggctccaaaagcaggcagtatggatgaagaatctctgctccatcacagccatcgtgcaaaattgcttcgatatgcagcagtcctcccttcaaaacaaacaaacaacacctttcccaagctatcgacctggtaatattattatagtttatttaattagattggcaggacaggcaaggagaagtctcttgggatttggatatgacagcagctctcattgtcctgtcttctgactaaatcccctgggggatgtggatggaataaaactctgctattcagaagggttggcattgccccctgggaggtctggaaatttatgaggatagtttggttttcacaataattggggggtaccatcactctgaaggagacaaaggtgcttatatcccacattatctgtcacaatcacatacaattttcaaatgtccactttagacaatttaggtctagattgtaactgctgattatgtataaggagcaattctcatattgttctagtgtatttaatatagttctaagattgcaaccaccaggtaaaatgaaagaaactggtacttttgtcttcaaaaccttagcaggagttgttcatcatctgagactataaggtcatgctatttgaatcccaaagacaacacagctgtatcagtctccaattagagccgcacattcacagtaaggctgcgccatgaccgctctcctagtgccaaaacatttatataaaacaatgtcctaggcagctgaggctgctataacagaataccacacattgggtggcttatatgcaacaaaaatctatttttcggccagacatggtggctcgtgcccgtaatcccagcactttgggaagcagaggcgggtggatcacctgaggtcaggagttcaagaccagcctggccaacatggtgaaacctcgtctctactacaaatacaaaaattagccaggagtggtggcaagcgcctgtaatcccagctactcaggaggctgaggcaggaaaatcacttgaacctgggaggcagaggttgcagtgagccgagatcacgccactgcactccagcctgggcaacagcaagactccgtctcaaaataaataaataaataaataaataaattatatatatatattcactcttgaggaggctgggaaatccaaaaatcaaaacgtctgcatattcagcgtctgagagctcactgctcattcagtgtaaatgaagaaacctgagggcaggtttcttcatttacagatggtgttgctgtgtgtcctcacttggcagaaggggaagtcagctcccttgggcctcttttatgagggcgctaatcccattcatgaggactctgccttcctgagctaattacctccccgaagcaccacctcttaatattatcaccttaggggttaagatcacacagcatataaattttggaaggacacaaacactctgaccacaacaggtaatagacaccatttgataaataattttccatttatttcttctttatattttcattgggtcattatattgctattttgaaactgtctatataaatagttatatattatctaagactctcccttcaggatagcatttgtgtgtgtgtgcgtgcatgtgcatgtgtgtttcaaaatacatgtttataaaaaggggttttgtgcttaataggggtgatgtcctctgctcggcatctctgggaaagaactggtctacagaataagctgttgctgtttcctatcaatattttactatacaggaaaatcagagctacatgtccttaacaccagctttctggtgagggaattactgataagtaatgagaattactgataaacagagagaaaaatgaaatttatgagttctccatcaagttctggcctctccccatcctaatccctatctcagaagcaagtcttttttttttttttttttttttttgagatggagtctagctctctcacccaggctggaatgtagtggtgctatctcagttcactgcaaactctgcctcccaggttcatgcaattctcctgtctcagcctcctgagtagctggaattacaggtgcctgccaccacacctggctaatttttgtatttttagtagagacagggtttcaccatgttggccaggttggtctcaaactcctgacctcaaatgatctgcccgcttcggtctcccaaagtgttgggattacaggcgtgagccaccgcacccagccaagtctttaaagtataaaaccttaaggttcatatccttcacccactttttgatgggtttttttttcttgtaaatttgtttgagttcattgtagattctggatattagccctttgtcagatgagtaggttgcaaaaattttctcccattctgtaggttgcctgttcattctgatggtggtttcttttgctatgcagaagctctttagttcaattagatcccatttgtcaattttggcttttgttgccattgtttttggtgttttagacatgaagtcttgcccatgcctatgtcctgaatggtattgcctaggttttcttctagggtttttatggttttaggtctgacatgtaagtctttaatccatcttgaattaatttttgtataaggtgtaaggaagggatccagtttcagctttctacatatggctagccagttttcccagcaccatttattaaatagggaatcctttccccatttcttctttttgtgaggtttgtcaaagatgagatagttgtagatatgcagcattatttctgagggctctgttctgttccattggtctatctctctgttttggtaccagtaccatgctgttttggttactgtagccttgtagtatagtttgaagtcaggtagcctgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatagcttttttcatgatattgattcttcctacccatgagcatggaatgttcttccatttctttgtatcctcttttatttcattgagcagtggtttatagttctccttgaagaggtccttcacgtcccttgtaagttggattcctaggtattttattctctttgaagcaattgtgaatgggagttcactcatgatttggctctctgtttgtctgttattggtatatatgcttgtgatttttgcatgttgattttgtatcctgagactgctgaagttgcttatcagcttaaggagattttgggctgagatgatcgggttttctagatatacaatcatgtcatctgcaaacagggacaatttgacttcctcttttcctaattgaatgccctttattcccttctcctgcctgactgccctggccagaatttccaacactatattgaataggagtggtgagagagggcatccctctcttttgcccattttcaaaaggaatgcttccagtttttgtccattcagtatgatattggctgtgggtttgtcatagatagctcttattgttttgagatacgtcccatcaatacctaatttattgagagtttttagcatgaagtgttgctgaattttgtcaaaggccttttctgcatctattgagataatcatgtggtttttgtctttggttctgtttatatgctggactacatttattgattttcgtatgttgaaccagccttgcatcccagggatgaagcccacttgatcatggtagataagctttttgatgtattgctggattcagtttgccagtattttattgaggatttttgcatcgatgttcatcaaggatattgggtaaaattctctttttttgttgtgtctctgccaggctttggtatcacgatgatgatggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttcagagcctgttattggtctattcagagattcaacttcttcctggtttagtcttgggagagtgtatgtgtcgagcaatttatccatttcttctagattttctagtttatctgcgtagaggtgtttatagtattctctgatggtagtttgtatttctgtgggatcggtggtgatatcccctttattttttattgcatctatttgattcttctctcttttcttctttattagtcttgctagcagtctatcaattttgttgatcttttcaaaaaaccagctcctggattcattgattttttgaagggttttttgtgtctccatttccttcagttctgctcttctcaaaagaagacatttatgcacccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaagtaggaacacttgtacactgttggtgggactgtaaactagttcaaccattgtggaagtcagtgtggcgattcctcagggatctagaactagaaataccatttgacccagccatcccattactgggtatatacccaaaggattataaatcatgctgctataaagacacacgcacacatatgtttattgtggcactattcacaatagcaaagacttggaacgaagccaaatgtccaacaatgatagactggattaagaaaatgtggcacatatacaccatggaatactatgcagccataaaaaaggatgagttcatgccctttgtagggacatggatgaagctggaaaccatcattctcagcaatctatcccaaggacaaaaaaccaaacaccgcatgttctcgctcataggtgggaattgaacaatgagaacgcatggacacaggaaggggaacatcacacaccagggactgttgtggggttgggggaggggggagggatagcattaggatatatacctaatgctaaatgacgagttaatgggtgcagcacactaacatggcacatgtatacatatgtaacaaacctgcacgttgtgcacacgtaccctaaaacttaaagtataataaaaaaaaaaaaaaaaaacttaaggtacagcagccactatcctgtctcttccccttgtcacctctccctggctgagccaacttgctttgcgttaactacctttctcacacatccccaagagcctacagaaaaggtctatgatcttggcttgttactaccaaatcatctcaaacctctcagcatctttacctactcagttaagtaaggaaactcacaattccttgagtagttcctgtagccctctcccagcctgaatggctcttcctggtgttgccgatgctaatcaatgactgaacacaggactgctgtctctctcatttctctgaactagctggcatatctttactttcttccctcttggcttctaatgaagacaaaactgcattgcctaattatcctttagaaagaaaaccttaacattctttaatacttgatctcttttcaatgccttctatttgtttctgtaattcagctaaaaatagttcagccattgaaaaaaatagattccaataaaacatattgaatgacaactatttaatgtgttaaaaagaatactacctgatttttttttttcagtaaactaaaaagcttcctgaatttgcagcattcttaaattgaagtaagaagtggagagacactttgggcagccgaggcaggcggatcatgaggtcaggagttcaagaccagcctggccaacattgtgaaactccatctctactaaaagtacaaaaaattagctgggtgtggtggccggtgcctgtaatcccagctacttgggaggctgatgcaggagaatggcttgaactcgggaggcggaggttgctgtgagccgagatcgcaccattgcactccagcctcagcaacaagagtgagactccgtctcaaaaaaaaaaaaaaaaagaagtgggaagaaagggagaagagattaatatagtagcagtttttaaatgttggtatgtaccagatcttcctaattacctgataaggaaggttacccataatttataggttgaagaaatcaaggcagagaggttaaacagtttgctcaaggtcatgtatagacacctccaccctcaccctcaaccagtgctaggattacaacccaatttgtctaattctattacatcatgctaccactctacagtaattataattagtgctaacttcataccaagaactgtgctaagtatctcatttagtctttataataaccctatgacgtaggtaccaaatttagcttcattttacaaatgagaaaattgggcacagaaagaaagtcaggttgcccaaagtcacacagtaaatagtccagcttatattcaaatccaggaacctgactccagaacctatgcccttaatcattaggcggcactctcggatagaattaaaatccaccaggcaaaaaatgagtaaatagctaatttttatcagtaaagattactgaggaaatcacaacagcgctattcccaacagaatgatttaacaatagctatgttcatgaggatgcatgatatagtttgaatatacgtccccaccaaatctcacgctgaattgtaatccccagggttggaggtggggcctgcagggaggtgtctgggtcatgggggaggatctctcgtggcccagtgctgtgctcatgataagatacgctcatttcaaagtgtatgatgccccacccccacacactagctcctgcttcctccatgtgacgggccagctccgctttgccttctaccatgattgtaagctcccagaggcctcatcagaaaccaagcagatgccaggtgccacacatgcttcctacacaggctgcagaagtgtgagccaaggaaacctcttatctttataaattgcccagcctcaggtacttctttatagcaacacaacagcagcctaatacaatgcactagcaaatcaaagtgggatttttgtttagtccacaagtgattaaaactccgaaaaaacaaaaccattaaccttacgaattaaatatcttcttttgatgggctaatgtaatattgaatatgaagtgattagaaagtaattccccaaaatttctgtctgtgggtggaaagaggggtggtatataacagcacaacacagaaatgtatccctacatgtgcctggttgaaaattcattttctctttggaatccaggctcctcctacccctagagcagtcagagagacatagctaccaaatgcaaaacagaatgcagtctttagagagagaccaccagggctgagatatcacccactgttatttacaaataaagccagcagtgagagatgggacagacatattagaggaaatcaaaagagtcatttttaaatgttaaagatttttcttggaaaatatgaaaggaaaaactaagaacattatcttggtaagttagcaaagccctgaagcaagcattggacatcccaaatcagccacatgggacacagaggagggtccacatagaaccaaagcctgtctcttctctacaaggttaaggtttgagtttcctagaggaagaaacaagagatttagaatgcatggtgtcatgtaaatcactctcactgtcattatttttaaggcttttacgtatatattttaactgcatactatatgtgtaaaatatatatattcatatacacataaatgcacacacacacacaaatacatatgtaaaaataaatgtacagctgattcaggtaaatcataccaggaaactgaagccagttttggtttttttgctggttttttttttttttttttgagatagagtcttgctctgtcgcccagaccagagtgcagtggcatgctatcggctcacagcaacctctgcctcctgagttcaagtgattctcctgcctcagcctctgagtagctggaattacaggcacacaccaccaggcccagctaatttttgtatttttagtagagacgacgtttcaccatgttggccaggccagtctcgaactcctgacctcaggtgatccacctgcctcggcctcccaaagtcctgggattacaggtgtgagccaccgcgcccggctggagccaggtttttgacatccacattgggtaaatcctggtgagcagaacagcacccatcacaaaatactgccttaatttaaagctattccagctaggtctgtttcatattactgtaatgaagataatagccaaaacatgataataaaactaacaaacccctggaattgttaacacagatacactgtcaacaatttttctacaaaaactgccatgtcagcttaagtgatcttttcttctctgaacagttacagcatttaccttctctaggcttaggacccagagatgcaaagggaaaggcaagtgttgtgggctcaccccccacttctaatataacagcaataataatagataaaatgtatatcgtacttaccacgtcccagactgtttttaaatgctttaactactccattatttttaatcctcacaacaatcccattattagtccatgtactaacaaggaaattgacccagagttgaggtaaatagtcccaggtcataaagctagttcatagaactagatctagaaccctggcctccagcactaaaaattacataaataaataaataatctttgctcacttatttttttaaagaccagtgaactatgctcagcccaggctagactcaaactattgggctcaagtgatcctcctgcctcagcctcccaagtagccaggactacaggcacacaccatcatgcccggctttcaccattttttcactcttttggttcagtttaagatttcatttagagaaaaaaggttttataccatttaaaataaaaacattgagcaccactagtctatatagtttatttatctattgccactcaaactctgatgtcatttttatggtgttctggttgcactgtttaattctgttagttaactttccgtatgttatgccttgaactgcatacatgtacgtagaaactcccacacgtaagtacactagactggaagttcttagagaacttatattctttgtattaggttggtgcaaaaggaactgtgggttttgccattaaaagtaattaatatctcctatgttgcatacagtacaatgcattcacaaataaattttttgagaaataaacttgatttaactgttcaaataaatttttatcctggggtaaatagttttagtttaaactatgctactggtaataataaacaatccttaagaacatcatatgagacagcagttctgcccaacccactcccaatttcttacccatgcggtgtcactaatcaatttataggttggaacaagaaaaaagttttacattacagaactaataaagcatactttccctgcagagggaccactactgtgacttaaaggttctaattaagtttttttctttgaagcttagtattcaaatctgcattcttacttgattagtattcaccaccattatttttatgcagatcacatgaaaaatgaaccctatgtgccagaataacttgcaagaaattactattcatcagcatgaatcaacaagcccacaattagaacagtgtccactgggaaaagtaaaaaaaaaaaaaaaaaacttttactaaggtcatataaaatgaaagtaaagggggaaaataaagaattcatttttgcattgaaaatcatacaaacgttttcagcagaaaattactatgactattattggggctcagaaaatgatatcctgaagtatggtgctttcatatgctgggcacttccgaattttaaaaaaacagaagaccttagaagctgcctcagaaccaaggactctgtaaccttctcctgtatctctccaactcccaaagcacagagaggggctctctctggaatttccttatcagactaaggaaactttttccttaagaaatacaattctcttaaacctcctccccagaaatctcattaaattaccaggaaagattaacctgagaagaaaagaatctataataagtcattgccaagaccagacagactgttcgtctgttcttcagagggcagctttgagacattacccgagagacttcaactgcataatacaacaacctctgttcaccctacagttcctccctcaacttcccataacttgtgggtcccattcagtttccaaagagaaccatttacaaactactgtctgctccttggatccattaaactctcctaaaatcactatcccccaaaattgcctatattcccccatctccctgactgctagaaagagagtgccatttaagctgtggctatctggcctttctgttacagcccaacaggttcttcttacctgctgcccagaaaagccaatacacggagaacagtaggggtgttgcagcagagaaagagtttaattactgcaaggcagctgagcagaaggaggggaggtatctctcaaatccacctcctcgaaagcttggagcccagggtttttaaggataatttggcaagctgagggccagggaatgtatgctactgattggttggagatgaaatcactggagtgttggaactgtcttcacgtgctgagtcagtttctaggtgggggtcacaggacgagttgagtctgttccttggtatgagtcatggtccagatggcatcagtcagtttaccagaatgcaaaggtctgaaaaatatctcaaaaacccatcttagggtttacagtggtgatgttatctcaaatcttgtgacctccagcagtaaccaagctagggaacaatggctggttatctcttcttcactgtgcttattacttagcagaattcaggcccttatcataattctaatcttattgactttcattagttttacaaatgcagtttcagttcccaagcaagaaggggaccagtttcaggaagggactattatcatccttgctttaaagttaaactgtaaactaaactcctttttagttagcttgacctacacccaggaatgagcagatagtcagcttctggggtcagaagcaagataaagtcagctgtgttggatttctctaaccatcataaccttagcaaggtggtttcagttctctgagtctcatatactgtgtggcccctgtgcttctgcacattaatacatttatatgcctcttcccctgttaatcagtctaatgtcaggtcatttcagcactttcaaatttcagagccagagggggaggaaaaattatcttcacacctatactctctaagaccaaaaagcaacagacattctgccacatgctacaagacggataaaccgacaaatattatatggttccacttataagaaacatgaagagaaagtagagtaaaggttcccttgtccccctctgccacagagggagtggcttgcttcttcagcgccctgctgctcaaacctctagggggagcatacagatgggcacgttgtggggctcggaccccatggcagtgtctagaggtgtatgtttacagctcctgaagccccagtgggcatgtgttacaaggtgctcttttaatctagccgtctgtaggcagcttgtgttagtcagctcaattagacccccttccttatcacaaggacaaagggatttctatatcctggggtttcttgctttggtgaactggaagaatcagatcacatgtaggcttggagaataagtgcaaggttttattgagtaaagtagctctcagcagatgggggagccagaagggaaatggttttctcccggagtcgggcgctcggtgacctgggctctcctccaaccgtcccagccaaactccacgtcgttctgctggccgacggcctcccagcgtgctggcatctgttgctgtgctcttctgcctgcgtgctcccctttgtcaggcctctgagcccaaggtaagccatcatatcccccgtgacctgcacgtatacatccagatggcctgaagcaactgaagaactacaaaacaactgaaaatagccagttcctgccttaaccgatgacattgcaccattgtgatttgttccctccccaccctaagtgatcaattgactttgtgacaataccccctccccgcccttgcgataatggactttgtgatattcctccgcccttgagaatgtaatatcctttgtaatatcctccccacacttgagaatgtactttgtaagatccaccccccactagcaaaaattgctcctaactccaccgcctatctctataagaactatagataagttcttatagggataaacctataagataaacctataagaactaatgataatcccaccaccctttgctgactctcttttcagacttagcccgcctgcacccaggtgattaaaaagctttattgctcacacaaagcctgtttggtggtctcttcacatggacacgtgtgacaccctccacgtcctcccgatgtccggccacttgtcttcttccaccaatgtgttcctctcaccctccagctgcttctgtctgtgccttgctagggtcttgggtttttataggcccaggatgggggcgtggtagaccagggtagtcttggaaaatgcaacatttgggcgcaaaggcagaagtgcttgtcctcacctaggtcgatgggggtagcgccctagccagggaccatgccctcctctacccagcacttcccttacccccttcctcatcatttaaagggaccacactcttcccttcccagcactcccgtatcacagtcagtggtggcactggattctcataggaccactaaccctattgtgaactgcacatggcagggatctaagttgcatgctccttatgagaatctaatacctgatgatccaaggtggaatagtttcatctagaaaccatccgcccccctcactctatatccctggaaaaactatcttccgcaaaaccagtccctggtgccaaaaaggttggggaccactgttttcagctaaaaagtctgtcacgacttgagctgtggctcatgcctgtaatcccagaatttcgggaggccgaggcagggggatcacgaggtcaggagatcgagacttctccatcctggctaacacggtgaaaccccgtctctattaaaaatataaaaattagccaggtgtggtcgcacatgcctgtagtcccagctactcgggagggtgaggcagaagaatcacttgaacccaggaggtggaggttgcagtgagctgagattgtgccactgcaccccagcctgggcgacagagcaagactgtctcaaaaaaaaaaaaaaagtctgtcatgacttgatatagcatcaataagaagctaatacataaaccactcgatgaggagtttagaagatgaagttgaactgaaagtacagcaaaaagaaaactgactccatcatgcaagagactgctcctacagcttggggttggaagtaaataaaataattaaaggcacagtgacttcacagcacgcaataaacatgtattaagcacctacttcctaaagcccactgcagtcaatgataattcagtcaagctgaaatcatcatcatccaaggttcgtttgtaaataatttaacagtttggagagaatatgtgaagaacaacagttttatttccaagaattcatgaccttatctagagaaagtttatgaatggacagagaagatagtcttatatttggcatgatttcctacgcaggtgaaagattcaactgcccaaaaatatctgatctttggcttgttctaatatagcaaatgcccactaataaaaacctttcaagataaatcttcaaaaaagtattaaaatggaaatgttaacaagaaaggtagtgcccactaaaattatagcataggttagggaagagaaattgccgtggagcagggcaaaaaatcattagctggaaagataaccaacccagtttggagggattaatgcagtaattgatgaactttacctttttctttgtctgggtgctgaagtatgactatttttataagacagatctttctaggcagtccagttactatatgtcaacacatagccttgtaaaagtataatatcctataaagaaataaactctaaactcctcaaatagctattcttctctaatgtttacactgtatatttttatctgataggtaagggtcaacactgtttgcatcattaactggcaaggaataatcgaaattactaattacatttagcatgtctcatattgatgaaacaacagatgtttaaggaagaagcttctttaatatctactaacattatattatgtttcattgtattacacaaaactaccaataaggctaaagcagttgtaccacttttatttaccttacaacaaagaataaatagcttgacaagatccttttaaaaaaaaaataaagtgccattactaattctgtaaaccagtaaaagttaccaaaagaattttaataaaaagatctcaagacccccactgtattttgtaaaatattaaaggcagtaaaatgtaacaaaataaaatagaaaaggtgaccttcaaatccatgaaagaaataagcaaaaaaacaagatgaccttaaaatgaaagttctaatgtcatttcattattttattgtaagtcacagagcccccaggtctatattaaaggcaatatttataagacttaaaatactaaaaaaagaaaaaacagaaaaagactaaaaaccatctacaataattcagaggtatttgaaaataatacaaagcaattaaaaacagtaaaatagaagagatgattaagtctaaaagcagctcagaaaggcctacagctgagctactgctcagggagagggaagctgagctcaaagccccaaacatcaagtgcaatgtgaggaacagaacacactcgaaagctgggggactgaatctgagtcagaagcccctgaaccaagagcgccaagagcagaagatggatgtgccagctcaaaagggagagagcaaattcacctttcctctgcctttttggtctactcatgccctcaatagactgatgagggtgatctttaccagtttgcacattcaagtgctcatctcttcccggaccactctcacagatacaaccaaaagtaatattataccagctatctagacatcccttagcccagttaaccatcacaagtaaggaatggtgacatggaataccggagacagaatagcatgacactgtgaaggccctttgatgataagccacagatcaaagaatactagggcaaagatttttgcataggaaaatgacataatctctctactacatatttaacctgattaaaatggatttttgcacagacaactaaggaagaggccttgttaggatcttgtttagaataaatagataaatatatatattatagttggataggactttaaatattgcctgatcccattccttcatttatcagactcagaaagtataatctcctcggggtcagctggaaaattagtgacaaaggctacaatgtttgcctttttttttaatttatttttttgagacagagtctcattctgtcacccaggctggagtgcagtggcatgatctcagctcactgcaacttccacctcctgcgttcaagggattctcctgcctcagcctcctgagcagctgggactaccagagcccaccacgcccagctaatttttgtatttttagtagagacggggtttcgccacgttagccaggctggtctcgaactcctgacctcaagtgatccacccgcctgagcctcccaaagtgctgggattacaggcgtgagccactgcacctggtttacaatgttttcaaacaatgaactcataagtactcttatatttattatgatttttttttaagatagctctatctcccagaatttctacaaccacctctttaatgaactgaagtctttctttctttctggccacaaatatttactgaacccctactatgtgccaggcactgttctagaggataataacaaaattaattctctggttagatctaaaattcaaaagaagaaaaaaaacaataaacaaacacatacatcacacagtggtaagtgttaggaaggaaaatggagtgagatgacccggcgcagtggctcaggcatataattccaatcactttgggaggccaaggcaggcggatcatgaggtcaggagttcgagaccagtctgaccaacatggtgaaaccctgtctcttctaaaaatacaaaaattagccgggcatggtggcgcatgcctataatcccagctactcaggaggctgaggcaggagaatcacttgaacccgggaaacgaaggttgcagtgagccgagatcgcgccactgcactccagcctgggcaatagagtgagactccaactcaaaaaaaaaaaaagaaaaagaaaagaaaaatagagtcagaaggaaaacaagtgcagaacagaaggtattataagtacacagagagcagccacagactaccatctcataagatggtctgcatgaaccaggagcagtggcttgtgcctgtaatcccacctcctagaggggatgagatggtgggatcacttgagtccaggagttcaagacaagcctgggaagcataacaagaccctacctctaaaaaaatgttttaaagtagtcagatgtggagacgcacacctgcagccccagctacccaggagcctgaggcaggaggattgcttgaggccaggagtttaaaactaagctgggcaatatattttatctcaaaaaaataaaaaaaaagatagcctgcactataagaaatccagtagaagagtggtccccaaagactagacaataaatgagaaaatagggagcaggtaagcagcctgtttaaaagagggagggagaagaaaatgaggttgaagtctaagtttcagaacaagtagaatcttatagaccactgtagaaactttgccacagaagtttcccccagaaacagtgcaaaccaggagacaatggaacatctttaaagtgatgaaagacagaacaaaaagtcaagccagaattctatatctagcagaaaaatcattaaaaataaaggcaaaacaaaaattccagacaaatgcaagaagaattgggtaccagcagacctaaagctagaaatttttaaggaagttcttcaggttaaagagaaaggataccagctggaaacagatgaatacaaagaaatgaagagtgctagaaatgttgtaacaatgtaccgtggggtttataacacgtacaagtaaaatgcatgataaaatagcacagaaaataggaggggagaatagaagtaaactattgtaaggttcttacattatatattaaatttatattattttacagtagattatgatgagttagagatagatgttttaaaccaaaagcaacaacaaacaaacaagtatagctaacaagtcaacagaagagataaaatggaatattaataaatactcaaaggaagacagaaaaagagaggacaaaaacaacaaaaataaattaaaaaaataaataaataagtaaacttactaaaacatggcaagaaaaatgcctaccaagcaacatatttaagctggtctgtgttagtgcatctgttgggaataaagctgaaaaccaacatctttactaattgatataaatgtctgcctgaagttttcacagatgatttactgtaatatggtcattctacattgctttcctttccatctgtcataaaatagctgtgtatgattttcaaaattaaaaaattaactttaattagccaactagtttactgataatatcttctcactcaaataagtttttgaactactagacatcgccaaataaaaatagcagttgaggatttgtaaaaagaaaattaagtcaaatagttatttgcaaaatcgttttatcatctttggttcatggaaccattatgtttatcttatatatgctacagcttttttatcaacatgcaaaaagttgtcacatcaacatacccacttgcaaaaatgtaattatactttatataatttcttatatactttacatagcgataatagtaatcaagtactaactatgatagaattcatattggcggagataaatggagcaaaataatattgcttactttgtaaaaataaataattatcttattgatgttgccatttatcctacttgattctatttaatcggcaaaaaccccaggctcaatgtaaaactggtcacagcaagactaggtcagatctctttccaaagtgccagtccagacttctgagtgaccatgggcaaagcacatgcggtgagtggtagaggaaccccaaaactttttcaacacacaccagaaaccgcaaagttacccccacccacatatggttccattcagaaacgaccacagctctcctggtaccggagatacaacaccaacctagataacaaagaccacagagtacatccatctcctcagtttggtctgtaactggagtatcttctacatctccacagcacagatccttggaacgccactgtaacataagctcagcactcaccattctcttacatgcctaaggctttctacagtaagccacagccactctctgcctgagagtgttcactggctgggagcttgctgagacaggccagaaaccagagctggacaagagtgaatgaataaatactcccgcttctttgccctcaggtaagataactatgaggtagattccatgtagcttcacaaaagtacccaatgggattgagcttcagttgccaatagttgcggcctgttcattagcataccctgtagtggcttcattctgtcttacttactcagctctttacaggtgcttcctgggatcatctccctaataaactacttgcactcaaatccttgattactttaatgccatccttcagaatgatgccatttcgtccaagaacaagggatgcctttagttttgttcagttctactttcgggcctttcaggagtgctttaaagttttcttcctgtaagttttgtacatttttaaagtttaattgctgagtattttatctttttttcttgctattgtaaatggggttttctcttcgattatatctctttttttttaagactagtcaagcgcagtagtaacaagtggagaaagactagaacaaggagtttaatctataactgactgaaaagtcaattgagataactcagttggacctttggaccagccttccttataccttctaactcattattgtttacatttatgaaggcttttgatttttccatgttaattttatcatacctattaccctattgagttattttactgagttgggattttttaacgactttattgagaaatcatttacatgccataaaattcactgattttaaatgtactattcaatgggttgaagtatatttagagagctgtacagccatcaccacaatgtaattttagaacagtttcatcaccccaaaaagaaacctttaggcccattaggagttactccctatccctaccccatctcgacctcccagccctacacagccactaatctactttctgtctatatagatttgcctgttgtggatattttacataacgaatcatatgacatgcggtcttttatgtccggcttctttcacttagcataatgttttctgaggttcattgagtaaggttttatcattgatttactagggtttttttaagtaaaatgtcatatgagctgcagatagaaatcattttccaattacaatgcctccaactgtttcctcctgtcaagtgcttttgttaatactgccagtacaatggtcccaacctttgtgggaatattcttagtgtcttcctaataaagtaaagtgctgattatttgatactttaactctgagaggaaaatcatatgtttctatatatgtcaccaccatattacattaactagaagccattatttgttcatctacaacaggataaaataatgtctgccctctctactttacagaaatcctaaaaagaaaatatatataaaatattttataaacaataaaactctatgtaaatttgagagcctatttactataccataaaaataattttagaaaccactgaactcctttgaaagtgtgtgtttttaactactaccaaggagagagaagttagtagacaagaagcaaggcgactagatcattcagccatccaggtatgtaaacaaagaaggaaagaagctagctacagaaagcaaatgtcatattggaacacactgagttttctaagttcctctgacatatttctggtcacagaactatcaccaaacttaaagacctaaaggacttctaatattaaacattaaaatagtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaataaaaaaaaataaatgtgagcatacatacatttaagaaagattaagcaggccaggtgtcgtggctcatgcctgtattcgcaacactttgggaggccaaggtgggaggatcacttgagcccaggagttcaagactagcctgggcaacacagggagactccatctctacaaaaattttaaaaatcagccaggcatgcctatagtcccagctgctcaggaagctgaggtgggaggatggcttgagcccaggaggttgaggctgcgatgagccatgactgtgtcactgcactccagcgtaggtgatacagtgagatcttgtctcaagagaaaaaaaaagtaaagcagaagaagaatttagaatttagaggtatgcttaaaaggttaaaagattcttaaatccttaacttattacagaggaattccaaatacagacatgaaaatgggggatatctacatgactgaaagtaactgaaaatatctgcttatctactcaatgaaatgttcaaatataaaaaaattttagacctcttgacaatgtaggaattgacagccagtaccattattagtgcttatttgttaaagtaagggggaaggaaggtagttcagttagctcttgtaaacaccctcggattgatttgttcaatcctggaaaaaattggtctatgcaatagtaattttcacatttttagagttcctttaacctactgtgtaaagtatgcagtgggaaggaagtcaaactagttacttaatacttatctttaagttgaattcaaattagtctcagagttaactaaccagtgtaagagttagggtgtttttcagttgcaaataacaaaaaaacagatttgcattaaaaagaaaagaaaacccagatagtgggcaggtttcagagttggttagaaataataatgacaacagtaacaacagcaaatactatctgtcaggtactgctctctccattttgtgtgtattaatctatttaatccttgccacaactttctgagagttgttatcctcattttacagataaggaaattatctaaaggtacagagagcatctattacatttgcccagcatgccacagttagtgagtagcagagctggcattcaaacccgtgcaatctagaccagagcccatgctcttaactgctgattcaaacccgtgcaatctagaccacagcccatgctcttaactgctgattcaaacccgcgcaatctagaccacagcccatgctcttaactgctgattcaaacccatgcaatctacaccacagcccatgctcttaaccgccgatgctctgctgcctcgtgatggcttctcaggctgtgactcctttctctccagttccctctgctctgccctcttccagagctagcttgcagctcagtctggctccccgtcaggaatattatagatgccaatgggtcctggaactaccctgtactcatataaaaggggagagcacaagcattccttcctaccaaacaaaagctctgagtctcactttaataggacagatcaggtattgttcccaccacagaaccaaccaccgtagacagggaataaggttgcccagagttatctatgccaatgggaacccaccacaggtacagtaataagggaagtctaccccaccaaacctgcaaaactgccatgtaatgagctggattggaaagaatgttgagtagaagccacactgtccactgcaaccagtgatactcttgggtgatacaactctaagaaagggaatcaagatataaccttatggtataacttactaaaattcatcaaatgtaagatgctatggattgtaagacatgccattattaaagataccattaaaaacagtatagcactgccaagtatcatcttaagaggccttcaaatgtaggacgcatcctaatttcagttatgtcaaaaatgtaggaggaaacgtccatcttacaataaaacaaaaatatgaagtgccatcagctggagttgtaaaaatccataactgctttcccacatatatctacataagtctaggctatgactctatacacaggctgagaaatgaaacagcaatcaaccctgctgtgttcccagaacttaagatgaaagatattaactaaaagagtcgtcagaggcctcactcctcaacccctcaatcaaacaccatgtcagacaagcaatatccaccatatgccaggcacagtgtctgggtcctacaagggaaaatgtcttaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaacggtaactcctgcctcaaggatatgactggcaagtactaaataatcatacgagaaatggtaactcctgcctcaaggatatgactggcaagtactaaataatcatacaagaaacggaatgaagtaatgctgttaaatggatatcaataaaatacaggggctcagaaaaaggaaagattaatatagactaactggaacagagacagttccagcatcaagataacatcagagctgcctgggcatctgtaagaaatgaggatctatttaagagaggaaggcaagaagcaagagtaaataacatggaggtatttcagatcacagtagtagaaatcaagtacttgagttgaactagagcgaaggccgtatgtggcagagtggactaaaaagctagaaatatagtttggagccagcacatttggtaggcaagaagagacactgaacattcttgggcagagaaatgacattatcagagaggttggagaagaatccctaacgagttgtttgcagacactgggcttacggggcttgtgggacatctagggagttttcactgaaactgcccagaagccacccagatataagtatggaatccacagaaagatctaagctaagagtttttatctgggggtcatcaggactagatgataactgaagttatgaaataaatgacattttcttaggaggatctgacatgccagaaaaacaaaggagcccagagaaattacctgaggaacgtcaacattagtggaatgagcagaagagaaggagcttatgtagaaaaagcagcagaaactacacaacaagaggaaggaaaaccaggaacgtgggaaaagagtatgtaagaaaagagagaagttaatactgaccagtttcacagcaagatagaataagaactgaaacataacccctgagatttagattattgatgagctggctgaaagcagtacacatggactagcaaggatggggtagtccacacagggaggtcagaaaaggatgcttagaaaagattgcttttgagctaagaagttaaccagataaacaggaaaaatcaccaaatgtaagggaagaaaaatagtatctacaaagaataggctggatccaatacaaaaatatgtatcttaatcaaaaaaaagaaaaaaacaataaacgcacacataggatttttacattcaacaagcataactaatttgttacctcacacaaattgatcttttgctttaattacaatgctaactttttaagaaaaagaacccaattaaaaatccagcaaatacacagctcagcaaaatttgatgaaaaggtatgcaaataagccacaccttttgtatgacctcttgctaaaaggagcaactttaggccaggtgaggtggctcacacctgtagtcccagcactttgggaggccaaggtgggtggatggcttgaagccaggagttcgagaccagcctggccaacatggtgaaaccctatctctactaaaaatacaaaaatcagccaggcatgctggtgtgcgcctgcagtcccagctactcgggggaggctgaggcagcagaatcgcttgaacccaggaggcagaagttgcagtgagctgagatgccaccaatgcactccagcctgggcaacacagtgagatcccatctcaaaaaacaaataaataaataaaaggagcaactttacatatatctgctatacaaattactctccatttctgcaacaatctgtttaactctaggcaacaagttcaatctcaaatttcattttgactcaattcttttcttaaaaaggattccatattttataatagaaagagccatgaaaaaactctaacttttatttattttaggaattgggaaaatcattccattcctaaaatccgacatatctgactatactctggaaaaaagtatatagtctggcaactcaatagacatgtattttttaaaaatctcactgaataattgcagataagacaaacaagagtaatctaacaattatgccaaacttagattggactacatgtgtgaaagtactacctctctagcactttctccaaggaaactatcagaaccatttattttccactgcataatagcagaactatcagttatgtgacatcctataaaaagacaaacacaatttctaattatatccattctttcattttaattactctagagagtgattacatatttaacttggctatctttaaaaaattaagttgctttaatgaaagtattttagatagctacaccaccatacatcaattagaaagttaatcattccacttgttctcacaaaaagattttaaaggaggtggagaggtggtgtttggtgctttataaaagttaattagagggcacccagaaagagagatcatccaggaaataaagtttatcaaaaatccaaaatatgtaatctgcacagtgtcaagaaacagcaggagattctctttaatgagtttactcatgttcactttaaaagaaaatcttcagttcacgatgtgaggttgagttttaaatatactggaagacttctctgtgtaacagactgtaagactccactcgctcgcttggtcttgactgcctaactgatggcagactattatctaaagcatattcctactctaaaggcagccttctattttacagtgatcttgctgtatacttcacagtcacactcatcattacaaaacattccgaaagctttttttaataagttttcagtgtttgaattatcatgatcactccctcaaattaattactaatatgataagaaataatcaaggttaagttgatacttaatttttggccaaagcaggttcaatggatctatcctagatcaatagataagcttaagaatgcatttctggaagtcctagccagagcaatcaggcaagaggaagaaataaaaggcatccaaacaggaaaagaagtcaaactctctctctttgcagacaatatgattctatacctataaaaccctaaagactctgccaaaagactcctggaactgataaatgacttcagtaaagtttcaggatacaaaattggtatacaaaaatcagcatttctatacccctataacattcaagctgagggtcaaattaagatcacaatctcacttacaatagacacacacaccaatatctaggaatacatctaatcaaagaggtaaaagatctctacaaggaaaactacaaaacactgctgaaagaaatcagagatgtcacaaacaagtggaaaaacattccatgctcatgaattagaagaatcaatatcactaaaatggccacactcgcggtggctcacgcctgtaatcccagcactttgggaggccaaggtgggaggatcacttgaggtcaggagtttgagaccagcctggacaacatggtaaaaccccatctctactaaaaatacaaaaattagccaggcatgctggcacgcgcctgtaatcccagctactcaagaggttgaggcgggagaattgcttgaattcaggaggcagagatggcagtaagccaagatcgtgccactgtactccagcctgggtgacacagcaaggctggctccgtctcgaaaaaataaataaaataaaatagccatactgcccaaagcaatctacagattcaacgctatgcctatcaaactaccaacatcatttttcacagaattagaaaaaattattctaaaatatagaactcaaaaagagcccaaaggattgcccaagcgattctaagcaaaaggaacaaagccagaggcatcacattacccaacttcaaagtatactataaggccaaacagtaaccaaaacagcatagaactggtacaaaaccaaacacatagaccaatggagtacagagaacccagaaataaagctgcacacccacaggcatctgatctttaacaaagtcaccaaaaataagcaatggggaaaggaccctctagtcaataaatggtgctgggataggctacctatatgcagaagaatacaactggacctctacctttcatcatgtacagaaattaagtcaagatggataagatttaaatataagaccacattctacaagaatcctagaagaaaaccattcttctaaaggattggtttaggaaacaccattctggacatcagctttagaaaagaatgtgtgactaagtcctcaaaagcaattgcaacaaaaacaaaaattgacaagtggaacctaattaaaataaagagcatctgcacagcaaaagaaattatcaacagagtaaacagacaacatatagaatgggagaaaatattcacaaactgtgaatttgtctatttgtcatccgacaaaggtctaatatccaaaatctataatgaacttaattcaacaagcaaaaaacaaatgaccccaatacaaaatgggcaaatatatgaatagacacttctcaaatgaagacacacaagcggcagacaaacatgaaaaaatgttccacatcactaatcatcagagaaatgcaaatcaaaaccacaatgagataccatctcacacctgtcagaatggcttttattaaaaagtcaaaacagaacagatgctggcgaggctgcagagaaaagggaacgtttatccactgttagtgggaatgtaacctagttcggccactgtggaaagcagtttggagatttctcaaagaacttgaaacagagctaccatttgacccagcaatgccattagtaggtatctatccaaaagaaaagaaattgttctaccaaagagacacatgtacgtatatgtttgttgcagcactactcacaatagcaaaaaacacggaactaacctaggtgtacatcaatagtggtttagataaagaaaacatggggtgtgtgtggaatagtattctgctccccatggaatacttagccataaaaaaagaacaaaatcatgtcctttgcggcaacatggaaacagctggaggctattctcctaagcaaattaatgcaaaacaataaaaccaaataacatgtagttcacacttataagtgggagctaatcactggtactgctggacataaagacggcaacaatagacactggtgactattaaaggagaagaggaaaggaggaggcaaggattgaaaaattattgggtactatgctcactacctgggtgacaggatcatccctatttcaaatctcagcattacacaatatacccatgccacaaacttgcacatgtattccttgaatctaaaataaaagttgaaattatttttttttaaagaatgtgtttgtgattatctgaaattattgcaaaatgtatatacatttttttccaaagaggtttcacggatttcataagttaactgttttattctatgaagagaccatggaataaacaaaacaaagcagcaaaatgttaagtgaaaactttatattcagactctgaagcttctttggtaagggtagtgtgttacgcaaagaggtattctgagtaactgtaatactagataaggaacagtcaggacaaagccactgcttttctctaagttaggaaaacatcaggaactcctgagaattccaaaatagcttgaatgaggaagggggaataagggaagagtaatagcgttgagactctaaatgatagaagaattccaaggagaagatacaagaattccaagaattccaaggagaagatacaagaattccaagaattccaaggagaagatacaagaattccaagaattccaaggagaagatacaaggaaactggacaaaacacgctaaatgaagctacattaattagaatgtcccacgtggcatttgaatttccctctattagagtttttgctacatttccctgaaggtttatcgagggcagacactgaccttaatagtctttgtatcacgggttccagcacagtacttctcacatagttgttactcaacatttcctgggtcagtaatgaaaacatgggttggaaataggtggcaagtttttttaaaattattaaaccagaagctttcagtgggtagtagttacatattcaaatttccttcacccacttgagagagaaaatataaaggctatgaaatgtgtcgggagaaaaactatgaaccattctttcttatttgaaaaaaaaaaaaactatacaacaatagaagaaagttgaaaaagaacctaatcttccttcatggaaacatggacttaaacaaaaaaagaacctaattttcctaaagtgaactaaaagttacaaatttcaatctccaataattgaaggcaagaactttgttcttatagactatctcaggcagcagtttaaaaggggggcctacaatgttttcccctttgattttaaaataattttacacttacataaaagtcacaataatagcacagaggattcccatctaccccttcactcagcttcccttaacattgacatcaccacagtaatacatagaaagtatctaggttcctgcctccctagtctcctccgatctgtcataattcctaagtctttccttgtctttgacacttgatacttttgaagagtaatgatcagttatttaggcaggtgtcttgcctaaatcatgttctttttctgttccacaaggtaaagatgtatttagatgtcctgcttcgttagtctcctccaatctgtgacccaacatgctcccgcccccaagggcaggtttacttctattacttctattttccccaggtgtaaagggttttcaccagagccccaaaggtaatggtcattgttttgtcctttctctgctttcattcagtagaagggaaaaggacgatagggaataagggtcctgccagagtttctttcttttttttttttttttttgagacagagttttcactctcgcccagactgaagtgcagtgacacaatctcggctcactgcaacctccacctcccgggttcaagcgattctcctgcctcagcttcccaagtagctgggattacaggcacccgccaccacacccagctaattttttgtatttattagagacaaggtttcaccacgttggtcaggctggtctcgaactcctgacctcgggtgatccactcacctcagcctcccacagtgctgggatttcagagtttcttactgtatctgcagcagctgctcttctcctagagacaaagaatgctttctcaggaatctcacctgtctttttgggagcacctggtagagtttttggagaaaaagcctacaggtgggtatgaactcccctcatccacagttcccagggtcttcacactttcttgccagcccacatgcagcatccatcaatttggttaactattctagctgaatgcttaccagtgtccagctgtgggtgccccaggtaagcaagtgctgatgtctttccctacatctgtctcttcttagacgtcaagctagccgattgccctataacctcagcaatctgatgggttaaaaaacaaaagtcatgaacttgtcattgtccagatgtttctgtgtttagtcttgcttttaagattagaagccatgctttttctgtacacaattttgtttttattaatgcgtgaatttgtttgctaaaagataacgctatgaaacaaatttaaagtttattgaaaaatcaacttaaaagcagcattccaaaatattctaatataatttttaatcttaaaacttagagttttgactgttgatcactgtcattttttccagctgttgttatatcaagaaaactctcattatttccataacaataaaattcaaaactgaaatgcaataatgcatgtggacataaattatactgagaattcaacctaataaaaaacacataacagctgacaatgatttcttaaaagcatttgcttaaagtttgtcagaatgctgggagaataccaattacgtattcatagtcctcataattttgttttacaaaatattttctcaaatctcttgggagattactatagggttaaaagctgttttaagatcaaagatcaaatagaggggggaaaaaccctgtaattctctactgcagctcattgatctttcccatctgctatgcaaaaaaggagatgcatgttaagtttgaaaaaagaaaatctttttaactaggaatgacagcatactgattctggcaaacgttcagagggaatttttatatatgagatccaactcccttttgccaaaatataaatgatgttaacaataggaaaacaaaatctagtcagtagtctcttatttatatatttcttcctgcaaatatatcgtatgatcagatttctaatataaaacacacatagtaaaataaattttcaaccatcaagagcacaggcttaggggtgaatgataagagacaagtggagtaagacactgaaaaacgaagtcaactcaggaccagaggaactactttcctggtactcttccctcccttgtatcctccagggattgattccaggacaccaaccccctccctggcccccagcacggataccaaaatccatggatgctcaagtcccttctataaaatggcatagtatttgcatataaactatgcatatcctcttgtatactttatatcatccctagaatacgtataacagtggtccccaaccgttttagcaccagggaccagtttcgtggaagacaacttttccacagatgctggggcggggggcggagtggggatggttttgggatgaaaccatcagatcatccaatcatccgatcatcaggcattactttgattctcatactgtgagatctagtgtgcaacctagatccctcacatgcacagttcacaatagggttcacgctcccgtgagaatctaatgccgctgctgatctgacaggagacagggctcaggcaataatgctcgttcacccgccactcactccctactgtgcggcctggttcctgacaggccatgggagtggtaccggtcctcggcccgggctctggggacccctgactatgctatgtaaatagttgttatgctgtattggttttatttgtactatttttattgccacattgttattttcgggggggggggttcccaattttttatttttatttttttaagagacaaggtcttgctatgttgcccaggctggccccaaactcctgggctcaagcaatcctcccatttgagcctccctaggaaatgagactacaggcaaacaccaccacacccagtccaaatattttgaatccaagcctggctgcatccacagatgtgaaaaccatggattcaaaggattcactgtatagtccaacaattcaagtttccgtggactttatgtaaaagcctagaagccttctcatgtatcttcaccttggaaacaataaaaaatacttcccaggaggccaatgacatggcccattttttagaacagaagcagcacattttatctcctgagacaaacgctcataggcacaccaacaattatcacctttggtaaccctcaaagtattttagcatggggcctgtttctttccttagtgtgcctttagcttctctcctctcacagtcactgaattctacacttaaaatgggtgagactgactcttaagaaaaaaaagacagttgtatattctcacactagaagcacaataaatgtgctagaagtactaagtactctggtaggcgggggtgggcggattacttgagcccaggagttgaagaccagcccgtgcaacgtggcgagaccacatctctactaaaaaaacagaaaaattagctgggagtggtggcgtgcccctatagtcccagctaccagggaggatgggatgggaggatcacttaagcttgggaggtcaaggctgcagtgagccatgatcgcaccactgcactccagcctgggtaacagagtgagaccttgtctcaaaaaaaagtgttttagttctttataagtttgatgatatttctatgatcagaagtatgtcataggaacttaactcttgtttatatccattagcctgtggtaaaatcggtttcgttagaagtcattttgcttgaagtttacaacaatctattgatgatgttgagtgaggacttactctacatgagaaataaaaagaagaaaataatcccatcacctagaaagacaaccactattaaaccaatatacacaaaaaatatatagatagagaaaattttatttttcaagacctcagatgccattttggaatctatttttaccacttaatgtgattatttgccccatgtcactaaatatcattaaaaattaacattagcaaaagatacctcccacaaattgagtacttaccgtttgccaagcacgacattagcactttgcagaagttatttcatcctcacaaacagcctgtgaggaagatatcgtcacacccactacactgatatgcaaactacctatcaatatctaatgatattttggatcacaaactaaataatcatgacagtatatttttttaattatgaagtcaaatttataaaagtattttcaggcagaaactagtgatgtaggaactctctctccaaatctagaagtatatatctatgaaaaaaaatatttgggggcataaaaactacgttaaaataaatgtagaaacatgttgaagatcttcgatgtgactaaaaaggaaagcctcattttttactatgatataggagtagcaaagggtaattaaaacaaccagcagcagcactgtgagctttcacagaaagatacaagttcacaaaatccctttcctaatgaccaagctccatggattggggctttcgcatctgtgaccatctttctgaatgtcctggcataccccgtcttttgtattttcctaagaggaagaaatccctctgtgaatggaacaataacctcagtgccatgtgtgtaagactatatatgcctactgcttggttgaaggccactgggaattacacacacctgttagtggggagcaacatggtcctccaatctggttacattacgtagaagtaaattataggtgacccttaatctctgttttgtgcgtccccacttaccctgccgttcgtaagtacacgcacattccagacacatgaagaggagctttttatccaagactttgaaagaaccgactaggagtttacaggaagatctctaatgagtaatagtggtaggtaaaattcacgctgagccagttctttcttggtcgtcatttgtgtacgtttccttactaaagtaccaaaatgtctttgtttcaaggtcatttcacctatggagtaaatgcataatttgtaactacgctgcaaaatttgtggttacactgactccaagttatcttatttcatactgaaaagaaccctgaaatgaaagtaccaccattcactatattgaggaggcaaatttaaaaccaggaagctgatattacctgttactgccaggtcactccttttcggattatcactggagctttcaaatcttcaagagatcagaaagcattccagtggctcaacaaaggcactgaaacaaggacaaaaaatgcctcactgacattttaggggctaatgcctatatttctttctttctttgttttttcccccttgagatagagtctcactctgtcgtccagcctggagtgcagtggcgccatctcagctcaccacaacctccacctcctgggttcaaacggttctcctgcctctgcctcccaagtagccgagaccacaggcacatgccagcatgtccagctaatttttatgtttttagtagagatgaggtttcaccatgctggccaggctggtctgcaactcctggcctcaagtgatcctcccgcctcgggcccccagggtgctgggactacaggcgtgaacttacgcgccccaccttctttctctttactatctttgatgttcatgtatctattcattcagtcaacaagcagaaaatgcctatcatgtgcaaggcactatggaaggcactgaagaatcacacataatagagacacactctcaaggcttttataacttagctgaggaacccaatttattcaccaccatgaactatatcatataataagtgctacaatgtgtaagcgctgtgggagcaccatggaggtgttacttgagtcataccatgaagtaccttttcttcagggaaggaaggaatgatgtgataatccattagaggtatggcacaggcacaaaaacaataaacccttatggaaaagtcttcactaaaagactattgaggccaggcatggtggctcacgcctgtaatcccagcactttgggaggccgaggcaggctgaggtcacgagttcaagaccagcctggccaacccggtgaaaccccgcctctactaaaaatacaaaaatcagctgggcgtggtgacgcacacctgtaatcccagctactcgggaggctgaggcaggaaattgcttgaacctgggaggcagaggtcgcaatgagccaagatcccaccactgcactccaggctgggctataagagcgaaaccccttctcaaaaaaaaataaaataataaaaaaagactactgaaaagagaaaacaaagtaaaagtagttacacagaaaataagaaaatgaaagaatctaatgataaagaaatatactgatgtgaaattggagaccagttggaggttaagtttaaaaatatatatatattttgaacacagtattgaaataggccagaggtttatgaataagtgaagcagacccattaacgcaaacactggtactgcttcctcaaagcttttgtgaaatgaaggaaggcaaaaagggaatggatagatgatcttgggagccagactctggtaagaatctgtgccctgggaaggacggttagttcttccacactgtgcactccacctcagggcatcttatctcccttccagaattcttgcctagcaacttcccttacagtgcaccaggctcccaacttcagattttatgctctactgtatttaaattcttcttatttaaatttaaaaatgtatggtagctcttcctattttggattttgtatattccttccagttgtttttgttttgttttactctcttatgtatttgcattaagtaacattttggttcacatatatacatgcctaagaaattttcctcaacctcctcttaccaatcagtaacactggtttcaccaaggagtaagattctaatgtgttaaaccctatttaatatctttcagtttgatcctcaaactgtacatttctccatctgcaagtacagcgttacattcaccaacttacctaatggaatttgatacatggttggacattactataaattagctgaatctcaatttatttaggaagctctacaatgtaactcctcaaaaggcaacagtctcctatagaatcaatatacatgtaacaccattaagaagcagcctctcagaaaagcgattcagcaattgagattaatgtaatgaaagttattcaggtagataacaatctaattttaaaacacttgaaagaaataagtcctaactcctttcccatacaaatagagatgctagccagtctggggcaagggagggttgggctggtgtagtggcagggaagatgggcacaggaacctaacaccaattttttcacttgtacatttcctaaaagaattttgaaaaaccttgtgctcttctgacattttaggttgacatgttaatttaatgatggcatggatatagtttccagtatggtatatacgtatcttaaatattattgttgcaaccctgcagctgtagatttcactcttttacttaatgaaatatgtccaccaaacaatctaattgttaagcctgttctgtcaaatcaataaatcaaataaaacttactttctgtcaaaaaattcatatttcatttcaaataaaagtgctaatctgccttccctataaaccctccctcaccacccatcaccaccacagacagacaacaatcaacttgattctaaaagaaagaaataaggtatggagtcctgccatgggtttgttacctggaggaaacatctatgattttgaccaaagcagtcatcactttgctatcttcaaattcacacccagaacctaagaattttttttttttttttggagacagagtctcgttctgtcacccaggctagagtgcaggtgcttgatctccgctcactgaaacctccgcctcccaggttcaagcaattttctgcctcagcctcccaagtagttgggattacaggcatgtgccaccacgcctggctaatttttgtatttttggtagagacggggtttcaccatgttggccagactggtctcaaactcctgaccttgtgatccacccgcctcggcctcccaaagtgctgggattacaggcatgagccatcgcgcccagccccagaacctaagaattcttaaatggtccctttagtgggtgaaccagaggatttacactccctgaagcaatcaaatattgtaagatttgtgctgggtcagaagcatgactgactgcctttgtcaagtgggaggaaagcaatttgtgaatggagaggtaggaaggaagactcactctgccacaggtgctctcaggcaaccatattagaaattatcaaatgcagacattgagcatctaaataccattaaaactatttttgcatgcaaaattcctgaaaagtctccatgaatcccgaagtgtatatatacacccactttaaagacaactaatctaaaaaacagctccagagtgcttaactcaacattggaagccaggcacacaaaacgcaaaagctgtcagtcataatgttctaagaatagaagcagaataaagataacaaggcaatgtggtaaaagctttaggatacgcaaatttgacataggggtgcagagcttggattctggaatcagaaagtctggggtttggattccacctgtactacttactagccatgtgactttaaataaatttctttatctccttggggctttgttccctcctctttaagacaggagcactattgatgttgatgatggcagtgatgatgttttaagtatctgtacttcactgaattgttgtgaggattaaatgaaataacacaaggcacttagcacaaaacgtagcatgtagtaaacattcaataaatgctaacacaacattaggagggagagttttacttaataaaatatgtccaccaaacaatctaattgctaagcctgtccttactgtcaaattaataaatcaaataaaaccctctcctgagtgtaaatcactgcccatttttgccagcagtttagactatgagtgaaaagaaggtttttaggaacaccaagccaactcaggcaaaatggagacatattttcaactacaggcctgtcctatgtccctaaaattgccttccatgaatgtaaccccaatcagagtatagtttaaggtagaacataagaatttgtccttcttactattgacccaagggataaacagcactagtaaaattctgcttttttatagatactctcaaatctgtatctgaatttctaaatgcatttaagatgcccggggtctaaaaacatacaacacagttaacaacaaagaaaacgaacttaggagggctgagttagaaaacccctacagctgttaagacagtcttttgcaaaccaagagattaggaatttaatttgtacaagtatggaggggacttccagccacttgtctgagagagcttagtacagataagaaattaatgtgcctgaatgacttagacttaattcttataaacactctcacttctgaaatgggaccggagctttgcctttgagtggacatccaaaaaggaaaaaaaaaacaaaaaaaaaacctgggaataagagaattaacttaaaaactcataaaaagcaaggcattactgtacatctgataagactgaaaaccatatgaatgcataactaatgaatttcccacacaccaagttcatgcaaaatcacacagttaattccatttcatacttttaaaccttcactagaattggttgtttttttaatctttactttcccatctactaaggtaagtcagaagaccctggatgtaaacatatcaattgcctctaaaataaagaccaagtattgaaatagtgaagaggatactgcattgtctcctagtgcttttgaggaagcagagcccaaaatcatggctcattttactactggccaaactgtgaagcagaatatatcactacatgtagcaaataacaagtaagcagagaatcaaagacatcacaatgatatatccataaaaaaagtattatcatatttgtcctaaagacaactctagaaataattctatttatctagtaagaaaaggcatgaccatttactatatataaaaacataatctttcaaagaatgtcaaaaatgaaaccactatattatccaataaattctgtgaccggggagagaaaacctactaatctctaataaatggaacctccacatcagagatattagaggtgctgtttttctaaacccatttaatgtagctctttgagcttgcaacaggatctccatgacaggtttcatttctaaaattcaattaaaacttatctacgatttaaataggtaccatatggggatgaattttaggaacctatgtaacttgaggcatctgatgacactgttaaaaggagttgtctattactgcaggaacacggtaatttagaaatggcatcctaggccgggcgctgtggctcacgcctgtaatcccagcactttgggaggctgaggtgggcagatcacaaggtcgggagatcgacaccatcctggctaacatgatgaaaccccgtctctactaaagatacaaaaaattagccagtcatgctagcacatgcctgtaatcccagctagtcaggaggctgaggcaggagaatcgcttgaacccgggaggcgaaggttgcagtgagccgagatcgtgccactgcactccagcctcggtgacagagccagactccgtctccaaaaaaaaaaaaaaaaaatggcatcctatctaatttaatcacaccataacttagagcaagttttatattttaaactatatagctttcaagtagcaatctcaaatcctataaatgaagactgcattaaaatgttaaatgtattgttataacatttccttcggaaaccagatttaattataggatcatctataatgtcttgcctttatcagaggaattggggaggtaattaagtaagtagagtgtatcactttacatttctggtcccaataactttcggaacactgtgtaacaaaatgtgctatgagaaaagagtacttgtaaaattattaccgtaatacaaataatcaacttcttcaagacagaaaaattcttggctataaaattcagaggaaaattccaaacttatgacaagatgaaaatactgaaatatatttgacatttgaaaacaaaatttccagaagtttctctcacaaatacacgagacagaaactgactgattcagaggccacgcacctgaagttgtctcaccagtcttaaaagattatctcaatacaagaaatgattgtctttccaatatttctttttcagtcttatagtctacagaagtatccacataaggagagctagcaggacacacacaccataaatcacagtaggcaggtcagctctatgcttagtcagttcttcattctacaccttctcccagttagaagcagccccatctcctctggggaattaattgccatgtaatcatcacttggattactgagctctactgtttcacttccagctttttaagagaattgctttcctcccacttttttcaaatagaagaggtgaggagatcaaaatacaacaagcactaatatacccttccccagattcaacatttgttaacaactttccacgtctgcttcctctctacatatgtgtatctgtacgttcttttgctcatccatttgaaaataagttgcatacattttaactcatccctaagacctttggcatatgattcctattaagaataacataatcaaattagccaggcgtggtggcgcatgcctgtaatgccaactactcgggaggctgaggcaggagaattgcttgaacccggaaggcagaggcggcattgagccaagatcgcgccattgcactccagctagggaaacagagcgagactccgtctcaaaaaaaaataataacataatctcttacatgatcacaatacatgatgctgaagccactattctggagaccacgctttgagaaccaacgcacagagactaagataaaactgctgttcaataaatgctcttctcctcatcctctactcttccctttccaaaagtcaactgtcattatcctatgaaaacagaactttgaatatgttatacaatcaatttgttggcagggaatacccatccccaacatatctactgagagactaaataaacaaatggtcaaaggccagatcgtaggtaactacgacccacgacctgcagctacaagcccaggcaaccaacctattatctacaataaccagtctaggaagtcagactggttactgtctagcaactagcccaggaagcccaacaatgcccttaagaatttgtacaaagccacactatctgtgatcatgcctggggaacacagcaagatctcatctcttttttttaaaaaaaaaaaaaaaaaaaaaaaaggacaaaatggccaggaaatgattagtaactgtcagcttccctaatttttgctcctgcttccaatgtaggaccaaccagagaaagccaaaaatgtacccttaactaatcacacaggttgctatgcttttagttggctcacctacagcttcccacaggaacagcctacaaacagggcatacctgaaaccttcccttttttccactctaaagtttaccctgctgggcacagtggctcacacttgtaatcccaacactttgggaagacaaggcaggaagatcacttgagcccaggacttcaagatgagcctgggaaacatagtgagacccagtgtctacaaaaaataaaaataaattagctggacatggtagcacatgcctgtagttccagctactcaggggggactgagatgggagagtcacttgagcctgggaggtcgagactgcaatgagccatgatcacgcccctgcactccacgtggtcaacagagcaagagcctatctccagaaaaaaaataaaataaacaaaagttttcccattcctctgtcttccttgaatctccaccaaattgaatagatggtggtggattcccttactatataaagaaagctctgaataagtagcctttgattgtactcatttgggtagacctcatttatttccacaaccagaataaaatcaattagttatttttgtgatgtttttgctctttaacttagaattccttcttctgagacagtgtgatatggggcaggagggacctgctttggagccaggaagacctgggtttggaaatctgacttctccagcgattaccttatgcaagttctataatctctttgaacgtgagacctgtgtttggaaatctgacttctccagcgattacctgatgcaagttctagaatctctttgaacgcccatttcctcactgatgttctccatgaagggaacaataagcacccactgcttagggctgccctaagaagagaaaataaacacaaaaggacaccgtgcctgacacagagaagtgtcaatgaagtcaggtgctctgactgggctatgttcttcagctttgaaacctttaatcctgtgagtatgaacctgctgacgttaggtgtggaaaggttttttttgtttgtttttaagtaatgttattgggagtatagagccaagtccctcactttagaaactaaaagatgagtgttgcagcttcggcataccgttttgactactgtgacagaaaatgacccaaactagttcatgtaaaatctcatcaacaggccgggcatggtggctcacacctattatcccagcactttgggaggccgaggtgggcagatcacctgaggtcgggagttcgagaccagcctgaccaacatggagcaaccccatctctgctaaaaatacaaaattagccgggcgtggcggcacatgcctgtaatcccagctactcaggaggctgaggcaggagaatggcttgaacgcctccgggaggcggaggttgaggtgagccgacatcgcaccattgcactccagcctgggcaacaaaagcgaaactctatctcaaaaaaaaaaaactcatcaacagaactatagggacatcccagactcccaaagactgagtttcaactgataaataactcaataaatcaggctgctctctcaggaaatgcttgatttgatcacctccgttgttcttctctcaacctgcttcttttgcttactcagctgcacacggccctgaaaaatgcccaccccaagatggcagtgatctataatttcataaagatttgggttacacaggtgtatgcatttgtcggaattcatcgaatggtatacttaagacataggcattccactgcacttaatggatctagtctcatttctgtctccctcactaaactgtgacatctcaaggacaaaaaggaatcatattcgacactgaatcctccacgctggcacaatgcctagcatgtaactgaatctcagtaaatgcgtgattattaaacaaaggaagcaaactgaagaatttgagaaagtctacttattgggatttattctgaaagatgtactacaagttcacattttaattaatgattacattccagtgaattaatataaacgtatttaaattttaatcattatgaagtgaactatatttataagcaaacaattagtgacttaattaaggtgccaactgttcagtgtacatgactctaccaccacctagtgtaaataaatgcatattaccacatttggaaattccctaaagacaaagaatctcccaatggtgggtcacaaactaacatacttcaaccacaaacattcagcaggtgcctgccggtcctggaaattatgccaggctccagaaggacagacacagctcttgtctgtgttgatcactgctgtctcctcagggtttaggagaatggcaaagcactttgctggccttcaataaatatctgttagctgactgacaagattctgggattaaaaggtgactaagttatcttcgggaaagacattcagccattcaaaaccaacagcattttataaacaatgaaatattattctgcactaaaaataaatgagctatcaagctctgaaaagacacggaggaaacttaagtgaatattactaagcgaaagaagccaatgtgaaaaggctacacactatacgattccaactgtatgacatttaggaaaaggcaaaactatagagacagtaaaaggatcagtgatgaccaggagctggggagggaagggatgaatatgtagggcacaggggattcagggggcagggaaattactctatgatatgatgatggtggatacatgtcattacacatatgtcaaaacccataggatttacaacaccaagggtgaacgctaatgtaaactattcactttgggtgataatgtcatgagtagaaggtgatcggttgcaacaaacgtgccattctggcggggggtgtccattgtaggggaggctgtgcatgtgtagaggaagagggtctatgcgaactctctgtgctacgcactcaattttgctatgtagttaaaactactctaaaaagtagttttttttagtcaataaaatttttttactttaactttagatatcaaataagcaaaacccaaatctaacaagtacatcaaaaatatactgtttttttaaatgcctacataaatgctcaataaatgttatttcctcacctccgtagcacaaccgcaactgcttaccccaagtagctgacatgaagtggctgtaaagaagccactgtttcttcatctgtgaaattaagacagcaggactaaatctctcacttcctattctaatttaacattcttttaaattttaaaagaatagatcactaaacctaaacttttctaaaatatagaaaaaggaaggaaactgtcaaatacttacagcatcacacagtgacaccaaaacctgacaacgaacacattaaaaattactgtcaaatctcacttgcgggccaggggcggtggctcacacctgtaattctagcactttgggaggccaagatgggtggatgacttgaggctaggagttcgagaccagcttggccaacatggcagaaccttgtctctcctaaaaatacaaaaattatgggtggtgttgtgcacctgtactaccagctactggggaggctgaggcacgagaatcgtttgaactcgtttgggaggtggaagttgcagtggacagagttcgcacctccagcctgggccacaaaccaagactccgtttcaaaaaagaaacggaaaaaaaagactcatttataaatattggtgcaaaaactttaaaagtaatagcaatgagaactcataaatgcactaaatgaaggataggctataggcacaactgtttactccagtgattccaggagagttcactattaggaactctactcatacaagcaaccatataagtaggtcaaaaaagaaaagttatatgaccatctaagtagatgccaaatagacatgatgaaatttttaaaccgttcctgattttaacgcttagcaaaatagcaatagatgactatttccttaacataatggaaaaatacatttcatatcagtctataactttctaatgttttactggaaacattactgaaacactaaaacaatgacacacacaagcatttctgttgaagtctgggaggaataaagaaagcccaccattgggcttctagattaatattcatctagaagtaccatactagccaatgcaagggaaaaaaaatcttatgtgagttttatttatttaccacacatttttacagtgcttactatatgtcagatactgttctgaacactttacaaatactaaatcatttaattcatataatcgtcataataataaggcagtactattattatctcattttacagagggagagagcaaggcacagagaacataagtagcttgcgcaaagtcacatagctagcaagttagtagaaacaggcttaacacacaagcagtcatagttccagagccggtgcttctcaccactatgctatatgaaacacgatatcggactgaaggaggcggaagtatccatatatgcagatgatatgacacatttgcaaaattcaagggagaaaaaagttgaaacattgttataagtgagaatttagtacagtggtggattacaaaatcacataaaactacgatgcttctatatgtaaacaataaaaacttagaaaatatactataaaaagatgctatttacactactgacaaaaaaggtaaaataactagaaataaaaataagtagatagttcctatttgaataaaaaattacaaccctgctggtttatcagtgaacataaactccaaatttaccaaaagcgaggtattcaaaaggtatgaactgacttaaaatgctcctcaggcacctaagtaaaagccacagggttgaaagcaaaccagccttaaaaaggcccaccgtttcgccacctacctggatcaggtgtatgcaatacacttgagctttgtcagctaacccaattatgcccaatcttttaggccaacccttaacaaatttaataccttctattaccagcccaagagcacggtcatgatacagaaacacttttctgcaaactgttagtaaatctctactacaccttacaacagtccacattttaactactaataaagcactgaagttgggtgaggatctgatggaacaagtggatcttctagtcggctcctattccactttaaggcctaaggttggcagttaatgcccagtcaaatcagattaggtaatacgtgaagaaattgttcacaatgcaaaaaagagaaatcctgaataaacattcagagaagtgtcccctaaaaagtaaggatcattcaactatgaaatgagttaacatgggaaaccaagattctctgtaggaaatagtttaatgggataggtgtgcatccataaagaaactgctatgcattgaggtggggaaaaatgctttaaccgtcaccattagcaccataatcagtcagtcagtcaagcaaccaggcaaccattacttatggagttgctactatgggcacaactctgcagcagtcaaaataaaatgtgaggtatgattccatcaagagaaatatttattatatgcttggagaaacaaacatgaagagaatacaaagcaatacatgaaaagaaatacataaggcaaactaataatgggagaatttctctctgagttcccatatatattacaggaataaaaatctaaggagcaatcaatcagaatagaattttatttcttccaacttttagaagctgaaaagatttggaggactataaaatgtacacaggcaaataatccacggcagtagtaataactgatgagggattattaaaaacacactaaagcctcaaacgtcagcaatgtttatcatcctatttcattaaaacatattcactaattaatttcagtaaccagagttaatttaacaagtcactgtgctaggcttttactgaatgagtcaaaaggaaacacataaaaatactcaaagatttcttatataaagcaacaggactggatgcaagctctaagggcagctgtttaacaatgaaaaaactgggactgaaatcaagtttgtgactgaaaataggcacattgagctctgtagtcacctctatttatagtactgtaataaaagccacatattgggttaaatcaatgtcctcccatcccttagataacccactctacaatacaacaaatttataactgaagatgtagggtgataattcacattaattcagcaaatatttactgagttatgatgctgtgctcagtgcctgaaatgctaaatttaataagacatagacccagcattttttgtttgtttttttaaataaagacacagtcaagtccaagtccctgatctgaaagagctcatgttatagagaatttctcactttgtagggagagaaaaagtattcctttaaaaataaagttccttgaaacagtcctgttttccaatcattaactacctaaccaggaagatagagaattggaaaaccaccacatttgcttataagaactgaatggaatatgaattggaaataaaaatgaaatatctctaaaaccgtcatgctatactggattgaatgtacatcaagaaattgtatttccagtcctacattgagaaattttatttacacaaaatctattacacaaagcaagatataaccagctaatatttcattgagctattaccaaatgttaagaggtttcctagaaagaaatgagttctattaaaagctttagggacactgagcctccaaatgctatagaaaagccagatactatagaaaagccagatactgccttgaggcaaaaatgctagaaagtgatagaatgcgttctttacaatttgcagctaggttattacccatgataaattgataaccattcattaactttgagagcaatagacaactggcaggctatttcatgcctcaaagaatttatggcaaaaatgacaggtgactttgaattctgaaaaggattcttggaaattattactttcatgcattcctttaaataaacttggaggcagatataggtatttgctgctgatatgaattaaaggtcatgattttctacatcaatgataaaagaattaatgtttatcggttgcatcagtctgtcaatcaacaacagatacgtgaatcaggcacttaaagtatatcctgatagctgatatccactctgagtcatagcagggaaaaactatgcaaaaatacatcaataacctatattaaaacagtacaattaagagtaggaattatgtttgcaggttctttgctggccacctccttggtacctaccacaatgttggtaatcccaaaggaatttgtctctggcccaattttcttctcattctccctgtttctaagctgatatatatctaagccttcagctatcacctatctctaccttctccaggaatatctctctcttgagttgctccgattgtcaaccctggcttcacattagcattacctcagtcgattttaagacataccaaactgtgtccctgtgtcatataaattaaatcagtatctctacgaataggaccaaggcatgaatttgttgtttagtttccctaataggcacacaaggtcgagacccactgcttttctagatccatcactccagccatctcctggactggtcagctccacctgaatatctcacaggcacctcaaatttcccatgtaacatacctactcatccaccaacaccaagctaaagcattttctcctctgccctaactgaccccaggagcattaggcagtccttccacctagcttccacagtattctgtctatgcctctgttgaagcatttagcaccatttattataacttatattttccccataagactgtttctttgtcctgctttgttttaatatgcgaagaacccacaaatgagtgggaccagaaggtgagtgatagccaaaatccaaagagaaatcaaatatctataatcaggtctaaggagtcattgcaaggttggaaaactggagacatggctaaggtatcattaagcaggcagacacaagatcaaagttatgaaggaggacacaaggggatgggaatggtgtacccagggcttagctttattaaattccacctagtacaccgaatggaccagactaatccaaatctggctctaggttaaagaaaatggtcctgtaaagtctacttccccaaagaatatcgaatttaagttctcctttgtgctttcacttctacagccttatatggagccttccatctcttgagtagactttttttccttttcttgtatagacttttaaaacagcatcttaattcatgtccatactgatcatctctggccacttcaggctaacactgaccacagagttatatttcagaagaataaatctttcgagaggtgaatgttcaagggtaagaatagagaaaaaataaaaacataaaataaaataataaatcttctccctcatcactcctctattggaaactctcaggtgactcttagaaaataaggtccatgaggtcaggagttccagaccagcctggccaacatggtgaaaccccgtctctattaaaaatacaaaaaattagccagccatgatggcaggcacctgtaatcccagctaatcgggaggctgaggcaggagaatcacttgcacctgggatgcggagggtgcagtgagctgagatcgtgccactgcactccagcctgagcaacagagcgagactctgcctcaaaaaaaaaaaaaaaagaaaagaaaagaaaagaaaagaaaagaaaaagaaaaagaaaagaaggtccaaattctctaccatggcctatacagcctttctcaacttggctgtaaccaatacctccaaccattctcccacataatcaatactacattcacaatcaatattctccatctgttcacaacttagtgcttttatacaagctgtgcgtacagcagaagtacccaatccactgcctacctactatccaaaatttacagatcctgcagaaatagctcaaatgctacctcttcagtaaggctatttataactacaccagaataaatggacatcctcattcactactgattctttccaaaagtttttctggaggccctactatgtgacagtcactagcataaactttcctatagtattttgttcaaacttgagttatgacagttatgatgttatatttaaaacgtatgtgattttatcacctgcatctgtctgttcatttcctgaagataacaagcattattttctggtccaactttcctgtttttctgacttgggtccaagaggggctcaggactccatgttgtgcctaataaagacttccctgatggcaggtcacagctgtgggcacccgagggtcaggctacaaggacagatattaaaataatgactgagcccacatgtagaatataaatagtgagccaagaaagtgaagaaaggtcaaaaggcaaagtattcaggtcttccatctcagatgagaaaaggagagttaaaagtgagaaacaagacaagcagagttggaaaaactgaagactaattctgaagtgatatcatcaacatagctcatctgtgcatgacttgatatactttgctggaacaaggccataaccttcaagtagaaaagtcattcttttttttttttttttttttttttttgagacagagtctcgctctgttgcccaggctggagtgcagtggtgcgatctcggctcactgcaacctccgcctcccaggttcacaccattctcctgcctcagtctcccaagtagctgggactacaggcgcccaccaccgcgcctggctgattttttttttttttttttttttttttgtatttttagtagagacggggtttcattatgttagccaggatggtctggatctcctgacctcgtgatccgcccgcctcagcctcccaaagtgctgggattacaggcgtgagccaccgcgcccggccggaaaagtcattctaaatacagtacattatatccatctttgtaactattctgcagcctaacctagtgccaggaacatgtgatgtgaaaatgtgctgaattaacacttttgcaagtaatgattataacatacacgcatatattctatgtgtattcatctgacccagtaggcaaaacaaagctactggaaatactgaactgtagaataggatgttgatatggttcagctctgtgtccccacccaaatctcatatccaattgtaatccccgtgtgttgaaggaggggcctgatgggggggtgactgaatcatgggggcagacttccccgtgctgttctccttacagagttctcgcaagatattgttgtttgaaaatgtgtagcacgtcccccttcactctctcctgctctgctgttctcgtgatagttctcgcgagatcttgttatttgaaagtgtgtgacacgtcccccttcactctctcctgctctgctgttctcgtgatagagtcctcaagagatcttgttatttgaaagtggctcctgctctgctgttctcatgatagagttctcgcgagatcttatttaaaagtgtgtagcacgtccccattcactctctcctgctctgctgttctcctgacagagttctcgcgagatcttgttacttgagagtttgtggcacgtcccccttcactctcttgttctgctattctcgcaataagagttctcgtgagatcttgttatttgaaagtgcgtggcacgtcccccttcactctctcctgctctgtcatggtaagatttcccttctccttcgcttccagtttcctgagacctcccagccatgcttcctgtacagcctgcggaactgtgagtcaattaaactgcttttcttcataaattacccagtctcaggtagttttttacagcagtgtgagaacagactaatacaggtatcttatctgaaaccagtgacttgaaactactaactcatggcatacagtaaatatcaaaagactaatttattctaccacctataagtcacatacagtattaaagcctggaaccaaaatgtaaaacaatcaggagctttggaaataaactgtcacgtgaactgaagattcttctgtcatttggctgcagaggaaaccattccgccacccaaaaaaaaaaaaaaaaaaaaagccacaaagaaagaagcagggatgaaaaaacacaagataacacacttaggctcttgaagtcattccactttctagtttcattcccttcccaaatcacaagacacacccctacgcttgatttctgtgagataccctgaatccttttaatatattcttctttgcttcagctaacactggtttctatttcctgcaaacaaacaaatttcataccaaccataagtaccacagtgctttacctcgactgcctttattatatccaagaacttcattgtcaaaaacatctattccttttacaactctgatttcacttcttactcctcttctcaattaccaatttattcaaatatctactgagcacctgctctagcacttagtaacagaaagatgaatatgtcatggtctctgcactcaagcacagtctagtccagttttttcaagctgtggatcttgatcaatttgtaaaatcaatttacttgtcctgagaggaactttttaatatttgaaatataagaaaattaaaatactgcatcacaagaaattaaatattattttctacagcttttgtttcagttacatgtgtgtttttactgaatagcaatatagtatgtatatctcactgtgggtcatgaacaaaggatttgaaaaataccagtaggcccctatttcctaataatgtgaacaaatgccaaggaagaagtcagtcaaaagctgtgccttagaaaatcctttagtgttttaataaaaaataatttcaattggtgttttcctagtttatgttgatttcataagtacttgaaaacagttgttggtttgcctcaagtagattaaacattccgtcttgtttatagttttaattagctaaacaaatccttttctctttgccttgaacattacaaagaaacttcaattcagcatgtcagaattattataaactcctaattagctaagtacaaatttagtacatttttaccacacttacaatgaatgctgtctgggctaaataaaccccaatcatcataagagtatctatcagctacaaggctacaagccatgacaagttagcctgaagaaaagaccatgaggcagaagacagctgtgctcaaatattattaaaggcataaaatgactctaaattgtttaaggtaacttctgaaaaatgtaagttaaagagaatgtagcaatacatcaaataagcgttgggcatcttgtaggatttcttgtattaataatctgattttgtttcaaggaaaattaattcaagcatgtttattctctagtttaaaggctgtccatctttatcagatagtggaaattatctgaaattagtggaaattagtgggaaaaaaagtggaaattagtcaacaagaatatttcctaaatacctagtacatgtagctccaggtattatgcagaacactacatatttctggaaaagtcataaaatacttccaaattatatacatgttattatgttaaaatccatagtaaaaacttagaacaattttagtgccaaaaataatcacatcataaacatgtttctatagaaaaatagaaatcatataaagcacagcaatctatttccatgtgttttcaaaaacatatacttgctacttatctatttgttttgctagagagaattaggtaactaaaggctaagaaaaaatatgtaaaaaaaaaattaaaattgagggggctgaggcaggagaatggcatgaacccgggaggctgagcttgcagtgagccaagattgcgccactgcactccagcctgggcaacagaactggactctgtctcaaaaaaaaaaaaaaaaaaattaaaattgagaaaatgtattcgcaaactttgttttctcagacacaggaaaagtaccactattagctggttttcacagagccacacacttttggcatacctgtgttcacgtattcattctcatttattctaaattaattgattgtctgcctaattctagagacataaagatgaaggtactcacagtttagaaaaggaacaaacgtataaaccaaatgtaatttaatttgcaaagtgcaacacagagtagagtacctaatccaggctagtgtggtagggagggcaaggaaggcttccacaaaagaggtgaaatctaaaacaaaggataggaggcatccaggtgaaggtttggtttctgaacacttttacgtgtgtggaggtgtggaaagcctagcattgtgagtacgggcatggcaagaagaattcgcctgctgggtacagtgcatcctcccgcggggcctgctgggtacagtgcatcctcccgcggggcctgctgggtacagtgcatcctcccgcggggcctgctgggtacagtgcatcctctcgcggggcctgctgggtatagtgaattctcccgtggatgctgcaggaccccatgcctagaggtctggagaactgtgctccacagtgatcagcggtacccccatccttggacctgcctctcccacgactccatgggggcctggcctcaagtcataggcccccgactgtgccactgtgtccactggtaattgtacacctgagcaatggaagggtcacacagaccccaccacccacaaaactgcatgtcagatcaccccatctctgggcgcatcccttgaccccgaggctcggagggcagaagaatcaccatcaggccatctggtatagctgaaacaaactcagcctggagctgagagaagggtcagaactggagggctacacaaacacactaaggattttggattttatgttgtaagaaatcaggattcagagaaatcttagatagctcactctatgagctaacaaaaaacagattagtaaataagaaatgagaattaagaaacattttaggtcgaaatgagatacatactatacaatttgctggtaaacaaagcaacaaaatacattttaattgagtagaaaaaaagaaagaaaaaaatggtaggggacagcaaaatcacatctaagaggctgtggcagggatgacatccaggtgagaaactgggggcctgaactgtgtagtaggcatggaaaggagaatgcaagaaaaacttggtgatataggaaggaaaatgaaatgaacttgctgaatgactgcaatgagattgagaaaaggaaaaagtcaaggagtggttcaagatgaggcagggagggacacataggcatgctaacaatctgaagccctgaaccgagaacagtagctaggagggtaggaggggaacaagaatgaataccaggtgacgaatcaggagactaagatagaaatttaggcaagaggttatggtatgatggtttcaactaggatgatgatagcagagatacagggatatatgtatatttgagaaacattctactgctgaaatcaacaggattgcagttattaggctaacaggtcagggagagggagagaggatgtcacaaggacaaaacagtggggtactagttactgaaataaggaaggtaggagagaagcaaatttaagaatgaagattgagaatactgttttaaacatgtggaatttccagctcctctgagatatctaagttgaaatatcaactagacagttaaatacaagagtgtggggccaggcacggtggctcacgcctgtaatcccaacactttgggaggccgaggcgggcggatcacgaggtcaggagatggagaccatcgtggctaacacggtgaaaccccatctctactaaaaatacaaaaaaaaaaaaaaaaaaaaaaacattagctgggtgttgtggcgggcgcctgtagtcccagctactcgggaagctgaggcaggagaatggcgtgaacccaggaggcggagtttgcagtgagccgagatcgcaccactgcactccagcctgggagacggcgagaccccgtctcaaaaaaaaaaaaaaaaaaaaaagagtgtggaattaaaagaaaggtctgtttagactgaaatataatttcaagaataacaattatataagtaattgcaactctgtaagacaacagaggaggcatatggacggaaaagatggcccagaaacaggtctaaaatctacactttagatgccaggcgaggatgagcctgcaaaggaagctggagtctctgtttattaacaaaggttttgagaaatttggttatgaagaagagatggtacagtagccttaagaagtgtaaggcaaacggagagggtgctctttgttttctttttgaggaaagacaatatagcatgtttaagagctgatgggaatgtgtcagtagagagagaaaaaggtttaaagatacacaagaaaaggcctggtgcagtggctcactcctgtagacccagcactttgggaggccgaggtgggcaaatcacttgagctcaggagttcaagaccaacctaggcaccatggcaaaaccccatctctactaaaaatttaaaaacttagccaggagtggtggcatgtgcctatgatcccagctactcgggaggctgaggtgggaggctcacttcagcccaggaggcggaggttgcagtgagccatgactgctccactgcactccagcctgggtgacagagacagaccctgtctcaaaaaaaggtatacaagaaagacagaaaatattcaatagcataagtttccaagaaggccaaaatacacgggatccaggacccatgtgaagggtttagcccctcctctccacgatggtgtctaggtaaactgtttgtgtgtctgtaggacagtggttgaggaaacactcttggagccacacagcatcctctaaattctcagttttctggctcactgtgttaagattagtctggacttatcaataaattgttagccactaaagtacaactggttctgtgtagtctttttttcccccatggatctgttaatgtttatttattagtactagcatcttcctttgttctctgtgttaaagcaaagaaagaagagggttttgtcatataatctgattttagcttgacttgggaaacttgagattgtcatttaatatatcttcttgctttaagaaataaattccttgtgtttacaattaattgatcacaaccagctatggatttctttgttccttcgccactcccactgctttacttgacaagaaaaaaagaaacaaagaaattccttgaaaatgaggaatacaaactgcagggataaaatataaatcaaacaaaagcatctcagctaaacctctttttttgttttccagatgctactatccttcaagatggtaattaataaaagagagaaaaatgcctaaacaccaactgatgttttcttgtcaaatctgtttcatcagacccaagggatatggcaggagatggtattctacaaaataattcggattctctttctaaagacttgaattgtttcaggaaaaataaacgaattcacaaatcagtaataatgcacttgtaggactaactatgagctgccatcactctgtaaatgaataaaacatagcggcatctacttctaaaactagtgccaaatacaccactaataactcctcgatgatgcagggaatcagtgctggtaattaacataaattaatgaaggaagttgaaaagttcagaagaagtattaaaagaacacctatcggggcggggcacggtggctcatgcctgtaatcccaacactttgggaggctgaggcaggaattgcttgtgcccaggagtaccagaccagcaccagcctggggaatatagtgagaccatatgtctacaaaaaaattaaaaatcatctggattattaaaaaataaataaataaaaaacagatgctggtaaggctgtggagaaaagagaacacttaaacacttgttttttgtttttcatttttttgaaacagagtctcactttgttgcccaagctggagtgcagtggcacaatctcagctcactgcaaccttgcctcctgggttcaagcaattctcgtgcgcctgcctactgagtagctgggattacaggcaagcaccacaacacctggctaatttttgtatttttagtagagatggggttttgccactttagccaggttggtctcaaactcctggcctcgtgtgatccacctgccttggcctcccaaagtgctgggattagaggcgtgagccactgctcctggccacttatacactgttggtgggaatgtaaattagttcaaccattgtggaaaacagtgtggtgattcctcaaagacctaaaaacagaactatcatttgaccagcaatcccattacttggtatatgcccaagagaatataaatcattctaacctaaagacacatgcacatgtatatttactgcagcactattcacaatagcaaaagctgaaatgcccatcaatggtagaatgcataaagaaaatgtacctatacaccatggaatactatgcatgcggccataaaaagaacaaaatcatgtcctcagcaggaacatggatggagctggaggccatcatccttagcaaactaacacaggaaaagaaaaccaaatactgcaggttcttgcttaaagggggagctaaatgatgagaacacatggacacataaagagggacaacagacactggggcctccttgagggtggaggttggaaggagggagaggatcaggaaatataactgttggatactagacttaatatgtggatgacaaaataatctatacaacaaacccacatcacatgagtttacctatataaaaaacctgcacacgtatccctgaacctaaaataaaaattttaaaactaaaaatgagctgggcatggtggcacatgcctatagccccagctactcaggaggctgatgggggaggatcacttgagcccgggaaatcaaggctccagtgagccatgatcatgccactgcactccagcctgggcaacagagtgaggccctgtctcaaaaagaataataatttttaaaattttttttttaaaaatgctgggcgcagtggctcacgcctgtaatcccagcactttgggaggccaaggcaggtggatcacttgaggtcaggagttcaaaatcagtctggccatcatggcaaaacctcatctctactaaaaagacaaaaaaattagccgggaatgggggcgtgtgcctgtaatcgcagctacttaggaggctgaggtaggagaatcacttgagcccaggaggtggaggttggagtgggctgagatcacatcactgcactccagccttggcgacagagtgagactccatctcaaaaaaaataaataaataaaatttaaaaataaaatacacttaccaataaaacaatggcaagttgctgtgactctattacttaggacaggagagacacatcatttgacagaattagatttcacatactttaggatgctacctgttttgcttgaactacccaacataaatataagggaaataataaaaatataagagcagaaataaatgaaatggaggctagaaaaacaatacaaaagatcaatgaaacaaagagctggttttttaaaaaacacaaaattgacaaacctttagctagacaaaaagagggaagactcgaataaagaaaatcagagatggaaaaggagctattacaatggaaatactaaggatcgtaatattatgaacaactataggtcaaccaactcaataacataaaaaaagagataaattcctaacacatacaatccaagataaaagtctcccatcaaagcaaagcccaggacctgacagcttcactgctgaactctaaaaagcaattaaagaactagtactaattcttctcaaactattccaaaaaatggaagaggagggaatacttccaaactcattcaaaaaagccagcattattctgacagcaaaaccagacagacacaataaaagaagaaaattacagacaaatatccctgattaacatagaggcaaaaatcctcaacaaaatatttgtaaaccaaattcagcagcacatcaaaaagagcactcaccagtacttgcagaggccaaggtgggcagatcgcttgagcccaggagttcacgaccagcctgggcaacatggcgaaaccccgtttctactaaaattacaaaaattaggcgggcgtggtggcacatgcctgtagtcccaactactcagaaggctgggttgggaggatcacttaagcccaggaggtggaagttgcagtgagccatgatctcaccactgcactccagcctgggcaacagaacaagactctgtcttaaaaaaaaaaaaaaaagataattcaccatgatggagtgggattcatcccagggacgcaaagatggtttaacataagtaaatcagtaaacatgatacatcacattaacagaatgaaaaacaaaaaatatatgatcatttctatagatgcagaaaaaggcatttgacaaaattcaatatgcctttttaaaaacatttacagttcagacatggtagctcacatctgtaatcccagaactctgggaggttgaggcgggcaaatcgcttgggctcaggagttcaagaccagcctgggcaacatggtgaaaccccatctccacaaaatatacaaaaattagccaggtatggtggcacatgcctgtaatcccagctacttgacaggctgaggcaggagaatcacttgaacccaggaggcagaggttgcagtgggccaagatcacaccactgcactccagcctgggtgacagagtgagactctgtctccaaaaaaaggaaaaaaaattaataacaataataataacaaataaaaattaacagggctgggtgtggtggctcatgtctgtaattcaacattttgggaggctgaggtggaagggttgcttggggtcaggagtttaagaccagactagacaacaaagcaagacattaccactggaaaaactttaaaaattagccgggcatggtggtacatgcctggagtcctaggtacttaggaggctaaggcaggaggatcacctaagccaaggagttggaggctacagtgaactatgatcataccactgtactccagcctggccaacaagactgtgccttcagtcattaagcctctgtacatggtagccttttcacgctaaacccaggctactgcctacccactggcccattcagtacctccacattccatcactagagcaaaagagaacttctggatccccagcatgacaagcacatgccatgaagaactcagagttgccatatgtggccagtctccttggccactcactggagaggcctctctgctgttagccacctgctttccacaatcactctcatctatctgacacacctcccaaacagaggaggtctcaccaacgacttcttcaatcttggtcttcttccattccacaattccccttggccgaaaaaggcccaaacttattataaatcttactacctagcagtcaaggcatggtgttaatatgtcaacaaaagctaaagggattttttaaatggctgaaaccaggctgagaaggcaaagtacaacataagcctggaacattttgttggactggaacattttgtcattccagagagtaagaaagtgttcctaaaaattatggaggtagatcaaatacagaagccagcttgaaggggctcccatgagtcaaatcagtgacaatttcagcatcaaaataaataagaacaataatggaacaaataggaaccaatggaacaaataggaacccatgagtccatactaataataaatagatacataaataaatagaggagaaggtaaggctcctccttagaagaaaataaagacataaatgtggagggaaccataaataatgattcaggtaagaaccaatcaataatagatgttaactctatggaggaaaaaaaactgacgaggaatagacatttgcatggtctcaaagtgtctccccacagactggctcattagttacaaggggaaaaacagtaactactcacccaaggctgtatcttaaccaagtgattaaaacttcaccaactaggagcagatggacattgtgtgcttcctggtgtgatatcctcagaacaacacagtatcacacatacactacataaatactgtcttatgtaatactctggctggggttgaaaaattcaagtctaatcatgagaaaacatcagacaaatctaattcggtttttttattctataaaataactgacttgcattcttcaaaaatattaatatcataaaagatgagaaaaggctgaggaactactccagattaatggagactaaagagacatgacaactacatgtattaatatataatccagctggacacagtggctcatgcctgtaatcccagcactttgggaggtcgaggcgggaggatcacctgaggtcaggagttcgagactagcctggtcatcatggcaaaaccctgtctctgctaaaaatacaaaaaataattagctgggtgtagtggcacacacgtgtaatcccagctactcaggaggccgaggcaggagaatcgcttgaacgtggaaggcggaggttgcagtgcccaagatcacaccactgcattccagcctaggagacagagcaagaatctgtctaaaaataaaaaaaaattaaaaaaaaaaatatatatatatataatatatacacatacatacactatatatacacactatatatatacacacacactatacattgtgtatatatacacacactatatatatacacactatatatatagtgtatgtatgtgtatatatacagtgcatatgtgtgtatatatatagtgcatatgtatgtgcatatatatatacatacacacaaaaaaaatcctacactggatcttggactaaaggaaaaaaatgcaacaaaggacattattgcaacatcgacaaaattggaaaaatgaactagagatcaaaagtactgtgtgaatgttaagtattttggatttgactaagtgtagaatggttatataagagaatatccttgttcttaggaaatgtacactaaagtggtaaggaaagagacattaggtatgcagcctaccctcaaatagttaagaaaaataaataatatttatgtatgtgtgttgtgtgtggggggtggtgtgtatagagaggaaataaataaatatgataaagccaatagagcaaatgttaaaatttgtttacttagataaaaggcatgtaagggttgtctgtactattcttccaacttttctgtaattttaaaattattccaaaataaagctttttaaaagcagtttgaccaattttaaaagatgttttaatttttttaatttttatttatttttttagagatggggtcttgctgtcccccaggctgaagtgcggctgtatgatcatggctcactgcagcctccaactcctgggctcaagtgatcctcctgcctaagcctcctaagtagcagggactacaggcacatgccactactcccagttaattctgtttttttgtagagacagggtcttgccatgttgcccagcctggtctcaaaatcctggcctcaactgattccccatccttggcctcccaaagtgctgggattacaggtgtgagccaccatgcctggccccatattttaaaataagactgcattaacctgtcatctttaatttcaaccatataagcaaggtaacaaaataaactttccagtgaagaagatctaaaaattaatgtgatataaagcatagataaacattttatgagaggattaaaacttcaactagcacagcaattatgcactggcgctctgcttactgttccactcggatttcattttgggctcatcagggatcccctgagtaagattaaaacactttatatcttatctataaatagatcattacatttgcatagaaagaagtttgataaaaatgtagaaagactacttcttaagttaactaggctaaaaactatgcaggtaccaaatttggctcctaatctcagtggcttttaaaagctaattagcaggaagcacaacccaaatatagaaagtgaagacaatcagtccaatcttggggaacaaaaacctaaagtaggtgttacttgtgatgtattatgctctgaataagtccattaaaagcatgtaagcattcaaccaaaatatttgattttaatttttcaatgattccagatgttctttaagttgaaaaaaaacaaaaaaaaggaaaaatgaaaaccaaaggttaaataggcaacactccagcacaagccacaaggggcctcagaaaaacacacacaccacactcctacaaatccacccgcctagcacccatacagaacgtgccataggtaattatgatcatcagaggcttttgatcttgtggaagaagaaaaaaaagaaaacagaaaagtgacaggcagccctttttgcaatttaatgagtggaatatgcttctacaatagctggaagcaccttttactatgttgttttttgttgtcattgtttttcgctatacctgctagattagaattttattttgtttttaaatttttaatcaaagcaatatataccatatggttaaaatggcaaataggctgggcatagtggctcatgactgtagccccagcactttgggaggccaagacgggcagatcagttgggcacaggagtttgagaccagcctaggcaacagagtgagaccctgtccctacaaaaaacagaaaaacttagctgggcatgctggcatgcgcctgtagtcccagctactggggaggctgataggggaggatcgcttaatctcgggaggtcaaggctaccccgagccatgatcacactactgcactccagcctgggtgacagagcaagatcctgtctccaaaaaaaagtcaaacagaaaaaacaaaaagcttccttctcctgctccccaaggcaatcatatctaactatttcatttcagggagtctcccgcagttactctcaaatttcttttttttttttttttttttttgagacagagtctcactctgtcactgaagctggactgcagtggagcaatctcagctcactgcaacctgtgcctcccgggttcaagtgattctcctgctcagcctcccaagtagctgggattacaggcacatgccaccacacccagctgatttttgtatttttagtagagactgggtttcaccatgttggccaggctagtcttgaactcctgacctcaggtgatccacctgcctcggcctcccaaagtgctgggattacaggcatgagtcactgcacccggcctaatgaatctttttcattccctcatttggtaggtatcttaatgttttagtttatctttttacatggcttaggttctggcaatacgagaaactattaagttaactggttctacatcttggagataaatagcacttcagcagtttgagttcagaatatatttagagtaaacctgatttattatgttattattcattttatgttatatattttgaaattcaaaaaaaatgccttgattccttattacttttgctaagtattctgctcatctcagagaagaaagtgtttttggactagctctgtaaattaccactctaggcttgtttcagaaccatttttctaaaaacattattttataaggtcagttgcttctagctaggaatattactgattttctaataggccttgttgggtttcaaaaacactttttaatgtgctaaaattgccccccaccaccatagcagacagacaactacccagctatgcactggtgatctaaaagccatttatgacatattgttattattatgacttactgttattacagtataagagaagaggcggaacacatatgcctcaatcccttcagagtttgttttttggggcgagggggtaccactcctccatgacttaagttttaaagaggtatgctctgcccctcaggggaaagcctgcaggtgtacttgtccagcattcccatgagaccaaatgaggtttgtctttgttgccaaattttgcagcagccgattgttgccatctacccaagccacttttcaaatgctccatcactaataaagctgaaattgtaattttcaaaagataacaaaaaaatctgctaggccatttaaattcaccatacataatacctaccaaaagttattaacaatttatttttaatctaatcctataacatgcttactaatagttaacatctaaataaattaattggaacaggattcaaaatgttctaattctacatcggagtgttttcagcttttacctaaactttgaagtctgtagtcttatccctcacagataagacaggcattcagttttaaacagttcttatagaaatttagaagtgggccgggcgcggtggctcatgcctttaatgcaagcactttgcggggccaaggcgggtggatcatgagatcaggagatcgagaccatcctggctaacacggtgaaatcctgtctctaccaaaaatacaaaaaattagctgggcgtggtggcacgtgcctatagtcccagctactcaggaggctgaggcaggagaatcgcttgaacccgggaggcagaagttgcagtgggccaagattgagccactgcactccaacctggacaacagggcaagactcccctctcaaaaaaaaaaaaaaaaaaaaaagaaatgcaggagtaatgaggtttcactacttgtttttaaactgacactaaacaattattaacatcaaataaattctatgtatagaaatacaaaatataaggattgagtttttaatctctactatatataaaataggactctaacaattactgcagaggtcagcaactccaaggtttatggaaggaaaaggggagacaggagacagagggcgtggtattgtctgcaggtcattctctggctttctttccagtatctccctttctccttccctcccactttccaagaagttgctactgtatgaggaaattctgtcaagtagcaggaaggggaaggctttgagccttgtagctaggactggtaagaactaagaaaattggtcctatctgtgctatcagattaaggagggtgtcgcctctggtacttttggcaaagatggtcaaatccccaactacaacctcacagtgatttgtggcgcattaaaaagtttgtacttggtcgggcgcggtggctcacatctgtaatcccagcactttgagatgctgaggtaggtggatcacctgtggccaggagttcgtgaccaccctgaccaacatggcaaaaccccatccctatcaaacccctgtcgactaaaacacaaaaaattagccaggcatggtggcaggcgcctgtaatcccagctacttgggagactgagggagaactgcttgaacccggaagaggaggttgcagtgagccgagagcccaccactgcattccagcctgggcaacacagcgagagactgtctcagaaaaaaaaaaaaaaaaaagtttgtactttttggccggcagccatggctcacacctgtaatcacagcactttgggaggctgaggtaggtggatcatttgaggtcgggaattcgagaccagcctggccaacatggtgaaacaccacctctactaaaaatacaaaaaaaaatagccgggcatgatggcgcgtgcctgtagtcccagctactcgggaaactgaggcaagaggatcgcttgaaccagggaggcagaggttgcattgagtcgagatcacaccactgcactccagcctgagcgacagagcaagactctgtctcattgtattgcccagagtggagaccagtggcacaatctcggctcactgcaacctccacctcctaggctcaagcaatcctcccgcctcagcctcccgagtagctgagactacaggcatgcaccaacacaccaggctaatttttcatatttttggtagagacagggtttcaccattagctcaggctgatctcaaactcctgagctcaagcaattcacccaccctggccaccaaaagtgctagtattacaggcgtgagccaccacgtccagccaagtttttactttgaagcaatagctaaaatagattttattcacactcaaagcaaaggttataagctatctagattttgttattctatgacaggtaatatagaaatacagttcagaaagataatgacagtatatgatcctaaagctatttttctttcactttaccaacaaattgtaatgttcattctaatgaatatggacattttattctataattacacatcaaagtatacagtgtactctatattttaaaaatatctaggtaattctaatggagtacttcctacgaactcctctaaacattgcaaacgtaccatcatcgtcactgttttacagttaaggaaactgagatgcagaggttaaattacttgcccaatgtcacaaagttagtaagtctcagattcaggatttaaactggctccacgggccagtccaatccacgcctctatgcctctcgggctttaataggcatgcacatcacctggagatcttgttaaaatgtagattctgagttaagttggtctaagactgggcctgagattttacatttccaaaatcatttagttacactgatgctgctggtccacagactgtattttaagtaacaagactgtaaaccactttgccctgctacccaactaagcatcaagaaaggggtgatatttaactcagatcctaacaatctaagcaaagaggcaattatatctgcaattcaaatacagaaccaaggggctgctttcaacctatatgaagactttcaatttacaataaaattcaagacccaactaaaaagaacttgatttgttcaatgtccttatttttctagtctaaggacaaaagcctatttcttcctgtccccatacaaacacagagaagaaaacaactttttcttttttgcagacaagcttttccagttggcatttgactaaaaattacatgtaaaaacaaatacatcaagtaagacacaaaactcttgactattcaattatcaaatacgtcacaaaaacctgtaaaagacagcttgtctctggaacactctagctcagcaactttttaaaggagggattagagaaagaaattgttccaactagtcatgcttctctattgaaaacaacatgattcagacctgacatttaaagacatctctgatgtgaattgaaaccaattttcttctttcaatctagaccaaaattaaaatgtttaattcctattaaacttaaacctcatttctctttctcaaattcaagctatttctaaaaactttcttgcacactcccttttaaggactattcagagttttctttgtgtatgcatcctattttcccaccttataagatacttagataaatataatcaatgaatttgttaggttttaaaattaacatttagtcttactgatacctaattactataatagctttctccaacgggtaccatgatgtcagaaaaaaacacacatacatactaaaatcatctcttaacacgactatattctaacactgtttttgaaaacctagagaaactacctgagacaagtttagaagggaaatatcatttatagcacacctacctgaaagtaggtgcaggctttgcaattaggcagacctgggtttacattcacctttagtgactgtgtgacctacgggcagatttatctaaacttactatgtcatagttctttgttttacatgtagtaaattcaattacatagttacagcaatagatattatagaaccatttttataaaagggaaaattaaagctcatggaatttacacaacttattgaatcacctagtaactggaaaaatcagaatttgagtccagctctatcagactccaatgcccagggcttctcctgtgagccatatacggcctgtggagttactgactgcttaactgaggtaacaagtatttcccacactctcagaatgaatctgtaatttaaagaagcctataactctactgcagcacaaaagccacctgcgtctacactactggtactaagacaaccaactattaaatatcaactagctaggaaataaacataaaagtcagtctcagctaacccaagaaatattaatacatatgtagataagggcaaagatgactgagagaatttgcttctaaggtcctcccagtcttcatactaacaaacatctgttgaggacctactgagaacatatgtggctaggtacccagttacattttacctaacattatgacacgatcaagactaaagaccaaaacaatttaaaaaaattaactaacctaacctaaaccacaataagagtttctacaactgatgctttaaatgataggagatttcactgcatctttggacagtcacctaaaagtagaagtaaatactaaggatactctgtgtaacagagtcaggaggtgagaaagcactggtctatgcacacataagtgctcatatatgcacacctgtcctctgtcctggagctggtacataagtgctcatatatgcacacctgtcctctgtcctggagctggtacataagtgctcatatatgcacacctgtcctctgtcctggagctggtacataggtgctcatatatgcacacctgtcctctgtcctggagctggtacataagtgctcatatatgcacacctgtcctctgtcctggagctggtacataagtgctcatatatgcacacctgtcctctgtcctggagctggtacgtaagtgctcatatatgtacatctgtcctccgtcctggagctggtacgtaagtgctcatatatgcacacctgtcctccgtcctggagctggtacgtaagtgctcatatatgcacacctgtcctccatctggagctggtacgtaagtgctcatatatgtacacctgtcctccgtcctggagctggtacataagtgctcatatatgcacacctgtcctccgtcctggagctggtacataagtgctcatatatgcacacctgtcctccgtcctggagctggtacataagtgctcgtatatgtacacctgtcctccgtcctggagctggtacataagtgctcatatatgcacacctgtcctctgtcctggagctgatacataagtgctcatatatgtacacctgtcctctgtcctggagctgatacataagtgctcatatatgcacacctgtcctctgtcctggagctggtacataagtgctcatatatgtacacctgtcctctgtcctggagctggtacacaagtgctcatatatgtaaacctgtcctctgtcccggagctagtgcattaagtgctcatatagttacacctgtcctctgtcctggagctggtacaagatcatggttcatactccaggaatgagggctagaagacctggttccagatccagctctgtcactcacagctgtgtgacctgggtcaagtaacctctttaagcctcagtcactttaactgccaaatgagtataaaaatagcacttaatttacgaggttgttcatttaatacacttttgttgagattacatcttgccactggcatcctgctaggcattgtggattaggtgttaaaatgcacgtgatgtgtttggcatgtgtcaaaaagcgggatttttttttttttttttttttttgagacagggtcttgctctgccacccacgctggagtgcagtggcgcaatctcagctcattgcaacctctgcctcctagactcaagtgatcctcccacctcagcctcccaagtagctggaactacaggtgtgtgccaccacactcagctagtttttaaaatttttgtagagccaaggtctcaatatattgcccaggctggtcgtgaactcctgggctcaagcaatcctcccacctcagcctcccaaaatgctaggattacaggcttgagtcacggcacccagcccagagcagggatttttgtctgttgtggttctctgctgtatcttcagtaccaacaacagtggctggcacgtaaagtctcacattaaatatctgctgtatcttcagtaccaacaacagtggcatgtaaagtctcacattaaatatcgcaacaaatactgaaaaaattgtttagcatcaggtgggtcagaaactactcccccgacccttgtttggattcagcctgtgtatttttaggtatcactaaaagaagttcaaggatctttttttaatttctttttagtttttataacagcttcatagagctataatttgcaaacaataaaagtaacccacttaaagtgtacaatgcaaccattttacattcacagagttgtgtctgccttgttttaaagacagggtctcacaccatgttgaccatcctggcctcaagtgatcctcctgccttggcctcccaaagcgttgggattacaggagtgagccaacacacccaggctctttcattttaaaaagagaagtcgggctcctgagactccatgtgtgagtttctgtcacacgtatttaaagtacttttaattgaacattttctgtaacaaaacactaaaacatacaaagaagtaaagcataatgcactctcatgtactcatcaaccaatttccataattatcaacttttttttactatattaaaatgtttcaaataccttagaaggttagattaacaaacacctctctattcagacacatctagttcctattccgagagaaaggggaaaagatataactacattatctgacacaacggtggctcttacgtctgctcccttacaaaatgtcactgtacagcaaaaataatttttaccagcaatgagtatccatagaaaacatagtaatcaatcccccattcccttccactatgctattttgggtccttctgacaaaatgaaagtaaatctcaatgcaattatccaagttaccttttttcaaaagatcttttttttttcttttttgagacagagtcttgctctgtcacccaggctgaatggagtacagtggtgcaatctcggctcactgcaacctcagcctcccaggttcaagcgattctcctgcctcagcctctcaagcagctgggattacaggcgtgtgccaccacacccagctaattttttgtatttttagtagagacagggtatcacaatattggccaggctgatctcaaactcctggcctcaagtgatccgtccaccttggcttcccaaagtgctgggattacagccactgtgcccatccaaaagatctctttagatctcaagttctataataactaacagagaaagagcaatacacatagactatagatgtaattaatctgttccaaataccttcaatatgccatcttccttctgcagatctgtaatggttgatttcacatgtaaacatgactgggccacaagatgcccagatatgtggttaaacattattttttggtgtgtctatgagggtttttctggaaaaaaaaatagcatttgaattggtgaactgaggaaagcagattgcccttttaaatgttagtagatatcatccaacctgtgagggcccaattagaacaaaagaatggagaaagggtgaattctctctctctctctctgattacttgagctgagacatcagtcttctcttgctcttggactgagacctaaaccatcaatcctcctggttctcaggccattggactccactttcctgggtctctaacttgcagagaacggatcatgggacttctcaggctccatatatatatatatacacatacatatatacatacatacatacacatattcatatatgatcatatatataattatatatataaactcatatatgagtatatatgatcatatatgattatatatatatgaactgatatgagtatatatatgatcatatatgattatgtgtatccatagaagatatatatatatagagagagagagatcgatcgatcgatcaatactctactggtttctctggagaaccttaatacaggggttcaaaaaaattccataacttctggctgggtgtaatggctcacacttgcaatcccagcactttgggaggccaaagcaggaggatcactcgagtcctggagttcaagaccagcctgggcaacataatgagaccctttctctactaaaaataaacaaaattagccaggaatggtggtgtacacctgtagtcccagctactgggaaggctaaggtaggagggtcatttaagcccaggaggtcaagcctgcagtgagccatgatcatgccactgtacaccagcctgggcaacagagcgagaccctgtctcagaagcaaaaaaaaattccgtaacttctaacatcaaagtgatcctcagtttgccatgagaggtaaaatggtgggtcagcccagggcatataatctttacactaatggttatcacctaagggcaacatgcagaaagccacagcagtgctccttagtgataggatcctcaatgttatagatacatcctcaatgttacagatggtggtacttcttacccccatataaattgatttatcatgtgtctacatctatcacatacataagcatcatgtggcacaaagtggtattaccccagattttttttttccacagttacaatggttgacgaaagccactctgtcgcctttcctggcctacgtcagggccaagttcaaaccctctccctaactgcagattagcagtcatggtgggctctccacagctctcactcagaggtgccagtacacctccctgcacatacagcgggataaacagctaggcaatctcagtcaagtgctttcttctaaagaagggccagcccctgaactaaaagacatataattttggccaataaaactaaggtaacaagttccatatgttttataaacataagatacgataaaaaacacaaagtgctccagtttcagatacagggaaatcaaggccatatacttctcagtaggggaaacgtccaacaagatcctgggaaaccagcagttggggatagaaagaggcaaacactgctccacagacaagggcagaccaaggagcctctgattccccagagtctacagttatatgcagatctctcaaggggatgaaactagttaacccaaatttcaggtttcttctgacttagaccatatgtccttacagcaccaggttgagctcattgcccctctcttgaacctaaacaaagcccagctgcagacttagaaaggatttactgttcataacaacaaaactaattttctactgtacccagacgatctcctctaaaaatgttcctttttaagtgaccaagttaaaggtaaaggatgacttccccctcgatgatatgtatatttcaattgatgtgcctgaacattaagagttaagctgttgataagtccttgaaatcaggcattctcataaaacattcacattaattcaagcaaaacattaaagagcattacataatgagtcatactaaaatggcaatgaaaagaacaaccattaagacacccagagtatcagtttagctccagttatcatttatagcatgaaaacatgtcttgagactaacatcaaaacacttacctcagcccccagaagtatcctgttcttccccttaaatacacaacatttaccaaaagcactgttttacgcaaatacaaaaggctaatctaaaaatgaaactaaaaaaacttatttggaagaatattcactaagctatctctattgcagatgtaaagccttaaaggaccatttaagggaaagggaaggctgtataattatgtaataatgttctctgatacaattgtggctctcacataagctttcttaaaagagaagagctatgaacaattaagatggcatagcacaggaaaaaaaaatgaccagcaatgagcattcacattctttctcctctctcatcctctctgctttttgggacctttccaataaaaggagagcaaatctaaatacaatccaagtcattttgtggttaattccaaataatgttccatattttaataaatctaccattgctttttcacaattgtaacagatgccactcccaactccttagatgtgaaacctaaaaacatatcacttcaaccaaaatacctaaactattgtactagttacacctaaaaacacatcacttcaaccaaaatacctaaaccattgcactagttacacctaaaaacacatcacttcaaccaaaatacctaaaccattgtactagttacacctaaaaacacatcacttcaaccaaaatacctaaaccattgcactagttacacctaaaaacacatcacttcaaccaaaatacctaaaccattgcactagttacacctaaaaacacatcacttcaaccaaaatacctaaaccactgcactagttacacctaaaaacacatcacttcaaccaaaatacctaaaccactgcactagttacacctaaaaacacatcacttcaaccaaaatacctaaaccactgcactagttacacctgaaaacacatcacttcaaccaaaatacctaaaccactgcactagttacacctgaaaacacatcacttcaaccaaaatacctaaaccattgcactagttacacctgaaaacacatcacttcaaccaaaatacctaaaccattgcactagttacacctgaaaacacatcacttcaaccaaaatacctaaaccattgcactagttacacctgaaaacacatcacttcaaccaaaatacctaaaccattgcactagttacacctgaaaacacatcacttcaaccaaaatacctaaaccattgcactagttacacctaaaaacacatcacttcaaccaaaatacctaaaccattgcactagttacacctaaaaacacatcacttcaaccaaaatacctaaaccattgcactagttacacctgaaaacacatcacttcaaccaaaatacctaaaccattgtactagttacacctgaaaacacatcacttcaaccaaaatacctaaactactgcactagttacacctgaaaacacatcacttcaaccaaaatacctaaactactgcactagttacacctgaaaacacatcgcctcaaccaaaatacctaaactactgcactagttacacctgaaaacacatcgcctcaaccaaaatacctaaactactgcactagttacacctgaaaacacatcgcctcaaccaaaatacctaaactactgcactagttacacctgaaaacacatcgcctcaaccaaaatacctaaactactgcactagttacacctgaaaacacatgacttcaaccaaaatacctaaactattgcactagttacacctgaaaagacatcacctcaaccaaaatacctaaactattgcactagttacacctgaaaacacatcacttcaaccaaaatacctaaactactgcactagttacacctgaaaacatatcacttcaaccaaaatacctaaactattgcactagttacacactaccagagttttatagataaaatcctgtctgtacatttttccaatttccaagataaatatcattttattatgaactcacagcatcacagaatgtataattactgttgacatgtgaaaagtttccaacaggaatgaaaagcttcattaataataaagatctagccagatgcggcggctcacacttataattccaacactttgggaggctgatgcaagaggatcacttgaggccaggtgttcaagcccagcctgggcaatacagtgagacccccccccacatctctacaaaaaaaattttttttaaatagctgggggtggtggttcgtgcctgtagtcccagctatttgggctgaggtggaaagattgcttgagcccaggagtccaaagctgtagtgggctaggatcacaccactgcagtccagcctgggcaacagagcaacactctgtctcaaaataataataaaaataataataaagatcatgggctctgagtgcagacagaattagctacataatttgagcaagatataacttctctgaacttcacttttcttatctgtaaaacaggaataatataaagagagacctcagaagattttgcaagactaaatgagataatgcacactaaagcccatggactcattcctgacagaaagcaagtattccttaagtgttgaccatcatcctcctctatactgagtaaaatgtatcattactgcttacttatcagtcacatataatatcccaggctttacgctggatgctgaacactttatcatagattatctcatttgttcttttaactaatcttataaggttgtttttattattgttgttaaccccattttaccaatgggaaaactaaggtttagctagtcagtttgcaggttcatgaaattagtaaacggcatcatcagaacctggaccagaatctatctgacaacaaagctccttaacagatatgacataagtattaacaggttcaaattcctctagaatgggtaataatagaagattccatacccaagtataggtgatattcatctaataactacctgaacttctgaccttttaggccaaaagtgaaaaattgaaaccccactccaattcttgaattgatatttaatctctaaaatatttatttcagggataagtgtgaagattataatacctcacatttatataatgctctggattaagtcatttgctcttcactaaaatcctatgacacagataggaattataaccccatttcattcattctgtagatgaagaaaatgaaaatcaaagagattaagtgatttgcccaaggtcacaaatctagcaaatggaagcagcgctcaaacctaagacttacttctccaagtacagtcctatttttcagtataccatgtagacaaacagatgaataatactaattaaaaagtgatcttcaaaaaaagtaatctcaccacccccaaaaaaactaattcactcatcatactcattctcattgatgatcaaagcaatggtatagttctccaatatacaacatttaaagaaaggagataagacttagaggagcataacactgttcaaaaaggtaggcccatggacatataaggaaagcaaaagatccactggtctccaagacaacaaaataaataaaattacccacctatactaatagaaaatatggtctagaactatactgaagaattttgtttaaataagaacagtcagaatgggtagacattgacggtacaagacacaatacctgcatccaagagcttccagaggaggtaaaaaaagtatttaataattactggttcaaatagttgaaatatggttgggcatggtagctcacgcctgtaatcccagcactctgggaggccaagcgagtggatcacttgaagccaggagtttgaaaccagcctggccaatatagccaaaccccatctctacttaaaatacaaaaattagccaggcatggtggtgcgcacctgtaatcccagctactcgtcccagctactcaggaggctaaggcaagagaatcacttgaacccaggaggtggaggttgcagtgagccgagattgcaccactgcactccagcctgggcaacagagcaagactctgtctggaaaaaaaaaaagttaaaatacaaggtggtaaatgtgataaaagatacaatgttctgagtacctgaaagagtgagcaccaccctaaacaaccaggagacaatcaaagaatgtgttcatctatagaaagaaaatgtaaaaaaacagaagtctcaaaatacaagaaaaatagttacaagcaatttcaccctactgcagaaaaccatgcccagtgtctaacttaggctccactcagatcttttttttttttttttgagatggagtttcactcttgttgcccaggctggagtgcaatgacgcgacctcagctcaccacaacctctgcctcctgggttcaagtgattctcctgcttcagcctccccagtagctgggattacaggcatgcaccaccaagcccggctaattttgtatttttagtagagacagggttcctccatgtttgtcaggctggtctcgaactcccaacctcaggtgatctgcatgcctcagcctcccaaagtgctgggattacaggtgtgagccaccacgcctggccctcccttttagcatttcctatgcatggtggccacatgaatcatgtgacctcgtaataaactgatcttccacaagtgcctcattcattaaatcctgctcattaaaagttgggctccaaactacaattaaatccatgtatttgatctgtgaccgaaaaattattatattaaaggtagttattacacaggtaatttcattaaaaagaagtctgggcattttaaaatagacttctagaatcatctgccagcttgacttgtacatcttgactgaaactaacagaagaaaggtattactatagatctctgatacagaaaggtcaagttcaagaaattcagtcaaaaagcaaaaacagaagaaagtgaagggtgctcagaaaaagtccaagctaagcacagaaaaaaataacagagatttaggctgggcgtggtggctcatgcctgtaatcccactttgggaggccgaggcgggcagatcacctgaggtctggagttcaagaccagccctgacaacctggtgaaaccctgtctccactaaaaatacaaaattagccaggtgtggtggtgcatgcctatagtctcaggtactggggaatctgaggcaggagaatagcttgaacccaggaggcagaggttgcagtgtgccgagatcgcaccactgcactccagcttgggtgacacagtgagactccgtctcaaaagaaaaaataaaaatagagattttaagcaggctgttatttacaactgctgcaaatattcatataaaactactatggatttagccctagtgtcctcaaactttagtgccaataagaccaataaagtagacagaagacagattgcaaaaggaatgcgtctccatcctgtaggtaaacaggtatcaaaattttatgagtaccagcgtcacccagggagcttggcaagaatgtagattctgtgccttaaaacactagatattctccggagaggcactgagagccagatttttaacaagtcctctctctctctctccacctcccactccccagtcattctgagggaggtgaatggtaggtcacttctgaagaagcaatgcaggccgggcgcggtggttcacacctgtaatcccagcactgtgggaggccgaggcgggcggatcacgaggtcaagagattgagatcatcctggctaacatggtgacaccccgtctctactaaaaatacaaaaaattagccgggcgtggtggcgggcgcctgtagtcccagctactcaggaggctgaggcaggagaatggcgtgaacccgggaggcggaggctgaggttgcagtgagccgagatcatgccactgcactccagcctgggcgacagagcgagactccatctcaaaaaaaataataaaagaaaaagaagcaatgcaatatttcaggtactatcctagtacttttgtgtgtgttgtctcatttactcctcatgaagatcacgaggtagctatttccctattttatgaatgagaaaacagaagcccagggtttaagaggcagaaggttaaacaactaaggagaaagaaaaaggacagaaaggaaatttgctctattcgacagcgatttcaaagtattctaaataaagaagctgacattctaaaacatcattaaaaacaaaagtatcaatagatcagaaagcttcaatatcttgtgtcattcagagagagagagagatgtggaaggccaatattgaaagttataaataactgtttaaatatttaaaatgcaactcagctgtttgtagtaggctgtacgtaagccaaggtagaggctgaaagtacactgtatgaagttatttatgcttaaaatttgcattatttgagcttgaagtctttattttttttgagacagagtctcgctctgtcacccagtggagtgacaaaatcacagctcatagcagcctcaaccccccaggctcaagtgatcctcctgcctcagcctcccaactacctgggactagaagtacgaccaccgcaccttgctaattttttcctttttttttttttttttttttgtcaggacagggtcccgctgtgttgcctaagctggtctggagcttctgggctcaagtgatctcaccttgacctcccaaagtgctggcagtataggcgtgagccactgtgcctgacttaagtcattttcatagatgaattaaataaccacctataaacattcgctgtgacatactatttctggtgactacacagaattatagatttgatactaataattcagccagtgaccctaatcttactagcttccataatcagtagtaccaactaagagtggtaataataatcaagagaaggagtcagtttcaaaaaatactcagaaaatgtctcagatgttatctgcagacagagtgctctgataatcctgcaaatttcagtcactgagacatttattgaacatccttgtgtacttagcaatgaactagggtcttgggattcacagaaaaataagacaaggtctccgtcctcaagaaggctaagaccacagggcaaataactaataaaacctaataaccaaattaagacctaaattatataataatacctaaattccaccgaccaatcgctgagggctggactcaatggctcacacctatactcccagcactttgggaggccaaggggagaggactgcttgagcccaggagatcagtctgggcaacacagtgagactctgtttctacaaacaattaaaaaattagccaggtatagtggcaggcacctgtgttcccagctattctggaggctgaggtgggaggatcgtttgagtctgggaagtcaaggctgcagtgagccatgatcatgccactgcaccccagcctgggcaacagagtgagaccctgtctcaaattaaataaataaatggtcttttaaaaagatcaatcaatgagaactaagtagagcaaggaaagaacacgtattaagtatgagtacctgttatacacaaaatacttccacatgttttatctcttttaattctgaggataatctgaagaggcagggttcaagattaagaaaacaaagttcagagctgttaagtagtttgccccaactcacataactcataaagaggataagacaagggaaagcaccaaagtgagagtaagtatgaccggttcacaaggcactgagaccagtcagactaaaacacaggatacactgggaaataaagctggccagagttgggccagattagaaaggaccactagttatgcttgatgaaataagaatctgtcagccgggcgcggtggatcacgcctgtaatcccagcactctgggaggccgaggcaggcatattacctaaggtcaggagttcaagaccagcctggccaacatggcaaaactccgtctgtactaaaaatacaaaaaaattagctaagcatggtagcggacaccggtaattccagctagcggggaggctgaagcaggagaatcgcttgaacccaggaggtggaggtggcagtgagccgagatcgcaccattgcactccagcctcggcaacaagagcgaaacttcgtctcaaataaaaaaaaaaaaaaaagagagagaaataagaatcagtcattaaaggcatatttaaggaagactactaatatggcaacacttcatagaacagattgcagtagggaggatctgcaaacagatataatcaactaagacacagctctagagaggagctgcccctggctgataccatcggtcctctagagaggagctgcaggaactgaccgatactatcaggtaggcaggtgttgctccaagctggccaggccctcacagggaggcactggtgtccttctgttgaacatacacaatttcacagaacatggacctcagacaaggccactctgtgaccgtgatggatcaaaacgaaaacaagaccactctgtaatcatgtctgaacgcaactctgttcaactaccgatgtgctccctggctggacggcaggaactaaagctagagcctgttctaggatggtggcagtaggaatagaagaaagaaagcaatataagtgacatttccaagtaagaataaaaaaaactgttagtaggcaattcaagagaaaaagttgagactcatacatcgcttgagtggatagcatccaactgaaatattataaatctaatctataatatttaaaatctatatttttatttaatctagttaaattagtccatgtttttcagactgaataaaagatgatgacagaaaaatatttagtaggtaattagagattaaaaaataatgatgcctgcgtcccacctccaaaggctctgattcgatcagtactgagtgtagcctaggcatcaggatttttccaagctccccaggtgattccagtgtgcagctaaagctaagaaccggtatctcagagaacgccgatggctcctgactaggaggaaaaaggacaaacgatggatagggtagaaagggacccaagaaagtactggggcaaaaaggtaagcgagaaacaaaaaatggctgaaagactagacagacgattcccagacacagcaagagtcatttaaatgatgaaagagtcactatttaacaaacgatagaaaccaggcaagaaggttaacacaggtttagatgactaggaaacatgaccaacaagtaaggccactactctgcattagcaaaatcttcagctaggagactttcaatctatgatcctctgaggatgcctggataacaactacatgtaccactacaaatagatgttaactgtgtacagcctgtttctaaatatagaggtggattcctccagcccttttccttcctagtgttcccacactgccacctcgtgggtcagcactgcaaggagccggtttgaactggaagggatttctaactggccctgtaaattcacaaggcaggtacatggtaaagcctcaattcaagggtttaatccttatgttttcctctgtttaattacagtggaagacagccttaaggtacattgtttcttttgtgggtgataagaattttctaaagttgattatggtgatattagtatgtacttaatgccaccgaagggtacacttaaataaataaaagggtaaagttaatgttactttatatcactttaaataggcaaatggtatggtatatgagttatatctcaataaagctgttacaaaaaaaggaggaggtggccaggcacattggtctgtagtcctagctactgggggggaggagaggggggctgaggtaggaggatcacttgaggccaggagtttgaggccagcctggacaacatagtgagaccttgtctctctgaaaaaataaataaataaaaagaaagaggagtaggaggaggcagctgtagcaaatacataaatggtttctaaaactgcagaaaacttaaaaaggatgtcagaaatcactcaataccttcatttcaaaaaggcaaaactgagactcagattaacttacttaccctacttacccaggcagtaaaaactaggccaaaaaggggcactattaacccatttatggaggtcttctatggtctcccaatcctgagaagctttttctcttaagcttgatcctcagcaatgctatcttttgctgcctaacttactactgggagatcacactcacaccaatgacttcacagagcagtagtatcaccactattccaatagttcaaaacccagcactcacccttcaccacagagcactactgtcaccactattccaatagttccagctcaaaacccagcactcacccttcaccacagagcagtactgtcaccactattccaatagttccagctcaaaacccagcactcacccttcaccacagagcagtactgtcaccactattccaatagttctagctcaaaacccagcactcacccttcactgcttccttgccctttaatcggtcaacaacgtgggtgaactcctcaacatgtttggttccaggccctctaccagtcccctagctcaggccttcatcacttcacatctagaataacgcacattttctcctaactggaatcctcatctccagtctttccacttctctccctcatcacaaaattcacccaaatcaggactcctacacaaatcttccatgtgcacctcatactgcagcccaaaaatctctatgggctcctcaagagttgtacctagaaaataaagttcaaaatctcttaacctcagcaaggccttctgtatcacagacgctatcccaacttataatctatcatctatacaaacagcacttcgctgcagtcataatggtctactaaacaatgtatgcacatttcccaattagttattcctccatagttgttatctctaccacttatttcactggtatcatgactttttttttattcctttcccaaaggttctcaactctggctatgcattagcattacctgtgaagctttaaacaattatgggacccttaaggatgttgctcagacatctggatatttttaaattccacaggtaaatgtgtaaaataccaatgattcatagattttaagtaagtctttttgtaagatgcttaagttttcaccactaaaactgagcatccaatattagagtcaaaaactcaaaaattaaactgcccagagaaactgttacctactacccaaggtttcttgatcattggtacaacataaatctttccaattaacatctactttctaacaagacgtaaacacagcagctaaaaaatgctaacaaggattaaatttttatatactcaaattcatttgtgagaaacatctatcataaccatgccaattaaaaattcaacataattcctgtttgtcctacctatgacaattatttaaatgtaaacagaacatgctaatgtcaatgtccagtttaaaactgaacatgcagaattatttatagatattataagcagttggactaatcccagctgtggcaattttaccttagcccttggatataaaggcacagagaagcagggagtcagtgaagatggaaaagaaagataggagctgtcaacccagactgctctataataatctggggagtattaaaaatgtctatgctctgccgggcgcggtggctcacgcctgtaatcccagcactttgggaggccaaggcgggtggatcacgaggtcaggagatcgagaccatcctggctaacacggtgaaaccccatctctactaaaaatacaaaaaattagccaggcgtggtggcgggcgcctgtagtcccagctactcgggaggctgaggcaggagaatggcatgaacccgggaggcggagcttgctgtgagccgagatcatgccactgcactccagcctgggtgacagagcaagactccgtctcaaaaaaaaaaaaaaaaaaaaaaaaggtctatgctccagccacactccagacaaattaaatgagaatctctgagggcaggacccatgcaccagcatttcttaaatctccccgagtgctttcaatgtgtagccaatgtcgagaaccaacgagttacaagggaatttctcaaaggaaatctaaagatgagagctgttcaaagacaaacacaaagagggaaaaagtcccaagaactagttagttacttcagaagtaagttgctttctcttatcagtttatgaacaatttttacatattacaaatatacactttttggccatgcgagtgactcacacctgtaatcccagcactttgggaggccaaggcagggggatcacttgagctcaggagatcaagaccagcctgagtaaatggcaaaaccccatctctaccaaaaataccaaataaaaaaaaaaaattagccaggggtggtggcacgcatctgtggtcccagctactcagagggcggaggtaggcggcttaggtggcagaattgcttgaacctgggaggcgaaggctgcagtgagctcagatcatgccactgtactccagcctgggtgacagtgagacttcacctcaaaaaataataataataataataatattcctttttatgttgaaatattttcgtcagtttcttgattttttgttgttgttgttgttattgttttgatatggagtctcactctgtcgccaggctggagtgcagtggcatgatctcaactccccgtaacctctgcctcccgggttcaagcgattctcctgcctcagcctcccaagtggttgggattacaggcgcacaccaccacgcccggctaattttgtatttttagtagagatgggatttcaccatgttggccaggatggtctctatctcttgacctcgtgatctgcccgtctcagcctcccaaggtgctgggattacaggcgtgagccaccacgcctggccagtttcttgatttttttcattataagatggttcattaacataaggatgtttttaacttttatatattcaaatctgcccagtctatcaatctatcttatccccttgtggttgctcttatttatttttgctgcaaatgctataagaacaacaaaaagaggacttgcttacattataattctcaacccaagtaatgaattttaaaaatcagtattggccagatgcggtagctcatgcctgtagtcccagcactttgggaggccgatgcaggtgaattgcttgagcccaggagttcaagaccaggctgggcaacatggtgaaaccccatctctacaaaaaatataaaaattagccgggcatggtggtgcatgcctgtggtcccagctactcaaggctgaggtaggaggatgacttcagccaggaggttgaggctgcagtgagccaggagcacaccactgcactccagcctgggtgacagagtgagactctgtctcaaacaaacaaacaaaaagatcaatattagcctactgttataaatgcttttaaatgtttaaaactaaacatgaataggccgtgtataaaacagtaaactggcaacaagtaaactttaaaaaggaaacattcttgattgtactatatttaaacaactagtaatggctctgtccattttcacttttcaaatagtagaatgagatataaaacacaaggttatcccacaagtggcctttattttttctatactaacaagtaattattatgtcaaaaactaggggaaaaactcatttacacagaatcttcttgtagtaataaactgtaaggagatcaacaagcacaattttccctccagatcataccaactccaagtaaaactactagtttcaaacataggtttcgactcttattgtgaaaaacatggtcatcatcaataagccactataccatgtaaatttcattagtgagttttatatagatatttatgacaaaatttaacttgtttgcccttttttggtctaattcaaaataagagttaatggcaaatgtcagaggctaagaacagtttggaaagggggttcatgaaggagaccactcagagacagtgttttagtggctaaaaaataagttgcctttctgaaaaatatttgtatgctttttactccattgtccaccagagggagcatcacatctgattaagagataatggggaactcccagatagaaatggaaaatcatctgaaacttgatctacgaggtgctacagatggtagcatatacagttaaatgtaaaatcaaatcagagaacccccaaaagaatctcaaagtgagtgggaggacagcctcctagggagatctcatctctaaaaaaaaattttcttttaattagctgggtatgatgttgcacgcctgtggtctcagctgctcagaaaattctggaggctgaggagggaggatcacttgagcccaggaattcaaggctgcagtgacctatgatcaaaccactgcattacagcctgggtaacacagggagaccccagtctctagaggaaaaaaaaaaagaaaaggaaaaaacaagaaaaatgagcaaaagataaatacagacaaatcacaaaaagatataaatatggcctttaaacacatgaaaagatgtttaacttcacccataatgcaatttaaatgcaaattaaaactatactaagatcccacttctcacccataagcttagcaaaaattcaaaagttcaggctgcaaagctaagggaaacaagtactcacatacatcattagtgggaatgcaaaatggtacaaccccacataggtatttacaccttgacccagaaatcccattttgaggaatctaccctgaagatacaccagcaacaatataaaaatacacacatgcaaggttattcattagagcaatatgcacaattgcaaaatactggaaattgcctaaatatccacacataggaaattagaaagtacagtggatacataaaattgagcattatggagctataacgaataaggaagatctccatgaactgatagtagagtgatttccagtagacacaaagataatgaagcaagtgcaaaactaagaatggaaaataagaacacacatataggccgggcacagtggctcacgcctgtaatcccagcactttgggaggccgaggcgggtggatcacgaggtcaggagatcgagaccatcctggctaatggtgaaaccctgtctctactaaaaatacaaaaaattagccaggcgtgatggcgggtgcctgtagtcccagctactcgggaggctgaggcaggagaatagtgtgaacctgggagacggagctggcagtgagccgagatcgcaccactgcactttagcctgggcaacagagcaagactccgtctcaaaaaaaaaaaaaaaaaagaacacacatatatacttgcttatcttaaaaagaaaaaatataagatgaaccagacgctacggtctgaatgcttataccccccaggctggagtccagtggcacgatcatggctcactgcagccttgacctcctaggctcaagtgatcctcccacctcagcctcccaagtaactgtgattacaagggtgcacaccatcccacccagataattttttgtttttttttttaacaagatgaagtttccctatgttgcccaaggtggttgtgagctcctggcctcaaatgatcctcccacctcgtcctaacaaagcactgggattacaggtgtaagccaccacttgattaagccagactttagagagacatgaaaaaaatgtaaagcaatgcaattctcattaaattttcgttgttttaaaaaatacacacgggcctatagtcccagctattcgggggactgaggcaggacaatcgcttgaacccaggaggcagaggttgcagtgagccgagattgtaccactgcactccagcctgggcaacaaagcgagactctatctcaaaaaaagaaaatatagtttgattccttaaaaaattgttacaacataataaatttacatatatgtaacaattttttaagtaaccaaaccatcaaatatacacacacacacacacacacacacatatatatatttttgttattgttgttttgttgttgttgggtattttttggaggcagggtctcactgtgtcacccaggctggagtgcagtggcgcagtctcagctcactgcagcctccacctcccaggtgcaagcgattctcctgcctcagcctccaaagtagcttgattacaggcatgcaccaccacatctggctaatttttgtatttttagtagagacggggtttcgctacgttggccaggctggtctcaaactcctgggctcatgtgatctgcccacctcggcctcccaaagtgctggaattacaggtgtgagccaccacgccctgccttaaatttatgtttaaataggtattttcaaaacttagttttaatttttatgcaataaatataaatagataaaacccacataaacaaaacatcatcagcactctcaataacgttttttaaatccctatcaaatccattttgataatttgtaaaaggataaaggggtcctgagactaaaaggtctgagaaccactggtctataacaccagctgccttaaatgccagagtatgttaagagcaggggctggggctggggactgtatcgcttctgttgcctgataatgctggattctgcactaccatcaccacagacactgggccctgctgctgctgctgctccttgggaaactggttgttgctggagagtgattctctcaaccattcttctttgtgatactggcttttattcaaagtcctcagagagcatcttagattgaccgaacttaggtcactgcccgcaccctagctgcaagggaggttgagaaggtatttagcctttttggctttttcgatagaaggcagacttggtctacatcccaccaatagtcttccaatgaggaaatcggcaaacataaacagtcaaaaccacaagcattagcccattgctctaattctttctgggaaggtcagaggcaaccttgtggggaatatcacagctctatcaaagattctcagtggatcttagagatggtggtattacacacagggaagacaaatccaagtacaggaaaaaaattgatattccaactgactcctccatgacaaaaagttctaccataataacccgacacaaggtggctggctggtcctgaagatgtgttgccatttggggaatcaggaccagttactactggcagcaaactgggcactctgtaccagcagaagccacatggctatcatgaggggaagtctgtattgttgagttccaggcaccagcctctatccccgtccccatggttgctctgttcttgagccttttgagcaagcaccaggctgtctgaagaacaacttactgctatccacaaagcaggtcatcctgtctgattaagaacgccctctgctgtggcattcacatggaccaaatgttttcaccagggctcagccataaagccctttcccaaacctcgttacagaagaaaaggaagcagtagaagaaacaggaattatgactcccacttaaaaagaaaaatgtagtcacatccataaagtcctttcccaaaccacattattatcaattcttccaccttatttcaaatcctagacccattagccactgcccaggaagttgcaaatcctacttcaagccatcgttcaaggttctgctctttgaaatgattttgctagttgcttgaccttcagggcctccaaggaagagtctgtaacactgcagcaattcacttacgcctggtgctaaccatattttacaaaatcagccgtaaacccagtaacgtctttttacattattttcacagaggtaagtgcttccttgtctccactagcctcttctactctactgacccttaaaccttgggttattttagccaatgtgagaattctgcctttgctgaaactattcatgccaatgtctaacattcttagtaacttcattatttagataattcaactaacctcagcctttgggtttcctgaccaaaaatcttttcttactccctaccttggccacattctgccacaccccgtacctgttgtatcaagacacacactacttctaagcatgtacatatcaagtcaacccattatctgaccactcaccatttctctgaccacatgaggacctctaatccattgattcggccacatttcactggccatcaccttccttacgacctcattccctacctgagaaaccatgatccacaattacaccctcccttgcctacaacttcaacttcccgtcccctctctccgtccatcatgctaacctagcaatcctaggtaaatccagttctcatagccaagcagctggcaattgggagagaaaggaaacatgacccaactaactgttcccactttaaataaacaaacacaagttttaagtagaccctcagcacttttcaacaatcctacatttcacgaggcaatttatgcttctctcctagaagactatttccaatctctcctaaggctgagtcacttagcaaccacttccctagcggtccttaaacttttcaatcaccactgctgttgccttttctggcacctcttcttcttaccctcatatatgaagatgttcccttccatctccaccccaggttcagtccttggccaagagacattccatcatctcaccaaacacagtgagttattaccctttattgcctggtcacatttactcacactgcaactcaaatgcagctgcctttttttttttctttttttttgagacagggtctcactctgtcacccaggctggagtgcagtggcgtgatcaccactcactgcaacctccacctcctgggctcaattgattctcccacctcagccttctgagtagctgggactacaggcatgcacccaggtaattatttgtatttttagtagagacagggttttgccatgtcgcacaggctcatcttgaacttatgggctcaagcgatccacctgcctcgacctcccaaagtgctgggactacaggcatgagccaccatgcccagcctgctttatcttctataactcatctaatctgtctcctgaatatgcgccattttttctataattaatctaatattcctcatgaatatctactctaataaatatccaggaaatttaaaacttgtcaaacaatatctcaatctcttccagttaatactcagactttgtttaactccttacccgggctggtttaaatggctgctttcgggtagatttccctccaaggtcttatcggacatcctagaagaaatagtggcaagaagaccttggatctgtgttgtttctctggatcctcactggtctctgctgcaaggaggtaatcaggtcctatggctgaactggtcccatctcatcttttaggatgtcatgctggctctcatccctggagtctgtgatcctgacattcagtctatagtcacacagtcttttgtcatgacgccagctgttccaccaggccaataagctcctccacctccttcacagtggtatgagagcatttcagaatcccctggtaccacaaactcaactatctagccacttccttctaccactgctgtgctataggcccgtgttggcctatcactaacctgcataacatctcctctcaagattccacataaggagcagagcaaaaggccttctactgctgaccgtcccctcaacccatttaacatccccaccctaaccctagaactttagccagccaagaaagatcagaacacatatttctcacaatctgttttccctacctctgtccccccgctgcccacaatccaccaggactgaaagggatgacacgtctacttccaagtcatcctccttcctcctgggaggcactaagcctcattctcagccttaatgccagatgagctattctctttaccctacagaagaaactatcattagagtttgccagaagtaactcttgatatggaagctgcaggcaacttggaacttgagaaaaccaaagacaaacatacagcgacttcaagttccccaaaatattaatccttgaatgattaacatctcccatgtggtaggccctggggatataaaaaagattagacttagagcactacactagggagtgagaaggtttacaaatacaatcataacaatggaattttatgtgctgcactcaccaaagcaaacgggaaatacacataactcatacccaattgtcaaccaacctgttctacctccatcaaattaaaaatgcatgcaacggcagaaggacaatataagtgatttcaggccggggacagcggctcacgcctgtaatcccagcacttaaggaggctgaggcgggtagatcacctgaggtcaggagtttgagaccagcctgactaacatggtgaaaccccatctctactaaaaatacaaaaattagccaggcgtggtctgtaatccaagctattaaggaggctgaggcaggagaatcgcttgcacctgggaggcggaggttgtggtgagccaagatcacaccattgcactccagcctgggcaacaagagcaaaactccatcttaaaaaaaaaaaaaaaaaaaaaaaagtgatttcaggttataatttcattgccatttactctttctacaacttacatacttcattttcttttccaggcacaacacggaaaaaccagaagccattccttaatgagaggaaaaaggtaagataagccatgaagcaggttcacctttctccattaacaaaaacaagtatacagaactaaagctactaatcaaaacagctctagagcaaaggaaatcatgtaaaacttggtaaccattgtttctggagcctaaggaagtagagatgtgcatcccttaaggacatcatgaggtgatttcattgttgtaggaacatcatggtgtatcctcacacaaacccagactgtacatacagcctgctacacacctaggctagcaggtattgtctgtactgcctactgctctgaggctataaacctgcaccgcgtgttactgtactgaatactgtaggtaactgtaaaacaatggtaagtatttgtgtatctaaatgtacctaaacacagaaaaagtacagttaaaaaatgatataatcatacagggccactgtcatgtatctggtctttcgctgaccaaaatgtcgttatgcagtgcatgactgtaattatcatcaatatctgtttttttaattctattttgatttttcctttcccatgtaactgttaattgctacaaactaacattttcattccatacttaattcagatggaaggcagcagaaggacaggggcagttaggaggaaaattctgccagacattcatactaaaactaagggcttactatgtgttagacactggggctacaaaaactgaaagatgcactattcttaaagacttcacaatggacagtgaataaagagaaacaaattttacttacaagatgacaagtaatacagaaacttatccctcaaggacaggcattcaacagtggcagaaaactgcatcaaacaatgcgctaacatttccctaacactattttcaggttgcagtgattcccaaccaggctctttggaacactataaccactaaaatgggagtgttcaaacagagcaactactaccacaacacaagtgaactgtgtatcctggcaatccaaagtaagtgcaaatattttgtgtctgtgtaaaatactagtaagtatttgtcagtcattatgaagaatctgtttagcttgttttgtttagatgcttagcatttacttatatccctttttctatgtttatgtttgctgatttccccactggataactatcggtgggaagtagagtgagcctgccttctatcttaaaagccaaaaaggctaaataccgtctcaacctccctcgcgctaggggtgcaggcagtgacctaagtttagccaatccaagacactcactgaggactttgaataaaagccagtatcacaaagaagaatggttgagagaatcactctccagcaacagtgagtttcccaaggagcagcagcagcagcagcaccagggtccagtgtctatggtgttcgtggtacctactgcagaatccaatattatcaggcgacagaagtgatatacaccccagatcccagccccagctacttttgcagtgcaatcctaacttggttcagccgatgcccagtcaagtcttggcagactttaaagcaacactgagaactcccccaaaactctttcattaaattccttttttgcttaaatccccagttactgcaaacaggaaaaatgaatgagactaatgaaatagtatggtaaatcaacaagcatcccacccacaaagggtttgtgtagcttattttggaaatgcacaattccgtgtgtcacaagactcaacttcagctctaatgattcaattgccaatttgtcaccatttattcattccaaaacttttctgttccaagaactatcttgaaaggaacgaattgttttcaaccacacagtttacaaaaacttcaagatgctgctctctcccgaacagatgttttcgctgttatcattacttcagaaagcaacagacaaaattattatttggtagctctaaaatgcaaagtcatattcctgaattatgaatcaaatgagaacaaagtaagaacaatggtcaaattacagatacgagttttgcacttaccgtcccacctccacccacctaaatctcagactggcaggtctgaaaagcggccatgcacaaaatcatcgcactcatctcaaaatagaactcttcttcctcgcacacagaagctcaataatatttgttgactgaatgcagttcctattattcatgtatgttacacatttccataaattgctttcacatagcactttacaccggcacagcgcgtccaggcttccaaaacaccttcacgtgaatccctgcatctagaatggtggttaagagttagacatgcctgcacagccattaaatggcacagcacacgggggacccgtgtctgatgctcccacagcacattaattgcccctctatttcagcccttctggtacactgtaattctctctctcacttgatcagctctttgaggaggtcccgttcctcttcgtatccccaggccacacacaacccagaccacagaggtgcaccgtagacatcaagattcttccacctgctgcaagcctgatgctttaccggcggggcctctgcaggggagcctgatttatactcatcccagctcccacccagccccacgcccgccacgtgtgatttccacagccgcaccaaggaagactgtccagcacacagacttttcgtctcccagcaaaattatccccggcacaacgcttccccctcaagtctgcccaatggctttcccatttccaccgcagcccaggttggggggcagtggctgagcctgggccccctcccagccccgctgcggcaacctaggggggtgtccgggcggggcctgtcagcagcgacccgcccccgggcacacgcgcgtcaggggcagcaccgccaagctgcctgtgcagccccatccagcaggagtcccgcggctgccggccgcccgacgcccccccctccccagcaccccacacagctcgcgactcaggtaggcgagggcgctccttacgcacccgagaaggcagcggtcgcagacgacgccacgactccccttgcacaccgtgtacgccaagggatccgagcggaagagtagctctccggggcgcagcggggtcacggcgcgcagcccgtttcccctcttggcggttgcgaacttttccaccttcagcggctccatcctcccgcagctccggcacctcagacggctacccgcgtccagcagcgggcgtctcacgggctgccgggacccgcgcgcctgcgccctgcgcgcacacgtacgcccgaggggcggggcgggcgcggtggggcaagagcatgcgcagatggagtctggagggacggctggagtggagtgtgtgggacctgaaggtggtcgtaaggctccgcgtgcggctcgtgcccatggcgactgcgcagaagacaggcggggttttttttctccctctaacattgtattacgatcattttaacgcatacggaacagttgaaaacagtgcagtgaacacctatatacctccgcctaaatcagacaacctagcactttgccatttctgctcgtcactctctccccacctgtagctatgtatacacgtattgtcgttaaactatttcaaagttgcaggcatcatgacatcacaactagtactttgcactgtaacttttttttgttttaggacggagtcttgctctgtcgcccaggctggagtgcagtggcgagatctcggctcactgcaacctctgacctccgggttcaagcgattctcctgcctcagcctccatagtagctgggactacaggcatgtgcaatcctcccgcctgggcctcctgactagatgggactataggctcacgccaccatgcctggctaatgctttttactttcctccagagacagtctacctatgtcgcccaggctagtcgcaaactcctggcctcaagtgaacctgaacctcctgcctcgacctctcgaattgctggaattacaggtgtgagccaccacacccagcttaattttcttttttgtttttggggtttgttttgttttgttttgttttttgagacggagtctcattctcgcccaggctggaatgcagtggtacgatattggctcactgcaacctctgcctcccgggttcaagcgattctcctgcctcagcctcttgagtagctgggactacaggcgcctgccaccacgcccggctaatttttgtatttttagtagagacgaggtttcaccgtgttagccaggatggtctcgatctaaccttgtgatccgcccgcctcggcctctcaaagtgctgggattacaggcgtgagccaccgcgcccagcccacccggcctaaatttcttagtttggacaaacgtgccatggtaatgcaaaatgtcattattaagggcagctggatggaaggtgtaggagtacactatagtgcctttcaatttttctgtgtatctaaagtcatttcaaaagtaaacatttattttaaaacatgaaggtggttatgcttccatgagtgtaaagtacaaaaggcaggctcgtggtgctgtcagaagtcagaacactggtttcagggctgggggtgttgggaggggctgggcatggttggctttgtgatctgggggctggtgtgttccatctgtgaatatcttttaagctgtgcacttaccagggatgtaagtcatatcttaataaattttcataagtttgacaaaaaataaaatgaggatgggaagcttgtttgggttgtggggcctcgggtgcttatccagccatgagctgtgtcccagatgcttctagaagcctggagggagctgagaacattccaagtcgaggtggcagagccaaggccctgaggtgggagcgcaatgctgcacatccccagctgtgaatggggtgtcctggtcagaagcagtgctgtgtgcactgcagggccggcaaatccacgtccacattgtggcttggtgcagtgaaagccaatctcagccccctccacagtgtgattagcctgccagcaggtggccagctggtcctcctgggaaatggtgccaacccagagactgggtgcaagtgtctcatccacggaggggcgctcagcagtggtgtcagcctggtgagcctcggtaagggcacgtgcaggatgctgagcctcttccgttcccatgcccgtctcaaggccacttgctccgtgggcccatccagcaagcatggtggccaggaaagaagccggctccattcacagggcgtgctgttttgctcacctcaggaccaagagcatcctccatagtgattctctttggtgggagcactagaaacatgaaccacagataccttcagcgtctgagccgctgaggcgagggctgcaggacaccctgctgtcgggaaaccctgcactggcggctggaaggcatgtggtggtggcgcctgctgtggctgcagcagttgctgcgaggcttcgggatctcgccggcccctgcgaggtgaattgtgacagtgcagagctccgtggtaccagggccccctgcatggccatgctgactgcagctgggagcccaccacacctctggttccccgctcttcccagggctggggtctaggccaggcccctcttggcctgcgaattgtgccctgggagggggacactgttccacaggttgggaccaaggacccagggcatgctactggctggctgggctgcagggatgccatgctcacctttctctctcatggccttgacgggaccggcttcctcattgaacagcattttccaaggtgtctgggattgctggtggggtgccaccctggctccttctaggcatgcccgtcattggccaccaagggggccagatgcaggtgcccatgctgctgtgggggcatctcccaacttccctcttagtcctgatgggcctaggcagggcctgatatgggggtccccatgggcttccggggctaagcctgccccatggtcccagggctgtccaggacacattcagaagggacatgagctcagcagctctgtttgaaattattatggaaccaagggccccccacatccaagtccactgggagtcgggacatggagttccgctgcaggtacctccaggaaccccgaggtcctccttgagccaaggccaggctgggcacaccataagtcctgggtcccccagagaatggcctgctgccctgggctccccagaagccccctcacgcccctgggccttggccacatggaagccccaccaggacaggtgtgagaggacaaggaacccatggtggggaagcagaccaaatgggccgctggaaccaggctggtgggccagggggcacctgcccatcccccttgcagagggccttcctgccacgtgaagccagcacagccctggctgctgaggacccttgcctgggtttggctgaaagaaaaacagacgtgatcaggcagcacctccagtgggcccaaagagtcctttctgggccgggccccacctgcctgggtctccggagtcctcagggtctctcggtggcccctggggtctgacactgaggacacacctgcaggctgctgatcccagagggaggggtgtgtgtcacctggggtagggaagctgtcggggcacagcaggtggctcctgggactgccccccaggattcaggctggctgggggcttcctgccccatgccctcatcccagggctgttgggcctggtatatgatccccagtcagaactcaggtgggaggggccttggctgtcacccagcccccttgctacctcacttggggacctgtctctaccatgagtaagagggcccagatacggggccccctctgccctcctgggctgcccggtccatgccaggactgaccattcccacacctggctgaactcttggctctggctctgggccaggggtcccacctgtgcccttgccctgaaagctctgggggtcagggacaccgactcccttgtctccctggctcaaggctcgttgtcctggcacccttggagggatgttcaggagtgaggggcctctgctgctctctgaggctgtcagtgcttgcagggaggggtggggggggtcccacaaatgggtctggctcctccagtgccgtcaagggccctgttgggggggggcgggacaccgtggaaagtgggagggggcttgttggagaggtcttgcccacatccccctcctgcgtgcacagcatgtgcagtgcacatgcactgagcacctgccctgaggaccgggggcctattgtctttcttagagtccaggaggaaaaggaggaagaaaaggcacaagaggaaggcccaggtagtaggcttgggggtcccgggcgctcccccactattgactgccccagagggtgactcaggagggggcctggtatggaagcccatctgggggtggcaggtccccattcttccttgttagcttcctcgtagaggcccaagggtgcccgagagctgcgtcttcatccagggcctaggtatgggagaaccagcccccaaaactgcccatgggccagacctggatgtcttcatgaggccctctagggatagggtgggcatcaggccaggagagttccctgggagggtcagagcccatacctcattgccacctcaaccgtctcccactgggaggtgccagatccttttgtggccaccccaggggtccagatgtgcataggaggctgtggctgggggtggcctgggcagggaagtgctcaccacactccagactttcatctggaacatgtcgggggtgggcttggtgtcactgtgccctgcccagcccacccagccagacctccccctgggccagagcagaggatcatggggacagtgtgaggaagctgccctcaggccagtccgagtctgaccccagtgctccccagtgccattgggcacacgtggacttactccattaaaccttaaaggcagtgcatgccatcggcatcaacacctgttccccttctaccaaatacacatcccacaggtgcaggttgagcctgagagagatctatggggacagcagacactggaggacctggcccttcaaggctgggggctggtggctcgagctgggcccactgggacttcagtccccagagtcagtgaccctccccatgagggtcatctgacccttccaggaggctgggtcagacagggtcttgcagctcctcatgaggggcactcatttcagtgggatatggcttctggagagagggacctccccagggcttgaggcttctgagctctcccaagttgggttctgccccagtcttcccatgaggctgggcctgagccccaacctctgccgtgggatgacccttcttgggcacggggccttgcttgtgtgtcctacagggccccgtctgtgcctcctgtgggctgggggtgagccggacccctgggcacggggagcagggcactgcagggcaaagagggtccctgagccagggtctccctgggcctccttgccccatccatcaagctctggagcagccagcctaatgaggaaccctgcgcacatggcccttccttgtcgtgatgggaggaacagaagtgctcagggccccctgggctactctaaaaaccaaacctccctcttccagggtcctctgaagacccttccccaagtgcagaacacaggatggtgtccagggctccacacgacaccttccccttcccgcactcccagcggacacactgcccttagccttgctctgcaggaggtgggccccagtgcctgtgcctctgtctcctccagggcgggaaaggaaacccaactccaaacgcatggagaaccccacatcccaggtcaggccctggctgggactcagcctctcatcagtcccatgggggtctctagccagccctacgggatgcagggcctctgggaaagagccgaggggaccataaacacacagggtgcctcgtggtcttgggttatgacgtgggtaccacgtgttcctggtggtcttgtagcccctggacccttgtgctatttgggctgtagaatcctgagacgcccccagcccatcatgaaaccagagccagctcccaagatgtggagctgtcagctggaagaactgggcagctgcagaggcccccgaaccccgaggcctcccaccctcccatctgtgaccccaccatgtggccttggccctggggagaaggggtgggaacatcccctggagcctggctggaggtgctccgggaggcctcctgggccagggtgccgggagggcaggcctgactttgaggccacaacagagagtagaaagaacaaggtgggtgctgggacccctggttgtctcttggaagtggggtcaggccaggggacatgggatggggaggtgctgccatctgggctttgtcagcccacctgtgggaaccaagggcagctgaagcccagccagctggaggccaggaggactctcagggaggggagagtcagctgcatagaattcgagctggagagcgtggctccaggacatagagggcggccacggcgaggatgagatgccctctgctgatggggatgaaaggcatctgactcagggtctgggggtccccattcatccatggtctcctgtgggaccttcagcagagacatcctaaaggctcccaacaagctggtgacacaaggaaggtacctttgctgaaagtcgagatcatctggctagggtggctgtccccgggtctggctgcatgaggtcggggggcagctgttcacctaccctgtggggagtgcctctcacaagccaacagctgggccagtgcccagaatgcatcctccccaggcccataaaggagaaacaaggcagcagcgtggctcaggtccctgcggtagcccacctcctgcaagatccagagtcaccatggaaggacatctcctggagggctgaggtcacctgggaggactcatgtcatcggagagggcagaggtgactggggaggcttcctctgaagaagaggcttcctcaggatgcaaatttattttctgacaagagccatgtccatcaggcacttcagcaacttgtccaaaatgtttcctgagagcactgtcctgcatgtgacactaccaagctcctgggctttggggcagccccaggaggagggtgtcatttcttgttatgaaaagtggtggtcaggcccaggtgacactagtagttggggccctgacttctttgtctcagtttgaccccttgagaccacctcccttgcttggagatttatgccaacggtgagctggagtcctatctactatatcctgatgggtcacaaatactgactttgaaagaaacaacgatgcccctaccagacacccacgcccacgaacgtgggaatatggcccagaaacgtcactgcctgggaatactcatggggttatatgccaaatataccaggaagatgtagaataattcctgctgcctaggaaagagataaaaggggctttcgtttgttttgtgcagacgcttttagtttcactttgcctacaaaccctaacaacaaatccagtttcaggttcagatgattcaccagataagtcacaagctcttcaggaccttggttgtttaagaaatgtttcaggccaggcgcggtggctcacacctgtaatcccagcactttgggaggccaaggcaggtggatcacgaggtcaggagatcgagaccatggtgaaaccccgtctctactaaaaatacaaaaaattagccaggtgcagtggtgggcgcctgtagtcccagctacacaggaggctgaggcaggagaatggtgtgaacctgggaggtggagcttatagtgagccaagatcgtgccactgcactccagcctgggtgacagaggaagactccatctcaaaacaaaacaaaaaaaaaaagtttcagtaaaatccacatctgtgaaatgcagatatcccagttgtatagtgagttgactgatcacactctgatttttattttttcagtttgcacacccaccagttcagtctttggggtgtacagtacctccatggttctaaaccaatgtgcagagtctcctggtcaccactccagcccctcctggagcgattccttcatcctccaagtctccagggtgtcccctatgtagccaacctcttcccggtccatcagcccttggccatcccaacgtgttttctgtccctgtgatttggccttttccagaatggcctattaattggaaccctacagaggtagcttgttgggtctggtttctttcccttagcaaaatgcaactaagatccactgacgttcatgtgggcatcactggctcattcacttttctcactgagtcttttttcctttgaagggagggccacccatcctctccccattcccatgttgaaggttgtccccatggcctctgtgtgtgagtgacgatgaatcaagcagtgaatgtggcatgcatgtttcatgtgtgttaagtaaaatgtttatttagaaacagaatgcttgatccttagtaccacaaagaaacatcagcatttagacaaaaagttttctcagcaaggcaattttaccttctgcagaaagggtgctcctcacagatggaacaatggtgagagcacacctgaataaaagagggaagcaatttttatcctttatgcagcttgtccctgctactgtgtcctgtctccattggctggagctgggccatacaatctaaactaaatctgactggctaataatttaaaatgtctctaaatagctgaaagcaatggagaacaaaggaaaagaggaagctgcttatgaaaagacttagaaaagtaataacattcccaaataaggaaggggcacaggcttcaagctgggacctgcctgtgagcacgtccagcacagataaccctgattgaagtacgaggacatagaatgtacttattcctttatatctaacagctgtgtagaatagggcttaacaaagagttattagcacaaagcaaggaggcttgaaggaaattagtctttaaaggaaactgttatttctaacacttatgatttattctttaacaagaagggaaactttgaaaaggaactttttactttctacagtgtggatgtcagttttcaaatcagttggttcaatgtctgtgacacttcggggatgtgtggtttgagtccactgagctttgcgagcgactgcccaactggcttccaaagtggctgtgtcatgtcacatttccaccagctgtggatgagagtctccggggccccgaatgcccccgcccccagcattgggtgctgtcggtgtcgccagaggagtctccggggccccaggtcccccccccccccagcattgggtgctgtcggtgttgccagaggaggttcaccagccctccatcctgctgccccccacccatgggtccataccatgggtcccatgggtcagggagagcacttttcaccattgtgcatgattttgtttgctgccttctgtctcctcaggatccttctgggttctggccccacatgttctagcctggcccagagcttggaacctgggaggtcctcagtgcatggtacgggctcctccctgggccaggagagcccttggcagctccgtcatccctcctgggtgaagctggtttttgctctggggaagtctccatccctctggttcacttcatctctgctgggaccctgtggcccccataggcttacctgatgccatatcatttcctaaatattatgtgattcctcagtgtccggctcacctccaggtcaatctggtggataggttcagaggacctcttgcccttttctttcatgacctgtagggcatggccaggaggaggaagcagcctcagaacagatggaaggacccctgccccagatggcagtcagcccacagtcagcactcgtggaaggagggaaaaaaggaaggtttccttctgcagaaagctgctttttggcttgtttctgaagccagggagggtcaccagagctgagctcatttggggtgcctatgtcaccgtctgcccaggatatgcttctgaccaccccagccccaccgataagctgggctcgatgttccctccatctggagacctgggctcctgacacagcctggcctgtttgttgtgctctggctgagtatacctcatatttcccagggttctcaggcttggtttcctcaatgtttagcaggactgaccacacccagccccagaccttcaggagaatgcctttgtacactctggcagacaactgatctggtgacacaggccacagggtgacctcagcaaggaccagaccccaaggattctggaagtctctggttttggccccatgattcctcaatacaggtgaggtcaagctgggacagggtctctcctcccagggctgaaagagtgggtcagcactcagagtctgaactctgatctacacctgttccttcaccaggaggcttccctagccctgatctacggtggccccagccctggcatcagattccctcccagcaaggtgacgagcgcacgaatgggcagcaaagctggcgaccaggcctgctgtcgtctgagtaaggacagggtgctacccgctctctaagaggcagatggtgccagcccacagccaagggtgcctgtccccctgactctgcagacagtggttctgcaggcctctccctccccacattaccttcttgctcatcctatatttctgccattctcccagcatcttcagccacttttccatgtgtctcatgtcctgtcacatttgctgtcaaatgaggaatgttggagttagtggagccgccatgcttcccggagtggcccacggatgctgggtcctgggttctggagctctagtgggacccagctggaaggagctagggaagggcagaccctgggggctgagaccctctgagcaaatgagcgccagtgggctggccttgtgaccctgggacgtgccatcctcaggccacagacacaccagtcttaggtcgggtcacagcctctaggtggtatcctgacacaagcgggcagccacccccaagccacgactgttgttctcactttgaaatttcggcaaactgccagagaaacagagacttggggtcaggtccagcagggacagctgcccctcccagtgacagtatgttgctccctcccacccaccaccacccaggcccgctgcctcctctgcctcaccgaacacccactgagtccccatccctggaccagctccccaagcatcagggacaggctcttaccttcacctccagggcattgacagggggcaactctgtctcactggaaggcacctgacagagctgaggacctgcgcagggcctggagccatcccggtccaggagtccacccccagaaaggactggctctgtccccttccatcccaggtctcagctcgggagaagccacagggaagggaggacaagggccctgtggggcagactcccaggaggggcccctggtgtgggggatggtcaggctgcacaatggggctgcccctcctggactggaggtggtgttttctgctggagctcagaaacgtcagctctgagatgggactgctgctgcccagggtgggtggccacgcccggacgggagtctctcagggagtgaccgcatcaccctgctggggtttgggtgcctggcctgagacctgcctggtgcacccggggcccatcccacctgacactcccaaggtcctcgcagagtctgaccacctggagcccacctgcctctccctgcacctgagccacacaccctgctttttccctgatttccgccatcctgtccaacccaaaaactgtgaacgtctctccagccaccctgggtctgctttgactctggtcctgtcagaacccctgagtgagactccccggatctgttctcatgcctgccttgcctgctcgagagatgccaggggtggcctgggtgaccgagggccccacaggcttccaggacagcctcctggccccacctcctgcctcacctggctttcggagccattggctgtcagccctcagcctcctcccagacactgcagcagatggaactcgggacacctggccgttctccccaactatcctgcctgccccaggtcagtcccccgatcaccctctgcccactgtgctgtccaagccaactggaagcagagtccctggaaagccacgtagaatcttggggatggactgactccctctgctgagaagtcccaggtgagctggtgttttcagccccaccccatctattgtcctccccagacaatcagctccattggggtgcatttccgacgtggcacagcccatgggcttattcccatcccacctcccccagggtcctctgtctttccatcctgtgacccctgagggattggctccaggctgggctctcttatctggccccagataccgtcccagtaccagacccagggcctttagccacaagctctgctgcccgcctggccagaatgcctagaatgggggaccctgcccatcttctcccccattcccctaggcccacagccctcactgtccccatggggaagggcatggtccttgggggaaccatggcatggtccatgcggaagggcatggggacagtgagggctttggccctaggggaatggggagaagaagggcaggtgggcccctcagagacctgctggacagctgccccaaggctggaccaggtgccccctcaccctgtggccacaacccttggatctcactaggatagtgtccaagtggacagggccagaccctcaagctgcctgcctcctcttctgctaacttggagacagaactgctgagagcccaggggcctgacctagtcccctctccattcccacctgctccctagatgagcaacactccctagatgaaccacactccctagatgggccacgctccctagatgggccacgctccctagattaaccacattccctagatgagccacactccctagatgaaccacattccctagatgggccacgctccctagatgaaccacactccctagatgggccacgctccttagatgaaccacactccctagatgagccacgctccctagatgaaccacattccctagatgggccacgctccctagatgggccatgctccctagatgaaccacgttccctagatgggccacgctccctagatgaaccatgctccctagatgagccacgctccctagatgggccatgctccctagattaaccacattccctagatgagccacactccctagatgaaccacgctccctagatgggccacgctccctagatgaaacacgctccctagatgggccacgctccctagatgggccacgctccctagatgaaccacgctccctagatgagccacgctccctagatgggccatgctccctagatgggccacgctccctagatgggccatgctccctagatgggccatgctccctagatgaaccacgcgccctagatgagccaccctccctagatgggccacgctccctagatgaaccacattccctagatgggccacgctccctagatgaaccacactccctagatgggccacgctccctagatgaaccacgctccctagatgggccacgctccctagatgggccacgctccctagatgaaccacgctccctagatgggccacgctccctagatgaaccacattccctagatgggccacactccctagatgaaccacactccctagatgggccacgctccctagatgggccacgctccctagctgaaccatgctcccttgatgggccacgctccctagctgaaccacgctccctagatgggccacgctccctagatgaaccacgctccctagatgggccacgctccctagatgaaccacgctccctagatgggccacgctccctagatgaaccacgctccctagatgggccacgctccctagatgaaccacattccctagatgggccacgctccctagatgaaccacgctccctagatgaaccacgctccctagatgagccacactccctagatgggccacactccctagattaaccacattccctagatgggccatgctccctagatgaaccatgctccctagatgggccacgctccctagatgaaccacgctccctagatgggccacgctccctagatgggccacgctccctagatgaaccactctccctagatgagccacgctccctagatgggccacactccccagatgggccacactccttagatgaaccacactgcctagatgagccacgctccctagatgagccacgctccctagatgaaccacgctccctagatgggccacgctccctagatgggccacgctccctagatgaaccactctccctagatgagccacgctccctagatgggccacgctccctagatgaaccactctccctagatgagccacgctccctagatgaaccacactgcctagatgagccacgctccctagatgagccacgctccctagatgaaccacgctccctagatgggccacgctccctagatgggccacgctccctagatgaaccactctccctagatgagccacgctccctagatgggccacgctccctagatgaaccacactgcctagatgagccacgctccctagatgagccacactccctagatgaaccacgctccctagatgagccacgctacctagatgaaccacattccctagatgggccacgctccctagatgggccatgctccctagatgaaccacgctccctagatgggccacgctccctagatgaaccacgctccctagatgggccacgctccctagatgggccatgctccctagatgaaccacgctccctagatgagccacactccctagatgggccacgctccctagattaaccacattccctagatgggccacgctccctagatgaaccatgctccctagatgggccacgctccctagatgggccacgctccctagatgaaccacgctccctagatgggccacgctccctagatgaaccacgctccctagatcaaccacgctccctagatgagccacgcacctctggcctaacaacaatcacaggctggacctgcaggggagcccgggaggagttctaccctagaaaagaggtaggcccaagccaaggagacacatcctgcctcagaaagacctttctaaaagcgaaacccatccctgagctgagatttgtgctttagagggtgagaggagcacagagaactcactgcagaatcccaaggcaatcagagatcttgtagatgttaacatgcccaggctatatgtccgctggcagcccagttccacatccctgaaacccagagggagccagggtgaggcatccaaggtaaaaggtgcaagggcctgggggtgttgtcaacttgtcaccacctgtgctcctggggagcccaggaccctttgagcagggcgcactgggagaggcctccgtccagggagcagactgactgtacctgctcatacttggtaatgatgtcccctcattcctgtgccagcagggtatccacattctctcccatgtccatcccatgagacaaatcgtccaaaggtgacactgtacccgagagcttcggagaacacctgagccactcctgccgggctcccagatgctggcggtgtgtgacccccattccatcaccacctccaggtgaaaaggggccagacacagtggcccacacctgcacgggtctctggagtctcaggccccaagcaggagtgcctccttcctaaggacttgagaatagtgggacctggacagagaatcccgttgtccccaaatgccatgaaatgggaacatatctatcccaacagaatgaaaggtgtccacctgccgggggtgaagagcctgtgattccagagatgaggaggcagactggggtcagggaccagaggtctctgtatgatcagcctcttgggatcgctcagaaaccacaaagttgcccagttttctatggacaacaagatatctcctgacttcccaattctactccactcatcacttgggctaccatggcccttcagtctgaccagtgaagccgctttaggaatcatgccagttgagcaggaaggtgtttgctttgggggaagaaaatgatctattgtctccaaagcagcctctgtgctggtggaaaccatgacgctgggggagggacggtggactccacaattctgagctatccatacagggtgtggggggcttcattttcccgggtcactgagaaagaacaggagaactctgggttcttggtcctggagaacaccgagatgaacgattcctcctgggaccactcggggcaaaagggaggcgaggcctctggaggaccaaactgagaaagaaatacttgaagagaatgccagtgcctgtacccctttgaacaggagggaagatagtctccatccaggcagccctccagggctccttcattttccacaactgcccaaaggcagaaggctccccatccactcccagacagggaactgtgtgtgtccagtgggtcccacagagaccatcaggacccagcttagggcacagaggtattctgaggcccctcccctccaccccacccacagtggatccatcccagcagctctgccagggccaagctctgccccattgggatctggaaccctggacacatttgggatttagggcagggaggtcacagggttcaggacttaagtccagcacggcacagggcaggggtgagagcacaacccagggtcacatctggattcttggggttacccagttaccgcctctctgaccccagatgtctcacctgtctaatgggcacatttgggagcagcacccaccctatggagccaccatgaggacgaaggaaacatatcattaaaagatcagaaatacaaaaagagataccattaagagttcctacagatactgaaacggtcattaggtaatagtattaacatttttattctgatattcaacagcagcagtcacttccctccacccatatgtgtatcgtctgcctgggcagcacagaacaggcacctggtgagtgcccagggatgaccctcctcggcagctgcccagaggccagcactacccaccccatagccactgtccccaagtcagcatgaagggaagggagaatgtcacactcacctgattctgatgaattggctgggctgagttatgcctctcatgtagcaaactctcatgaacacagaactgctcacagatagcactgtgcgtgtgcaactgctctggaacacagaggcaggctggagggcgagcgggtgctcagcaccagtgacattctgaggtcatggcacacatcacagtggggccttgcctgggtcatcagagcccagagtcagcgtcctccactgcctgaggcgtcaacatgcctgcatgcaatgtgtgcacttgtgtgcacatgtgtatgtgggtaaacacatctgtgcacctgtgtgttgcttctctggccaggcctggctgccccactcatgtctgcacccagttcctcatcactgttacccccgaggcccaggaccagcatcagagcatccatgggtgctccctaacttcagccctccccaaccagggtggtcctgggatacacataggggtggagggaagttactgttgctgttgaatatcagaataaaaatgttaatactattacctaataacctttcagtatctgtaggaactcttaatggtatccctttttgtatttctgatattttaatgatatgtttctctccatgacccttggttattctaggtagagggtcctgtggggaaagtgcctggcaccctgtaggggctcactcttctagaaatgtgatctgaaatctggctcacctgtccttccacccagggcctaggggatgccgagttccggagaccagaaagagcttgggataaaaagaaggtttaaggggaaggctttgacctgggctgggtttgcctgcgccatccaaacctgcaggctcgagtcctgagacacagggggtccagatgtcccaatgcagggccctcctcattaacacctgctcccctgtactcattagtaacctcacccatcctaccctcaaagcacagttggccctggtatccgtgggctctgcatgtgtggattcagccaacagtgggtggaaaatattcagaaaagggagtgtggatggctatgtctctgctgaacatgtacagacttttttcctgtcaccattccctaaacaatacagtataacaacccaatgacagccctagcaagtagagacaatgaaaaagaccggctcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaacacacatgagaaaatgctcacaatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcacccattgtggaagacagtttggccattcctcagggatctagaactagaaatatcatttgacccagccatcccattactgggtatatacccaaaggattataaatcgtgctgctataaagacacatgcacacgtatgtttattgtggcactattcacaatagcaaagacttggaaccaacccaaatgtccaacaatgatagactggattaagaaaatatggcacatatataccatggaatactatacagccataaaaatgatgagttcttgtcctttgtagggacatggatgaagctggaaaccatcattctcagcaaactatcacaaggacaaaaaccaaacaccgcatgttctcactcataggtgggaattgaacaatgagaacacttggacacaggaaggggaacatcacacaccggggactgtggtggggtggggggcggggggagggatagcattaggagatatacctaatgtaaatgacgagttaatgggtgcagcacaccaacatggcacatgtatacatatgtaacaaacctgcacgttgtgcacatgtaccctaaaacttaaagtataataataaaaaaaagaagaaaaagaaaaagaaacagacctgctcacattgtccagctttgaagtcttggaagaagttgccaccaggatgcaggtaggggtcaatctcctccaggatccagagagcatatcagccagcttcagggtcaggaaaggagcctgacaggtctgcagtaggacggggctggggctggccgtgtggatcacgtgggcctaatgagggggaaagtaagaccatggggcaaaggagggagcatgggggcagctggtggcctaagcagaaggaacttcagagaaggggtctgcattagttcattttcacactgctataaagaaataccagagactaggttatttataaaggaaagcagctaaattgactcgcagttcaggaaacttccaatcatggcggaaggcgaaggggaagcaggcaccttcttcacaaggcggcaggagggagtgagtggagaatgaggaagctccacattttaaaaccatcagctctcctgagaactcactcactatcaggagaacagcatgggagaaactgcccccaaatccaatcccctcccaccaggttcctcccttgacacatgaggattacagctcaagatgagatttgggtggggacacagagtcaaacctatcagaggctcactctgtctcgtggctcccccagggctcaggctgagtgcagatctgatctgctggccctgctctacagcacgctggggctctgcctgtgcatccccatctgtggcttcccggcgtggcggcctgttccctcaaaaggagggtggctctgctctcctgccagccccctgcagggcacgatggagccctggccacgtcctcccagggtgagggcatgaaactgggctccttgcccttcttgctgcttgggtgacaagctttgggtcatccctaggtcctgtcactgttcctgcttctaaatggagagcattttgccacatcttcctgggagaggctgggggttcgtccttgttatttgttctatcttggtaaaaccaggttaagttatctgggcaagcagacaatagagtggcacccaggaagggtggggtgtagggtgctggcctttgggcttgcctggaccatggttggaggggggaaggttaccaggaagcaggactgtcagggctaaagtcaggaggaagtggttatgctgaggggggaggtgtgtggctggcttggggcaggacgtaagtaagagccaagctctgtcagctcacagagagggccgctggcacctagtctagaggctgtggagcccaggggttgcccttagttcctggatccagggagacttctggagcctgtgcctatggctttcaggcacagggtgaagctggtgagggcagggggaagggtgagagaggaggccttgcatggcagggcaggacaggaagctggccagagaccagtttgcagtggctgctcccatcctcacccccacccccaagcacacccctaccccagctgggcctgggcacgtgtcctctgctttggtctcagcagatcacaagatggaagctggcagcctagtgggtgtgccactcaagccagtggtgacctgtgacttctgcttcctggatcgtggggtgcccacccaggagagcacaggtatgccccacacccctgaccttgagggcgctgggaggtgggggaccaatgtgctctatccctgtgtgtatgccctgaaaggtggcctaggagtcctgtgtgcgcccatccacgtggggtcccaggagcttcaacggtggcagggagggagacgaggagggagaaagaagtggagaagaaggagagagaaagagagttggggagaagagagtgagacagaaagagaggaagagagatgggggaagaaacagagaaagagagatagggagagagacagaggaggctgagaggaagaggagagagagagatagggagagagacataaaaagcaaagagagagacagggagagaggtgcatgagtaggaggtcgggtcattcttgatcacagttccagggcaacctgtaggttgccattaactaaccacacatataataaaggcttctgcctgctgcttacagccctcaagaacctctactcctggagactaaaacctttgacggctgcccttcctcactggatgtttgtcgtgtcttctgacgaaccgtgatgcctctttgtaggaatggtatcaataaagagccagatttgaggaggagagtaacgtgaggcattccaaaccattttcagctgaaaggtctttaattaaggtttcaaactctttagtagttggattgctggcgtcatcagtgctggtgccctccttttctttctttgattcattgtttaaatctgttgaggattgaacaactgtgaagttgacctgaatagcaccttcactcctgacagtcacatcttggtaactggattatacctataataaaggaggcagatcagaaccacagtccttcagctggagtaccccagccctgggaaaacaggtgtgcagagaatgtgtgaatccttgggataaatgtggtgcatcttcctaaagagacattttcatgttgagcaatttattatttttgatacattaattaataaataaaactcaggggacaggcttgcctgggaggacttagcgagtctcacagtgtcctcagggtgccgggaatgttggctttgtttcaaacccatttcctttcacagagaacctagccatcacatggggctggatgaggtccaggggcaactgagggttcctggccaaggccacaccctagtgttacctgtaggcttctgaactaaccccagcctctgacagcccaatgggtgatggcaaccgggtctccaagcttcttctatcgcaattttcctcttctccttttcatgaccaccatatctcctatccactctctgtatgcaatgctgcaggaatttttacagttcagggaagtaatcctgttaggcgagatcaggaaatgccataagggattgctgttttcttgattttctagaaacagagggcctccccaactgcccccaaacccccaccccactgcagtgagcatctctctctttacccttggtctggagagcacatggtatttcaaggtcaaaatcgccacctagcggagtaggaatcctctccatgaggcacattgtcagccctttgcagaaacattccagcttcccaattctccctttttgaacccctctactagacaccaggctttctgccccttcagtaaatgggaaaactcaacgatgagaaggaaaatgtcctccaaaaccaaattttaatcttgatactgtcccatcagcaggaaaaccaccattcagtcctacgttctttcaaggcaccagaatattctgcctccaattaaaatggtacttaggctgggtgtagtggctcacgcctataatcgcagcactttgggaggccaaagcaggcagataacctgaggtcaggagttcaagaccagcctggccaacgttgtggaacaccatctctactaaaaatacaataaatttgccaggtgttgtggcgtgtgcctatactcaggaagctgagacaggaaatttttttttttttttgagacagagtctcgctgtgtcacccaggctggagtgtagtggtgcgatctcggctcactgcaacctccaactccctggttcaagcaattctcctgcctcagcctcccgagtagctgggattacaggcacgtgccaccacgtccagctatttttttttgtatttttagtagagacggggtttcaccatgttggccagaatggtctcgaactcctgacctcatgatctgcacccccctcagcctcccaaagtgctgggattacaggcatgagccaccatggccagcgaggcaggaaaatttcttgagcctgacaggcagaggttgcagtgagccaagattgcaccactgcactccagcctgggcaacagagtgagactccatctcaaaaaaaaaaaaaaaaaaattaataagtagattttatgcccggaagttaactggagccactacctaagaataaatactttagtatagaccataataacaaactgtagagctcaaaccagcacactccctccattaaggggccttgcccaaatgcaactgttacatagtcctccccaagatctatctattggggaaccacacaggtcacacaagtctaagaagtcaaagggaaatcaccagcagaggactagagtcacatggatgaatgtgactaatccctttgcttagttcctccgattccatggctgagggtcatatctgcattactgggcagcacctttaacagatgccagggctcagggaaccaaggaaggaaaaacagttggggggtcgaccccactgtcttcccctccatcctgagccattgaaggagggagaccaaagggatgcctttttcttgcttctctttctagatgggtaaagaccaacttcagcctgtacttctctggaatgcattctgaatcactgggactcctttgaccccaagactttgaaggaaaagcagctcattttcttttgcgcaagggcatggccttcttatcatcttgaaccagcctggcctgtggaggggagctttgattttaatactatccaacaattagatcttttctgcagacaggagggcaaatggtccgagatcccctatgtacaagctttctttgccctgcaagacaacccagacctttgcaagtgttgcacaattgactcaacttttttagcagtcatatcagacgggccaaaagggaatgactccccaaaactagagaagcaacttccaggggaacaatctgaggcagctattgagtgtccaggcccttgttgtcccccttctctggggccccctccaaccatgccattagctccttcagccctaccacctctgaaactccccacatccccctacaggaaatgcccaatggaggtgatgccactaaggttcaagttcccttctaattgcagaaccttaggaaaataagggaagacttaggtcaattttctgatgacccttatagatatatagaagctttccaaaatttaactcaggtgtttagcttctcatggaggaatgttatgctgctcctaaaccaaacacttactacggctgaaaaacaagcagctctgaaggcagcagagaaattcggagatgagcaatatgtctcctatagtaggccaaaaagggaaagagaaaatagggaaagtgaagaaaggaagaacggagaaccatcattcccaataggaagaaaggcagtaactcctgacaaacctgattggaaccccagtgataccacagatgaatggaaaaggaaaactttttaatgtgcatattggagggcctacaaagaactagggccaaacaccttaattactctaaattgtccatgataggccaaaagccagatgagaatcctgcagcctttatggaaaggctgagagaggcactaataaaacacacctccttaacccctgattcagtcgagggacagctcatcctaaaggagaagtttattacacaagcagctcctgatattagaaggaaactgcagaagcaggctataggaccagatagtaccttggagaacctgttgagggtagccagcttagttttttataatagggatcaggaggaggcccaagagaaaggaaggaagcacaagagaaggacagagactctagtagctgctttgcaggcttgcaaagtccaggatccccgaggtgcatatgctagttgctactaatgtgacaagtcggggcactttaagaaggagcgcccaggcagcaagaaaaaaccattttgatcctgtccagcctgaggcagggaccactggagaacggactgcccccagagacagaggtcaccaggttcagaaccagtttcatagatggtccaacaggactgatgggtcttggggttcaaacccccagatccagtagcttaaactaccattacagcacaggagccctgagtgattctggaaattgaaggaaggaaggaaggtggacctccttctggacactggagccagattctctcttctcttctctgatctaggcttcccctcttcccatagcataactgtaagcatctcaggaaaggttctgacctgatatttttctcaacctcttagttgtagttggggggatctattatttatgcacaccttcttaatcatagctgaaagtcccacctctttactaggtagagacatttcagctcgcatggggatcaacatcctcatagccccaggacaaacacttttctccccctggtggaaggtaatatgaatccaggattgtgggcaactcaaggaagaatagattgagctgtaactgctaagccagttcagttccaccttaaggatcccacttcttttcctaaccagagacaatatctcctaaagccagaggctagcaaagggctagaagcccttattaataacctgaagatgaggggcttcctcaagccctctaacagcccttgcaataccccaatattaggagtgcaaaaacccaatggggaatggagactggttctagacctctgcctcattaatgaggccatagtcccaattcatccagtggtccctaatccctatatcttgctgactcaaatacctgaaggaactaaatggttctcagtcctagatttaaaggatgcctttttctgtataccattacatcctgactcacaatacctatttaccttcaaagatccctccagccaaactgcccagttaacatggatggtggtgcctcagggatttcgagacagtcctcacttgtttggacaggcattgtcaaaggacctttctgagttttcccatcctcaggttaggatcttgcaatatgtagataacatattgctctgtaccccaattgaggaagcttctcaggaaggcactgaagctcttctgaatttcttagccaagagagggcataaggtttcaaactccaaggcccagctttgccaaacctcagtgaagtacctgggtttagtgtgtctgaagggaccagagcattaggggaagaaaggattaatcccatttcctccttccccctcccccaaccctcaggcaactaagaggatttcagggcattagaggattttgcagaccatggatacctgggtacactgagatagctcgccctttatatcacctcataaaagaaacttaagtggctaaagctcatctcctgacctgggaacctgaagctcaaaaggcatttagccagctaaatcaagccttacgtaaggcacctgccctcagccttcccacagggagggccttcaatctttatgtatcagaaaggagggaatggccctgggagttttaatgcaagcctaaggaccagctcaatagccagtggactacctgagtaaggaacttgattttgtggctaaaggatggccagtatgcctctgagcagttgctgctgtggccctactggtatcagatgccaccaaatcaaccctggcaaattacttaactatttatacccccacataatgtagcagaattgctgtcttctaggggaagcctttagctaacagacagctggctctttaaatatcaagctctgctgttagaagggtctacaatccaattgaaaacttgtcctcacctaaacccaaccactttcctccccgaggaaactggggaacctgaacatgactgtgagcaagttgtggtacagacctatgcagccagggaggatctcagggacactcccctacaaaatccaggctggacccttttcatagatggaagttcctttgtagagcaaggagtctgtaaggcaggatatgcagtcatcactctgaatggtgtttttaaagtgcatccctctctccaggcacaagcactcaactagctgaactaatagctcttataagagcacttgaattaaggaagggaacagtagctaatatttacactgcctccaagaatgcttccttagttctctatgcttatgctgccatttggaaggaaaaacactttcttactgctaatggatctcctataaaatatcatcaggaaattaacaggttattatcatcggttttccttccacaaggggtagcagcgatgcattgtaagggacatcagaagggaacagatgaagtagctgaaggaaacatgttagctcatcagacagccaagtcagtggcaaggaagcctcagggcacaacacacttgaagccgcttgaatttgggaaggctccgtaagagaaatgaagcctcagtactcccctgcagagatagaatgggccacctctcgaaggtacactttccagccctcaggaccgttgaagtcagaggatggaaaactccccttgccagccttcagccattggaaagcccttaaaatccttcaccaagcttttcacttgggaaaggatataactgatctgtgtgcccagagatcgttttcaggagagaacttattaaaaacagtcaaataggttgttaatgcttgtgaagtctgtcttaaaaacaatcccctcaacaggcagctccttcctcctcaaacccaaaggatgggaagctatcaaggggaagactggcagatagacttcacccatataccaaagatgaagggcatccaatacctcctagtatgggtagatactttcactaactgggtagaggcatttccatgccgtacagaaaaggcctctgaagtaataaaagggtgagttaacgaaataactcctcactctggtgtgcctaagtacctcaaaagtgacaatggcccctcatttaaggcagccatcacacaggcgttctcaaaggcactaggcatatggtatcatctccattgtgcttggagaccccagtcctcaggaaaggtagagatgaccaacgatgttatcaagacacatcagaaaactgtctcaagaaactcaccttccttgggtcactcttctttccatggctttactgcgggtaggaaataccccttcaaagttaggtctgagcccttttgaaatgctgtatggatggcctttccttaccagtgatttcttattagaccaggagacctctgaattggttaaggatgtaacttctctagctcattttcttttttttttttttgagacagagtctcactctgtcacccaggctggagtgcagtggcgcgacctcggctcactgcaagctctgcctcccggcttcacgtcattctcctgcctcagcctcctgagtagctgagactacaggcgcccgccaccatgcctggctaatttttttttgtatttttagtacagacggggtttcactgcgttagccaggatggtctcgatctcctgacctcgagatccgcccgcctcggcctcccaaagtgctgggattataggcgtgagccaccacgcccggcctctagctcactttcaacagcaatgaacacaactggcaaaagcccagccctcaaaaacaggagcacctctatttaacccagaggatttcgtcttggtgaaagctctcccttctctccctcctcccccacgcccaagctgggaagggccctattctgttcttcttatatttatttttatttttatttttttttgagacagagtttctctttggttgcccaggctggagtgcagtggcgtgatattggctcatcgcaacctccacctcccgggttcaagcgattctcctgactcagtctctggagtagctgggattacaggcatgtaccaccatgcctggctaattttgtatttttagtagagacagggtttctccatgttgatcaggctggtctcaaactcctgacctcaggtgatccacgtgcctcagcctcccaaagtgctgcgattacaagcgtaagccaccgcgcccagcctctacactgttcttcttttaaccccctcagcagtacaagttataggtattgactcctggatacatcacactcaagtcaaagcatgtaaagctaagaggcaacccctgacagcccagaggaacgtcctggatataaatgtgaagaaatagaagatgttaagctgaaaatcataacagataagtaaatgagtgagggcttctctacctactcagtcacacccctaccttaccatataccttcagtcatttctacttttcctctcgagatttgccatcaaatattaaaacatctttttgaaatgtactttcagagagattttgattatccaggggattacatttgtaacttcacagacccccagagggaaagtctatatcttggtgagtaaaattttagatggaaattatctactatacctcccttgcaggaattgttgtgctcactctacttgtagtaggactgtatactgtcacacccccagaatggaatattggatgaagaatctcaatcactgaagtattttgcttaattattatccttacagcagggacaatagttactgacgacaggtaaacatgaaggttttactatcactgagtcagctaggactttttctttttcttttttactttttttttctgagatggagtctcgctgtgtcgccaggctggagtgcagtggcacacaatcttggctcactgcaacctccgcctcccgggttcaagcaagtctcctgcctcagcctcccaagtagctgggactacaggcatgccccaccacgcctggctaatttttgtgtttttagtagagatgaggtttcaccatgttggccaggatggtctagatctcttgacctcgtgatctggccgcctcgctctcccagagtgctgggattacaggcgtgagccaccgtgcccggcctacctgtgcacttttaaatgaaacatgctgcttctggatcagcatctctagtcaagtagaagagaacctacaggtgcttaaagaccaaattagaatcattgacaagttaagagaaaacgtggattccagtcttctttatggaattgattagttccttttttaagcccgctcttgctcgtgtgttttgtactaatatttggaccttgtatacgcaatacggtaacttgaattatttcctctcacctagaagctattaaactccaaatggcgccgcggatggaacctcgcatggacatgccattcttccaaggacccttagatcgactccaggaggagctctagctgctgtgccccactcaatgcccctctcttcagcaggaagtagccagaaagtcattgcccaataccccctaacaggagttagggttaccactcctgagaggggaaatatgatacaggagctagaaagaaattatttggcagacagtgagggtgaataagtcctcagcaaggtttcccttttaagaaaacgcagcccccaaatcatttcttttctaacaaagagcagcctgaaaaattgagctgcaaacataggtaagcaagttggaagcttgcacggggggatgccggcacctgtgctgatagaagaaagctaccgggggccaggcatgttcaacatggaggctccatcttcccttttgtcaccatgtgtacagtaaaaaaagcaggcaacatggcaccggccaggtagagaatccatctgaataataaaagattagggtggggcggccagcttctttgtgcactatgcaaacagcacacctagtcctaaccagttctttgaatgctatgtaaacggcacaccttgtccaaccaatctttcattccctatgtaaattagacaccacctcctcaagcacatctataaaacctcctgcacttcactgcagaccagaagacctgcttgggacctcctctctcttcaggagagagcttttctctttctttcacctattaaacctccatttttaacctctctccttgtgtgtctgtccttgatttccttggcatgggacaaggaaccttgggttttaccccagatgaacgatgccacttcaccactatgttgcccaggctggtctccaactcctgggctcaagcaatgttcccgccttggcttcctgaattgttgggattacaggcgtaaaccgctgttcccagtctgaaaaattttcttcagagagaacaggctttgtcagtggtctacttgaacagtatactaaattcatcaggtttggggatccaaaggaactgtccattatcctcatccatcagcaaaaagaataggccctttggtaaattatttttgtaagtgcttaatcctcaattacttgttgctgggccttgtcatcaccaggaatcattccgtgctttgtgtccttaatgccagcattcacgatttaaaactaagctttctagcacttgcttcactgtttcaaccactttcttcctgggactttcaaattctttgactcctgtgttagttcaagtctacagaaaagtagatgtcaaggactacatgtgaaagaggtttattagagaaggaacagaaggcaggacaaatcttcagactgattgcaggtctgactatggaaggagagagggaaggaaggagggttgggtaggactggactgtagcaaaattcagccaggccacagggagtctttgagccaaaattgcctgttggaggtctgtatgtcaacagaatgggcattcccttaacgcacctcttttattaatctaatcatccgcagtccccattactctagtcctactgttgaaaatcatacaatagtagagaatactgaagccactgttaaaggccctccatagtatcccttcttaattccgattgtccacagcagttaccacgactcctcgtccttctcagctcctcttctattctgtctcaagtaacactgcttgtgttttctgagagaatatggcacctgtaggtcattaatttatctaaaaagaacacgtgtagtcaatttctttcatctaagctaagagcaaaatgtgctttaccagtcttaggaccccatcccttttcctacaaccatgttgatccctctgagctgtatttaaaaatactcctcagctgacttcattcttacactctagttccttttttttttttttttgagacagtctcactctgttacccaggctggagtgcagtggcacgatcactgctcactgcaacttccgcctcctggcatcaagcgaccctcctgcctcaaccttccaagtagctgggattacaggcatgcaccaccatgcctgggtaattttttgtatttttagtaaagatggggtttcgccgtgttggacaggctggtctcgaacttctgacctcaggtgatctgcccgcctcggcctcccaaagtgctggggttacaggcgcgcgccaccatgcctggcccaccctaggaactttttttttgtttgatgggtcttgctttgttacccaggctgcaatgcagggggttcttcacaggtacaataaataatagctccctgcagcctcgaactcttgggctgaagtgatcctctcacctcagcctccgaagttgctgggactacaggaacctgccaccatgcccagctgttttataaaatatttttagaaatgggggtttcaccatgttgcccccaggctagacccatgggctcagttgtcctccctcctccacctcctgagtagctgggactacaggtgcacaccaccattcctggcaagaaaacattcttttttttttttttttttttccgagactgagtcttgctctgtcacccaggctggagtgcagtggtatgatctcggctcactgcaacctctgcctcccaggtccaagcgattctcctgcctcagcctccagagtaactgggattacaggtgcccaccaccacaccaggctaatttttgtacttttagtagagatggggtttcaccgtgttggccaggctggtctcgaactcctgacttcgtgatccgcccgccttggcctcccaaagtgctgggattacaggcgtgagccgctgtgcctggccaagaaaatattcttaattccatttaggttcacataaattccatttaggttcatatccaacttcagatgaattttcttgatagaacaaatgtgcagacttttcagtaatacagactgaattattcaccaaaactatattgacgctacatgacagaactaaaaaggagtaaattagggtcagtttaatgtttcattaggtatttagagaccaaaagaaaccacaaaatcttcttatttaaaatattttaatttctaaaaagcttaaatcatattaaaatttaaacaatttcattgtacagtacttgacaatacatttcaacaaactgaaaggcaaaccagtaaatcagttttgcttactttctaagcttaataatgtacagactcttgctcttcaagaagatgcaaaaatcagcaacagtacaagtgaaatatttaaataggaatctgaaacaaaacgaattcaatctgatcaaatccacaattaattgaagttttcattttattcaattgtgaataaaatagcagacactgtttcatccaataagccaatgatatcagcttaggagaaatgatctgcctggcttgtgcaagacaagaacagttaccttctgctgaaaggatgtgagttttcaaatttggttttcatgtcatagtttccaaataaatgaaccgctccaccaaaaacgacagtctagttgctacctatcttccagggtttcatcatacagccatttataagcacaatctttggaacgctctatagtttcaaaaagtgttttgaagtcttgagggtgcatgttaactactttctcatcctcctgttttcctatttgcatcaatatatctctcgcatcaagtggagtcaatgaactgcaaaagaaatacaaagtaaatgtacttaattctttctcatgcatctatcagttcacggtgacagaaatggcttctaagttgaattcaaaatgtctaacttaggcatacagagtgctataatggacacgggagaatcagcagggaagaggatgggaggagggtgaaggatgggaggagggtgaaggataaaaagctacctactgggtacaatgtacactatttgggcatgggtacactaaaagcccagacttcaacaatccatccatgaaaccaaaaaaatcacttgtattcctaaggctattgaaataagaagaaaaaaaaaagcctaacttattatatataagcaatcttatttagtttaagagcttccagtaactttatgcttatttctaaagtttcatagctaacctataatgaaaatattaatagcaggtttaggctttcacatactctaatcaatttttacaccgaattctagtttaatcactgccgtttgaaaaaattattatgcctacctctttcatccttttcctttctgcaaaaaatattcttaacttcttttggttcatgtcaaagttcagtaactataaacagcagaagttgctgtttggcagtttacaaagagggaatcatttttcacattttgatgtaaccatcattggtaaatacattataaagccgcaaacttccttatacagtcatgcattgcttaatgatggaggtatgtcctgagaaatgcactgttaggtgatttcattgttgcttgaacatcttacagagtacttaacccaaacctatgtgatatagcctattacagacttaggatatatggcatagcctattgctccaaggatacaaacctgcacagcatgttactgtactgaatactgtaggcaactgtaacacaatggtaagtaatagaaaagatacagtaaaagatacagcatctttataatcttatgggaccactattgtacatttggtccactactgactgaaacgaggtataacgaacacgcctcattatgaggtattatatatataaggtatattatataatatatatacaatatataatcaatgaggtatattatataccataatatgaggtacataactgtgtatcagcttagcaacaaaccatcaataagcctccaacaacaacaattgtaaaaaaatattttgggctgggtgcggtggctcctacctgttatcccagcactttggggggctaggtgggaggatcatttgagcccaagagttcaagactatcctgagcaacatagtgagaccccatctctacaaaaatcgtaaaaagttagctgggcatagtggtgggcatagtagtcccagctactcagggaagaggctgaggcaggatcacttgagcaaggggtttgtggttgcagtgagctatgattgtgccactgtactccagactgggcaacagagtgagactctctgtctgttcaattccaatactttttgatattgaatagaatcttggtaacatgtttctagtccactgagattaccaggagcatttttaatattttgcactatgatttacaacatttattccttatttccctattttcttgatattttcattcaaaatagccacaaggtggcaagatgaaaaataatagattgccttttattagtctattgccttttactagtctattaccacttttttttttttttttttttagagatagagtcttgctctgtcacccaggctcatctcaaagtcttgttggcgctctctgcctcccaattttttttttttttttttttttagagacaaggtcagcttgctctgtgtcccacactgcaatgcagtggtgagtttatggctcactacagcctccaatccccggcctcctcaagtgatcctcccaccttggcctcacaaaaatgctcggattacaggcatgaaccactgcacccaggctattgccacttttaacatttatttttagataaatattgtctagtcaacagctcattcagagttaaatattaaatgatcaaatttgttaaaataattattttaacattttacccatcctctggcgagactttgaatgactatgggctgctgattacaaggcataatgcacaacttacagggacgtatgcatcagccctacatacaaattacatggatttatgtacaaattacacagatggctgggcgcgggagctcatgcctgtaaccccaacactacttacagagatgtatgcatcatccctacatacaaattacatagatggccaggcgcagtggctcatgctggtaacctgagctgtacttacagaagtgtgggcatcaggcctacacacaaattacatggatggccaggcatggtggctcccgcctgtaaccccagcactacttacagaggtgtgtgcatcagccctacatacaaattacatggatggccaggtgcagtggctcatgcctgtaaccccagcactttgggaggccaagcaaggtggattgcttgaggccaggaatttgagaccagcctgggcaaggtggcaaaaccccatctctacaaaaattggcatacaatttataaacacaaaatataaatataaaaattttatatttttacaaatataaaaattagccgggcgtggtggtgcatgcttgtagtcccagctactcaggaggctgaggtgggaggatcacttgagcctgggaggacaaggctgcagtgagctgagactgtgccactacacttcagcctggacaacacagcgagaccctgtctctaacaacaacaaaaaaatgtttttcacttatatagacataaagcaagtagtgttacttacaagctattatttttacaaagctttgggtaaaaacaaaatttgatccagagcaagggaaccagggtggtataattatctatccctactctggttaaggaacagaaccactgaagacaagcaatgagaggtaagtgtgggcacgcctccagtaatgctgatttctctccaccccactagtggtaggcagctagtgcttcctgtaagataaagctaagcccatactctcaaaaagattaaacaatctgggcatttttttaaagaaggaaaaataaatgaaactcaatgagagattatgggaaaaatatattttcctcaaaatgtacaccagggagaacaaattattttgaagaaatatgagggaaaacatggtacctcactctgtcaatcaagatataaaaatagatctctagcatgaaagaataatttgtgcatcgttgctactttatacttgcttttattctttttactcaccgtaagtggtctattacagtggcgctgcgcctcccaaaacagtgctttaacaagtgaaaaaatatattatagttcataggtgttaagttcttggtaaataaattttgacgaggaatcatttgaataagatacagcttttgttgtaattggtctaataattcctggagagaagaaaaaatgaattgcattagtcacaaaatattgccagagtaagacattgctcacttcttccttcaagctatctgctgaaagacacaatcaccacaggccctgagtgtcttcacattctctttttctttcttggagatagagtctcactctgtcgcccaggctggagtacaacggcgtgatctccactcactgaaagctccatctcccgggttcatgccattctcctgcctcagcctcccgagtagctgggactacaggcgcccaccaccacgcctggctaattttttgtatttttagtagagatggggtttcaccgtgttagccaggatggtctcgatctcctgacctcgtgatccgcccgcctcggcctccccaaagtgctgggattacaggcgtgagccaccgtgcccggcccacattttcttattgtgtacaccaagaacacaaagccctaattggtctttaccaatgaattgggccatttctcagagttgtttgtgatgagtaaccttgagggaggagataacgtctctctccaggacaaagagcaggcctgtggctgggtgcagtggctcatgcccatgatcccagcactttgggaggccaaggcgtggatcactcgaggtcaggagttcaagaccagcctggacaacgtggcaaaaccccatctctataaaaaataaattagctgggtgtggtggtgtgtgcctgtagtcccagctactcgggaggctgaggtgggaggatggcttgagcccaggaggtggaggctgagagcatgccactgcactcaaggctggttgacagagccaggccttctcttaaaaaaacaaaagggcaggcttgcttaatgtttgctatgaaggaggaggattcattgggaggctgaggtgggcagatcgcttgagcccaggagttcaagactagcctggacaacatggcgaaaccctgtctctacaaacagtacaaaaattggcagggtatggtggtgcatgcctgtagccccagctacttaggaggctcagatgggaggatgcttgagactgctgcgtggagtttgcagtgagccgagattacgccattgcactccagcccgggtgacagagcaagaccctgattcgaaaaaaaaaaaaaaaaaaaaaagacctagattcccccagctctgtacttctcagctgcaaagcaagtccactaaatgcaaggcacccaactgagccacctcacatcactccatgggaagagaggcacagaacatcctctgtctgatccaggagtcttaggccaacatccgagaaacagtaacatttattaacatgtaagtagggtaaaatcaaatcccagacatgaggccgggttgctcacacctacaatccaacactttgggaggccgaggcaggaggatcgctggagcccaagagttagcgaccagcctgggcaacacagggagactccttctttacaaacaaacaaactagctgggcgtgggatgcacatctgtggtcccagctatttgggaggttgaggtgggaggatcacttgagtcccgggagtttgaggctgcagtaagccgtgattatgccactgcactccagcctgggagaagagtgagacactgtcttttaaaaaaagaaaaaaaaataggctgggcgtggcggctcacgcctgtaatcccagcactttgggaagccaaggtaggcggatcacctgaggtcaggagtttgagaccagcctggccaacgtggttgaaaccccatctttactaaaaatacaaaaattagccctgcgtggtggagcatgcctgtaatcccagcattcgggagggtgaggcaggagaaacacttgaactcgggaggtaggggttgcaatgagccaagatcatgccatcgcactccagcctgggtgacagaatgagactttgcctcaaaaaaataaataaataaaaaataaaaaaaggaaaaaaaaaaaaacccaaacatggcattaacatatattgagtccttgctatattcaagataaaacatcaccatcggatccaaaggacaaaaaaagttattgactaaaatttttaatcggatatttaaaaagtaggtctcaaacaaaacttggatagaaatgacaggccctaaaaacctgttaaatgtctcaaactgcttccatagcaatatgagcaccttgatatcaaagacacatgtgaaatatctaaaataaattctgtcataaaatatgacatttgcttatttcatcttcatccctaaaagtttatatatgtatatatacacacacacacacacattttttttttttttttttgagacaaagtctcactctgttatccaggctggagtgcaatggcatagtctcagctcactgcaaactctgcctcccaggttcaactgattctcccacctcagcctcctgagtagctgggactacaggcgcacgccaccacacccagctaattcttgtatttttagcagagatggggtttcagcacgttggccaggctggtctcagactcttgacctcgtgatccacccacctcggcctcccaaagtgctgggattacaggtgtgagccaccacgtccggccaagtttatatttttaagttggccaaaaaaacttaagcttttcagcttcttgctgaaaaactgagaaagtatattatatacaggattgttcatttgtggaatatttggataagtccccaatagtatccaaatgtactgtattagacaaaatgcattattcctattctgttttttgggactacataaatatgctgtataaatagtcaaacagaactaaaagcacaatgatgactgatcactctaaaatcacaacattgaaagaaaactgataattttctttttcctttagtggcaagtgtgagaaaaaaacataagtaagcaaacaaacaagatcttcagactaagctgttatgctgagattaggccattgttagcatttaattcgttttttttttttttaagccccaaaccttaaagacaggcatctaattctaaagtgaaacttctgaattgagtcaaaaaattgttttgtgaaactttagctactttattagaatttcacaactagccctgagataaactaaatggaggactataacattgtcactttggttcttacgtacaaagattaaaaaatgaacaaaaataaaggcctaactcctgggtaaaaatcaagaagtacctatcagtgaattcaaccatgtaataagagtagtaatatcacaatttttttttttttttttttgagacagagtctcgctctgttgtcaggctagagtgcagtggcacgatcttggctcactgcaacctctgtctgccaggttcaagtgattcttctgcttcagcgtcctgaatagctggaattacaggcatgcgccaccacacccagctaagttttgtatttttaatagaggcggggtttcaccatgttggccagggtggtcccgatctcttgaccttgaatatcacaaatttctaatcgattaatacgtcataaaattttgtttctaattaatcgaattagataaatattaaaatgattttattttccaaatttgaaatgtaccttcatttcaaaagatataagaagagaactcagattctgtttttaagcctattactatgctagcatccattgtataacagctgataactcttccaaaatacttttgattcattaaaagtagtaagatatgtttaaagaatgtttctagatattttaaaattaaaaagttaaatacagactaccaaatagtcctaaaaaaataaaataaaaaatacgtcacgtagggagaaaaaggaaaaggtattattttattcttaccctacgctttgggttttccagcggccctttccgggtgtatatatcaaatgatgaccaaggctcctggggaagaaaaacaaagcaaaacaacatcttttatttctctttggtcaaagtgccccagttattacttccttaaaaaacaccttgcctaaataagagaatggtcagtctaattggatttaaaagaaacatgttatagctaaataatacacatctctctccttaatttttttaaagaggaggaggatcaaaagtctacccaaatactagtacctcttttccttattaaacatgacttcgcctgttatgcaattacgcaaataagtatttgttataatttttaccactcaatatttccatatcacagtcagaatcagcagtttaagggatattagattaatgctgaggatttctttttgccctacttcagtggaaaagcctactaatcaaactatttgaatatgttagaacatatatggaaataaacaaataaagatactagtgtcgaccaggtgctgtggttcatgcctataatcccagcactttgggaggccaaagtgggagggttgcttgagcctgggagctggagtttgcagtaagccactgtactccagcctgggaaacagagtgagaccctatccaaaaacaacaataacaaaaacctagtgtcaattttaaaatggatcactatttttcggtatctatcttttgtaagagaattttgtgcataaggcaattttaagagatgatccggtcaggcacagtggctcatgcctgtaatcccagcactttgggaggctgagggaggaggaccgcttgagctcaggggttcaaggccagcctgggcaacatggtgaaaccctgtctcttcaacaaatacaaaaattagctgggtgtggtggtgtatgcctgcagtcccagctctttgggaggctgaggcgggaggattgcttaagcctgggaggcggaggttgcagtgagccgggattgtgctggtgcactccaacctgggctgacagagtgagatcgtgtctcaaaataaaaaaccgacccacctgaaaaagtattctctattaaaaaaactatacatacccataaccatattaaattccaaaataagagtgggttaaaatagatctgacataggcttaaaagactaaacaatattgaacacaaggtctgaaaggctactgtcaagtaacaatttattattaactgcaggggcaatgagagtggctaaaacatataattgtggccaaattgtgaaattcctagcagttccaggaatgtcactttaagtgggggaagaaaagcaccatcagccgtgcacaatgagtactgccacttcccacacgcctggtcgagcctcaacagctttcccctcatcaagcacagtggaggaaaacctgcaagacactgggaattgacttcaacaacttactctacagatgtagacacacagtggagcaagtgctgagaaacgttaggtccagaaagacctttcctttctggagtttagtaaatggcaaaacctaacacgggacctttgaaagcaaatactaagggaacaagaagacgaaaacattctgcaagctaaagtcctcagagggcctctctgaagaaactagctgaaagctaccaggacagaagacttgagatgaaagtcaacagaatgagacaagatcagtgggtaaggaagaattttagagaaaccaagaactatagtactgagagtacaatatacagtgcaggcagaaagcagaatcagtgatgtgaagactaagtgtgaagagattctgggaatggagaaaaatgatgagagcatgacagacacgaaagacaaggatcagagatccaacctaagaacctcaaatgtttttgaggggaaaaaaaaagaattggaacaaaagctaaaatcaaatgagataacattcctgagcttaaaaaaaaaatacagcaaggtgcagactgaagacctcagcatattctcaggcggaagcagtgacgagaacacgtgaagatccacattgtaaatatttaaaaattagagccagggccaggcgcagtggctcacgcctgtaatcccagcactttaagaggctgaggcgggtagatcacctgaggtcaggagctcaaggccagcctggccaatgtggtgaaacctgtctctaccgaaaatacaaaaattagcaaggtgtggcggtgcacgcctgtagtcccagctactcgggaggccgaggcaggggaattgcttgaatacaggatgtagaggttgcagtgagccgagatcgaaccactgctccccagcctgggtgacttgagtgagactccatctcaaaaaataaaaaaataaaaaatagagccaggtgcagtgggtcatgcctgtaatcccagtgatctgggaggctaaggcagaaggatcacttgaggccaggagttcaagaccaggctgggcaatattcttaaacattttaaaacttagccaggcatggtggcgcctggctgtagtcccagctactccagaggctaaggtgagaggatcacttgagtccagtagttcaaggctgcagcaagctatgattgtgccactgcactccagcctgggcaacataatgagaccctgtcgctaaagaaaaacgtttttaaacagaaggattttactcaccatgtgcagaaccttaatctcacaagctaattgccagataacacttaatacatgatacaagtctggatttccgggatctgccattagtttctagtaaaaggaaaataaaaattacatgttatacacatctataatcaattaaaaacaaatgctgactcttaataggactatcttaatggcatctagacatttaagaaaagaaaactagaattagatgcaaaaagccgggtgcagcggtgcacgcctgtagtcccagctactcgaaaggctgaggcaaggggactgcttgagcccaggcatttgggcgttccgtgtgagatgatcgtgcctgtgaatagccacagcactccggcaggggcaacggcagggcacgcggggtcacgcttgtaattccagcactttgggaggccaaggtgggaggatgcttgagcctagaagttcaagaccagcctgggcaacatagtgagaccgcatctcttaaaaaacaacaacacacaagtgttaaggctgacttgaaaggacgaggttacctcaacgaatgggaaggcactccgcagacaagaaaccacatgtgaaaaggtccacggcaaaagaggcatgggccagtggaatataaccctagcagcaggaatctaacacagcacttcctattcttctccttgtctttcctttgttgaatagcgtatgcacagccccaaggtcctgaggccctcgctgtctttccatggctagcaaatatgtatttactaaatgggtctgggggagcaaatcatcccttcattttttgccccactatcctaatccatagcaatacaaataagcattataaaaatcttaatcttctttgagtcttaatagtactatcttaatagcatctagaaatttaagcagagaaaactagaattagatacaaaaagctgggtgcagtggtgtgcacatgtagtcccagctactcgaaaggctgaggcaaggggactgcttgagtctaggagtttgggggttcagtgtgagatgaccgtgcctgtgaaaagccatagcactccagcatgggcaacacagcaagacaaacaagcatttcccgtcaaactggattaacagatcaataacatgaaacattctgggcagaaaagaaagatgacactcatagcgagatcaaggttgtcaggaagaccttccattacagagaattgaactagagtctcaaatcttaggctcggtgtaatggctcacaactgtaatcctagcactttgggaggccgaggcaggagaatcacttgaagacaggagttcaagaccaccctgaacaacacagcatgaccctgtcactacaaaaataaactacctgggtgtggtggtgtgcacaggtggtcccagctacagggaggctgaggcaggagtgtcacttgagcccaggagtttgaggctgcagtgagctatgaacataccacgacattcaagcctgggcaacagagcaagaccctgtctctaaaaaaatttcttttaatgttttaaagttaaaaaaaataattataataccccttaaatattaaaaaaaaatcctgttaaaactaataaattcagctgagtatggtagctcacacttgtaatcccagcattttgggaggccgagggaggaggatcacttaagcccaggtgtttgagaccagcctgggcaacaaagtgagacactgtctctatttaaaaacaaagggagggaaaaaaaacctggctgggcgctgtggctcatacctgtaatcccagcactttgggaggctgaggcaggcggatcatgaggtcaccagtttgagactagcctgaccaacatggtgaaaccccatctgtactaaaaatacaaaaaaagtagctgggcatggtggcgcgtgcctgtaatcccagctattcaggaggctgaggcaggagaatcacttaaactgggaggcggaggttgcagtgagccgggattgcgccactgcactccagcctgggcgacagagcaagactccgtctaaaaaaaacaaaacaaaacaaaaaacctaataaattcagcaaagctgcaggatacaaaaatcagttgcatttttatgcactaccaacggacaattcgaaaaacaattccatttacaatagcaccaaaagtaacttaaaagctagtaattaaaaacacaaataaatggaggccaggcacagtggctcacacctgcaatcccagcacctcaggagactgaggtagaaggatcacttgaacccagaagttcaagaccagcctgagcaacgtggtaaaaccatctctacaaaaaagacaataatcagccaggcacgggggtgcacgcctgtagtcccacctactggggaggttgaggtggaagcatcacctgagcctgggaggtcaaggcttcagtgagctgtgatcctgccactgcactccagcctgggcgacagtgagaccctgtgtcaaacaaaaatgaaaacaacaacaacaacaaaacccacaaataaatggaaagacatttcatgttcgtggattggaagatttaatattgaatactgttaagatgccactaccacccaaagcaatctccagattcaacgcaatccctaggaaaatcctaacgcattttggagaaacagaaaaatccagcctaaaatccatatagaatctcgaggaaactcaaatagcctaaacaatcattaaaaagaataaatttggatgaatcagcccctgatttcaaaacttaccaaggtaacagtagcaacacagtgttgtcttggcctaaggacaaatatttagatcaatagaatacaatagagcccagaaataaacgcgtacacatatggtcaaatcatttctgacaccaacgccaaagccatttaatggcagtaaagaacagtctttccacaaacggtgctgggaaaactagatcaaagaatgaagctggacactgaaaccataagcaaaatttactgaaaatggatcaaagacctaaacaagagccaaaactataaaactcttagaagaaaacacaaggaaaccttcacaacactggatttggcaatgatctattagctacgacacaggtccccaatccccgggccacgaactgataccagtccgtgtcctgttagaaactgggccacacagcaggaagtgagcggcaggtgaacaggcgaggcgtcatccgtatttatagccgctccccaccgttcacatcaccgcctgagctccacctcctctcagatcagcagccgccttagattctcataggaacacaatccctattgcgcatgcgaaggatctgggttttgcaagggccttatgagaatctaatcccgatgatctgtcactatctcctgtcacccgcaagtaggaccatctagtttcaggaaaactagctcagtgttcccactgattctacattatggtgagttgtataattatttcattatatattacaatgtaataataatagaaataaagtgcacaataaatgtgatgcacttgaatcatcctgaaaccatccccgccgccatccacgtaaaaactgtcttccacaaaactggtccctggtgccaaagatgttggggaccgcccagctacgtatgataccaaaggcacaggcaacaaaagagaaaaaaagacaaagttgacttcatcaaaatgaaaaactttgggcatcaaaggacacaattaacagggttaaaaggcaacccatagaatgggagaaaatatttgtaaatcatgtatgataagagattaatatccagaatatataaagaactcttaaaactcagcaacaaacaaaataacccattaaaaatgggcaaatgtcttgaacagacatttcttaaaagatatacagtcagtacgtacataaaaatatattcaacatgactaattattaggaaaatgcaaatcaaaagcacaatgaaataccacttcataccattaggagaggtattaccaaaaacccagaaaacgactctcagtaatgctgtggagaaatcggaacccttgtgcactgctggtaggaatatcaaatggtgcatccacgacggataacaaacagtatggcagttcctcaaaaaactaaaaatagactgggtacagtggctcatgcctgtagtcccaacactttaggaggctgaggcaggaggactgcttgagtcccagagttggaggccagcctgagcaacatggcaagaccctatcgctacaaaaagctgggcctggtggtgtgtggctgcagtcccagcttgggggctgaggcgggaagatcgcttgagcccaggaggtccaggttgcagagagctgtgatcatgtcactgcactccagcctgggcaacagggcaagaccctgtctcaaaaaacaaacaaacaatcaaacaaaaaacaaaaaacccacaaaaaactaaaaatagaattactatatgatcctgcaattctacttctagctgtacactcaaaggacttgaagagatattggtaaactcatgttcattgcagcattattcccaacagccaaaaggtaaaagcaaccaaatgtcattgatacatcaacacacaaactgtagtatatatatacaatagattttttttttgagacaaagtcttgctctgttgcccaggctggagtgcaggggcatgatctgggcttatagcaacctcctcctcccaggttcaagtgattctcctgttttagcctcccaagtagctgggattacaggcatgcaccaccacgcctggctaatttttgtatttttagtagagacagggttttgccatgttagccaaactggtctcgaactcctgacctcaagcgatcagcatgccttggcctcccagagtgctgggattacaggagtgagccaccgtgcccggccagaatggaatattattcagccttaaagaggaatgaaattctgacacatgctataacattgatgaaccttgaaaacattatgctaagtgaaatacgccagacacaaagaaatattgtagagtaaacttacatgaggtaaagagaatagtctaattcatagagacagaaagtagaataatgattactaggggacgcaggaagagggaaacgagagtttgtgtttaatgagtacagagttttggtatgggatgatgaaaagttttggagacagatgatggtaatggctgtacaatgggaatgcagttaaaaccactcaactgtacactgaaaaagcaacctgagcataagactgctctgcagaatttaaaaacaatcttagaccctcaaatgtcacgagccctaaattaaaatcgcacagattaagagtactcagagaaaaattacagactcagaacaaaaaataggtatttgttaataacatacctggaattctttttcaccaataaacatatttacttctattcgtccaaatttatatatagaagtacaggaatacaagtcatatgcgagtttccaaagtgcccttttctcacctctacttgggaacattccaactacttttaaagggatgtctgttaggaatataagcaaaaagatttgaataaagttcttagcattttgtcctatgtccatatttttttgagacaaactaagttaacaaactatattaatttcaagtttatttcaattaaaactaagcctcaatatctttccttggcatgaaacttggcttttggggaaataaactgggtacctgtgtccaggtgaggtaaatgccatattcagagtcagagcatctgctcataaactgtattaatataatataaattatacacaaattcggcggggtacggtggctcacatctgtaatcccagcactttgggaggtcgaagcgggcagatcacttgagggctggagtttgagaccagcctggccaacatggtgaaaccccgtctctaccaaaaatacaaaaaaataaccaggtgtggtgacacacacttgtaatcccagctactagggaggctgaagcaggagaatcacatgaacctggaggcagagggtcagtgaaccaggatcgcgccactgcactccagcctgggtgacagagtgagactccatctcagaaaacaaacaaataaataaaacacaaatttcatcaacaaatcagttatactgctagagacacctggcaaattctaggtatttgctttagtaaattccaaaaatgacctgctgtccaaggaactgcttctattcccaaattcttaaagagccctcgagaagacatagcaggtggttttattactccaccacttctaggatctagtttaaagaagtcacagtggatcactcgtagttttccatccagattttttcctaaggactaaagagagacaaagataacacgttaaaaattttcagcattaagtatactttgcagcaattcaaaaaactctacttcaaaaaaccataataaaatgtaaaaataaaaataattcaattacctggggtttttttgttttgttttgttttgtttttgagagacagagtctcgctctgttgccaggctggagtgcagtggcgccatctcggctcactgcaacctctgcctcctgggttcaagtgatcctgtgccagcctcccaagtagctgggactacaggtgcgtgccaccacacccagccagttttttgtatttttagtagagatggggtttcaccatgttggccaggagagcctcaatctcttgacctcatgatacgtccaccttggcctcccaaagtgctgggattacaggcgtgagccaccacgcccggctgaattacctttttacaaaaaatatttctacctccataactatgtaaagaaaatattactaacatacccaaaatttaacagaggaagtaaaaatcaattaatacctgaaaagtggcaaaagtacaatattaccaagaaaaagccccccaaacagaaataaactatcataaatttttctttatctgtttactttttttttttttttgagacaagctgtcaaccaggcaggagtgcagtggcgcaatcccagctgactgcagccttgacctcctgggcttaagtgatccttccacctcagtcccacaagcagctaggactacaggtgcataccatcacgccccaccaatttttggattttttgtagcaacagggttttgccatgttgcccaggttggtctcaaactcctgagctcaagagatctgcccaccttgacctcccaaagtgctgggattacaggtgtgagccactgcacccggccccacttactttctttatcataatggcttcagctattcaaaagcttttcacaccactccctgcctgcttagtagtggttacctgaagcactgggcaaagattctgacaccatggttggcctcttacagagaactgtgagccatctgctttggtcatgggaagaaaaaatgaaagatgtttcacagtaaagaaaaacaattaaaatataaaagtgaaaggcagatggattcaagagaatatctttcttctaggggaatctagtcagctatccaccaaataaatgaacttagctcatctccataattttcatttactttttctaaagacagaagcaactatacaccttgtttgctggaagaggtctaatatatctcagtcttctcactgctctgatttgctcatcttgcagtagtactagagaccttcatagttagggcaagaatcagttatagactccataaacttaattcgaagttacaaaaaaaaaaatcagtaagaaggcattatgtttttaatgtgtacactgatgtttctgtgcacagaaaattctattaatatttattaaggttggaaatgatgtaacttaaagttattaatgcaaacacctattttttcttaagcatttgtattcaacctatattatcctatttctaaatctagtaaaatactttttcttcttattttttattgagatgagtctcactatgtccccaggctggtctccaactcctggccttaagtgatgctcctgtctcagcctcctaagtgtctgggattacaggtgtgtgataccgtgtccagctcaaaatgtagtaaattttggccgggtgcagtggctcacacgtgtaataccagcactttgggaggccaaagagggcggatcacacaaggtcaggagtttgagatgagcacggccaacatggtgaaaccctgtctctactaaaaatacaaaagtaagccaggggtggtggcacacccctgtaactccagctattggggaggtgaagtgggagaaatcgcttgaacccaggaggcaggggttgcagagagctgagattgcaccactgcactctagtcagggtgacagagtgagactccatctccaaagtaaataaacaaacaaatctagtacattttaacaatcactttcaaggggaagttttaaaaagactagaggaagggaaagactgggggtggaaatcatacacatttggtcacattaatttcgagatgcctactatgtgatctaggtagaggtgccaggtaggaagttgcagacctgaataaggtgctcagtggagtggtccagtctgacgatataaatgtgtgggaatttggcttgttgaaggtaatttaagtcaggggtctacactagggagaaacagaggactagccctgaaggtagagtatgtccaaagtctaatgacaagaaactgagaatacaactaaggaggaaaaccagaagagtgtggtgtcatggaagctaaaagaaagagtacctacctaatgcatacgattgtcagtcaacacgcatggcaaggctgtctaacctgtggcctgagggccgcatacagcccaggacggctttgaatgtggcccaacacacatttgtcatctttcttaaaacattatgagatgtatgcatggactttttttttttttaagctcatcagccactgttcttattactgtattttatgtatggcccagacagttgatgtttcagggtggcctaggcaaaccaaaagattggacacccctgatatagcattaacataatctttcaagttatcaaaaaggcagtttaatctttgtaattaaggaaagctaaacagcacaggtgtggtggctcatgcttgtagtcccaggagtttgagaccagcctggacaacatgacaaaaccctgtctctactaataatacaaaaaatcagccaggtgtgggggcgtgtgcctgtaatcccagttgcttgggaggctgaggtgggagaatcacctgagcctgggaagttgagactgtagtgagctgtgactgcagcactgcactccagcctgggcaatgggagtgagaccctgtctcaaaaaagaaaaagaaaatgtataaacaatgaacactttatggcctcaatacacttgtatgttctgagagggcaccatacattcttgctttagcacttgtcagttaacactcaacaattcaaacatgataataatcaaagcttcaggataaataattcaattcatacaacagatcacatttaaaaattcaactggattgcattaggattcaaaaacagaatgggaaaaaacagagaaaaggcaagtaacccttgagtttttactagtcattaagttaggtacttaagttagtcattaagtttgtctcatttactgggtgcagtgggtcaagcctgtaatcctagcactttggaggctgaggcgggcggatcacgaggtcaggagttccagaccagtctggccaacatggtaaaaccacgtctctactaaaaatacaaaaaattcgtcggtcgtggtggcggtcacctgtaatcccagctctcaccactgaaactcctttcagttttcaggaacaaactttaggtggccagaagcattatccgctaagcgcagcactttaagtccctgacttagagccacaagagttctgcttacctattgttacttctcttttcactctggcaaacagattaattcacacaaaattttatttgaatggcttttcaatttatcataacaatggttactaaaaagtgagagaatatgtactaagggttgagtacaagtcagtgctagtagaaaataagagccttaatagagaaaaaactagttctaatcaaagactggatttagtcaatgatgtttatatttttagctgacatttatagcttcagaaacattttgttattgatattcctatcataattattgtttcaaaaattctctagtccctaaccttccttttttcattaaacaattgttttaaaattaaactgttatcttgaaggttttttttttcttttgagactgagttttgctcctgtagcccaggctggagtgtaatggcacgatctcggctcactgcaacctccacctaccgggttcaagtgattctcctgcctcagcctcccaagtaactgggattacaggcatgaaccaccatgcccagctaattttttgtatttttagtagagatggggtttcactatgttggccaggctggtcttgaactcctgacctcaagtgacctgcccgccttggcctcccaaagtgctgggattacaggcatgggcctcggtcctcagccttgaagatcttatagaaaaaagcaactactgtgttacagaataacaaactttaaatagaaacaaagacattttaatacaatcttaattactttgtgaatatgtagattaacctttaaatataggcttttttttttcctcaaatcaggataaaagttatcttctcatttttaatttccaagttgaaactacagatgactatgtttactgaatcacatttcaggatcttaaatcttcggacaattatgtgttttttcttcacatttttggaactccctcagatttaacatcaattaaataacctagctaaaaccttgaactcttttcaaaacagtaagtggtagaataacaataatttcatactcatagttttaaaagaattaaacaactggatttgacagacattttcacaattttttgttgtcatgcaattttggatacagccattctgcatggtttcacaaagttggcatagagaaatataagtttcctaagttgaaacggaagattataaaagagggaaggagaatgagagtaagagactggttaaagacccaaaggatttccacttcttcattgttacgtaaatgtgtctgctttttaagaagcacaatcactgaaaaatctatttggatgatgccttcactctatgcaactgtatctgactacaggctgagcatccttaatccaaaaattctgaaatgctccaaaatgtgaaactttttgagtgtcaacatgaagccaaaagtggaaaatttgacacccgaccttctgtgacaggcttgcagtgaaaatgcaggtatacaacacgaagatgaggtcagtctataaaaatcgaagggagtcatctaagacaaaaaccactgttaataaggcagatgactccatagggaacttttttttttttttgagacaaagagtgtagctcagtcgcccaggctgcagtgcagtggtgtgatctcagctcactgcaatctctgagtcccgggttcaagcgattctcctgcctcagcctcccgagtagctgggactacaggcatgcgccaccacgcccagctaagttttgtatttttagtagagacggggtttcaccatgttggtcaggatggtctcaatctcttaacctagtgatccgcccgcctctgcctcccgaagtgctgggatgacaggtgtgagccaccgcgcccggcccacaggaaacatttttaaaagccggccggcagaatgtctccttagccttgacggacccgcttcctggtccctcagctgcttctgatgtttcttcttaagaaaaaataaaatgtggtgtacagtaacctttcaatgaaaacacagcatcccaggagactgaaagcctgccgctgtgtgtttccactgttcaacagctgacacagggattctgatgctgctgtgctgcttagtttctctgaacacactttttttttttttttttactgtactaatggtatgtcattttttctactgttaagcactcatgtgtgaataagtgtaagaaaatgatggcttatcagaagcatataaattcggagtcaggagctaggcatggtggctcacgcctgtaatcccagcactttgggaggccaaggtgggtggatcacctgaggtcagcagttcaagaccagcctggccaacatggtgaaaccccgtcactactaaaaatacaaaagtcagctgggcatagtggcgggcgcctgtaatcccagctacttgggaggctgaggcaggagaatcgcttaaacttgggaggcagtggttacagtgagccgagatcgcaccattgcactccagcctgggtgacaagagagaaactccatcttaaaaaaaaaaaaaaagtcagggatgatgacgatgtcaaacaaggagattgttcacatgggtgggtgacatagtgacacctttgctttctgatggtccaatgtacacaaattttgtttaatgcacaaaattatttaaaatattatacagaattgcctttaggccttatgaataagatgtatatggaacaaaaaaggaatttttagactcgggtcccatccccaagatatctcattatgtatatgcaaatattgcaaaatatgaaaaaatttgaaatccaaaacagttgtgttcccaagcatttcagataaaatacttaatttgtatgccaacctttcttgcctttcaaaccctaaatatagaggttacacagatccattaacctaatattagcacttattccaattagattccaagctcacagaagaaaggagcacagcgcagcttagtagaaatggggaaacaagcctagggatgccagttatacgctttgttcaaagtcacccaactaggctgtagccgacctagaactagcaaacaagtcttagaactcctcatgtttcagccattcaacagcactgaatattaactgtgttctagtctttgggaataaacaagatatttcagagatggctccctaaaagatattctatgtaaaacactgtgtgcttaattccatttccttaaaccactcacagatagttgaacaaacaataacatacgttgagaaactaaaaatatacctccaaatgtggaataaaagttttgtcactttcgagcgcaaccactttggcaccagcttcaagtaatgcctgagtcaggattccaggacctggcacattaacagaacgaaaagtttatttgtacaagaaacataatctctttcaataccaaactttcattagatgtttcacacgttattacctggtttttaaatctgacagcatccgcaaagtagatgtcactctcctttttacatataaggaaacaggagattatatatacttatttgactccagcgtcaaaagtgatgcagcttggctttgaaatcattgtcagcgactgcaaaacctgcactcttttttttttttttttgagacgaagtctcactctgtcacccaggctggagtgcagtggggcaatctcggctcactgcaacctctgcctcttgggttcaagcgattctcctgcctcagcctcccgagtagctgggattacaggcgcccgccaccacgcccggctaatttttgtattttaagcagagacggagtttcaccatgttggccaggctggtctggaactcctgacctcaagggaaccactcgcctcggcctctgaaagtgctggattacaggcgtgagccaccgcaccaggtcaaaacttgcactcttcatcaccatgattcactacctcttagaagaaaaaagtcacagcaaaatagattgcctctagcctatcacttcctcacggactacacggatgctttaaccatcaaagagattgtcaagcctaaacagaactgactccctgtgatatgaaatggtgctttaaaaaactatcattcaaaaagcctataaatcttgtgttcttagcatcctgctatggtctatagggaatgcacggaagaataagataacatcattttttcagctggcagaggcttgcaactcttttggggagataagatctaagagcatgttttatcaaaatattgtgtaaagtgcaagctgctacagaaatactttgtggtgtcattaacgatacagactctacgcttatgtagtgggcaatctctccaactaaggagcttcaaacaaagacccgtatctggacgggcgcagtggctcacgcctctaatcccagcattttgggagacctaggggggaggatcacgaggtcaagagatcgagaccatcctggccaacacggcgaaatcccgtctctagtaaaaataagaaaattagctgggcgtggtggcgcgcgcctgtagttcttgctactcgggaggctgaggcaggagaatcgcctgaacccggtacgcggaggttgcagggagccgagatcgccccactgcactccagcctggcaacacagcgagactccgtctcaaagcaaaagaacaacaaaaaagaccccccagtatctaaaatagcaccccgaggagggtcaatacgtttgaataaatgatgaacatccaagaaaatgcaattcagctggactcacctggattgcactccagcagtaggtgtggaggtctacttggttttcccaaatagatttgcgccagggtctcagccaatctccgatcggttacgtaacgcttaaagtctaagctggccttagacgccttccttggcggattcctgaaatccggttcgggccacagctgcggagaggagtcagagagcccacagtggttcctcgccggcaaatgctttcgcgtcgccgcttcagaccctaaaatgcaaaagcgaccagcgcccgccaaggcggagagcctcagccgccgaggaagcccgaccactgggatccacatgtccttgtctctcaggcccgctccaagaatcacctagtgcagctactacagtgaaccccacgcagggtatcccacgtggaacattttctggcgtccgggccaggtcaagcggaagtaaacactagagcctgcgcatgcgaacagcggagccttcctgcttttctccctcacttccgcttccgcctcggctcagccgcccgaggattgtgagtggaccgttgaggagagcgaccgaccatccggctggtgtccggactcgtactctatggttgtccgcgctctgcgcttcctctctagccgccagtgctctatgctccgcggtcgcgggccgccagcctccagccggccagccgcgaggggtgcgcagagggaggcggggcggaaaggcgagaggtgtctcctccaccggagccaggggagacccgagcaagctccgtgacagcacgtcggccgccatgtcgccgagtggggctggaaacagacccggcgcccagcggtagccctccttgcgcctccgattcccaggtgaggagaggaggagcgggatgcaggggacccgccggctcgcggccgggatggaaagcctttcggaagcctctcgctcctccccctgcgctgtcctcctccagccgcgcagcctctgccctccgggtgaggtgtagcccggtccccttacctcctccgcctctcaggtcgcctgttttcctctcctttctcagctactgtgggtctcctattgctgcgcgtcgcgccaatttctccctccctaggggactagcgccagaagtcgttcctcacccggctcctggaggagcctgcggcttccacggtctccgttcctttctgttgtgtggcccacagcccgctctccccaccctcgtggatggttttcatttcccccccacacctggtcccccccatcactaccactttggttgtcaagaaccgcgtggtgtctcccttccattcctctctctgggccaatattttccttaattttttcagtttgtgtgtttaaaagacttaaagttaagattaaaaatgaagatgtaaaagcttacaattcctttctaagcttaaaaagattaagactttaggatgcttactgtattccttatgtaaacttagtcaaacacatcgtactgtggaatgcgatttaaaagacccaattttgaagactaaaaataggatgctgtaatggaaattttggcagtctttttttttttacctattgggcaatgttagaagacacggttctttgagagtgttttccgtgtttcaggatcaaacttagagcttttacccattatccttaccaccaaggcaagaaacggcagccaatcaactccgtgtcttagaatacgtacaatcctttctgcttactctactgagagtgtaattgagtttggcatttaaatgcacgaggaaaaggttcctaaggaatgtatcacccagcaaatagtctgaagattatactcatctgatgaagctcaagcggataaagaattgacaactaaatatgaccttttgtgtattataaatttgttaggacatcatagaaaatatctcatcaactgttgtgcaaactgtggggactcactcattggtcttaatttgcttaaattcttttttcgtacagttttctcactgacaattttctagaggtgactttgcatcctctgaacctctctccattactgagctgcctccccctctccccttaaaaaacattttcatagattcagaaatacacttttttccccctccaggacctggagtcctaaatatttttaaatcagataaaatagaattatgtcttcatggttcactcatagaaatgtgtcgttgaatttctgactttttaaaaaaaacactgtggtggctgggtatggtagttcatgcctgtaatcccagcactttgggaggccaaggtgggaggatcacttgctgccgggagttcgaagccagactgggcaacatagactctgtctccttaaaaaaaaagaaagaaagaaaaagagaaaaagaaaaataaacacattgtggttaaaaacaaaacagttattttaaaatgcactgtcttatttcataatgtttgtggaccaaagttagcctactgagtcctagaaaaactgatgtcattttttattttgcttttgagtgttattattttctcttggttttgggaaagagaattacattataatattccctttttacagtgttgatggttcacttgtttgtaattgaaggtacttgaataataagagatttttgtacatcttattttttttctgaggtcccaggtgctgagaatgttgatttcaccttaaagatgaactttatgatcaggatttagacatactttattagaaaaacttgattagtgtgcagtatttcccatcttttttcttaagaagtgtggttttctatcctatgctgtttttgcctttttgaagtaattttgagatggagtctactctgtcgcctaggctggtgccatctcggttcactgcaacctccgcttttcgggttcaagcagtttctcctgcttcagcctcccgagtagctgggattacaggctcctgctactatgtccagctaatttttgtatttttagtagagacggagtttcgccatgttggccagggtggtcttgacctcaggtgatcctccgacctccacctctcaaagtgctgggattacaggcgtgagccaccacgcctttaaaatactttttttcttgctttttacatttaaatatatttatttatttgtgaaggcggagttttgctatgttgcccaggctggtctcaaattcctggcctcatgcaatcctcccacctcagcctcccaaaacactggtattacaggcatgagccaccacacccagcctcttttggcttttaaatgacaactgtaattgggaaatgccaagtgatagtccttgcttgctgttagaattaaggctgtaggtctgtagcagcagtcttcaatagaaatacaatgcaagccatataagtaatttaaaattttctagtagtggtattaagaaagtaaaaagaaacaggtaaaattttagtagtatattttatttaatcttatatatgttattttaacatgaaatcaatttttaaaatgagatattttacattatttgatactaaatctataaaatctggtattttatacttacagcacatctcagtttggagaagccacatttcaagtgctcaacagtcacatgtagctaaatgttaccttactgagcagcacaaatgataggatggtcacatgatttttaagctgtcttcctacactgagagtctgattctgtggggtaaattaaaaactcctcttcctgaagtactgcggtatttaatttgagaagtttctatgcaggaagagagttctaagtctcttccttttagtgtttttgttttgttttgtttgttttgagacagattctcattctattgcccaggctggagtgcagtggcagtcccggagccctgaactcctgggatcaaatgatccacctcaacctctcaaagtgttgagattacaggcgtagccaccatgcccagcctctttctcttagtgttgactgtgttaacgttgagccccatgcttgtttaatgaggctcataagatgaatagtgttcagtcatttcctggcgtgtcattgttactagttatttacatctgcacgtcaacagtgtgtcaaggcacagtatgagtttctgtcgactaaattgtagggagaacttgaggaccttcaagaagattgaactttattgtgaacaggtagagtacctgttgttgcagagttattttctgagtcagtttcaggtaaggctaagagttttataaatgtgcttctttatatcatggtgtttcttaccaagggaaagatcaaatctttgagcaaaatttagaaaggaagagagtaggttttatggctgtagaatgctgggagcctgagtaaagtaaaagattaacttgtgtatggtggtttaggggaatttaaaaggaaagatggcagtttttatataaagcaactgacatactgtctccatacgtgcttcaagttgtttttgcaacaagggtggtgatttacgtagaaccgtcagtggttcagagctgctgtaacaaaggtaactctaaagccagttaacctccatggggatcagtcagacccatcattgttcctgtcttgacctctgtgctctaataaacttccctaaatactactttagctgctgtgtgttatatctacattaatagctaaattagcctgaaggcctaattaatattcagtgtaatttaatacaggaaacatgccctcttctcaacctttatagtatgaagaaattttaaattacctggtcagtgaacaaactccctctgtcaaatatagtcatgatagacctggcacaatgtagggactatggggagtgttagaggatcaaagacagaattggggaaggggtatagttactggatgttacttgttctgtgagagatgtgtggatgttctataagaaaataataatgttttttgtttgtatttaaaactagatagctgtttattggcacccttttagttggataagagaaaatacattgcttggtttctacaagtgagtcttagcaaatttattgtagttattttaggaagagtaattgatagtgcagtaatcttcagtttttaaaaagccctgataaggtttaactgggctttaaaagcattatatgcttaatgagaaattctaacttaatatatgtatgtcttgatactgttatgtaacctttccagtttagggccttcaagattcacatgaatacaggctttcctttatgtaggaatcattctcatgggggaaattatatatcctctcagggaataattttgttttttaagcatttgaaataattgtttgtaatattcgttaaagaacacatcattagcagaattctgaagtcttataatagcttgagatttcttaaattgtttttatcctttttgagacagtcttgctctgtcgcccagggtggagtgcagtggtacgagatctcagctcactgcaacctccacctcctgggttcaagtgattctcctgcctcagcctcccaagtagctgagattacaggcgtgtgccaccacacccagctaattttttgtatttttagtagagacagggtttcactatgttggccaggctggtttcaaactcctgacctcaagtgatccgcccacctcagcctcccaaagtgctgggattaaaggcgtgagccactgtgccaggccaaatggtttttatcttagttttgagatcctgctctttaacattttggagatggaaactttttgccattataccctccacccttccgtctcttaggacttcctgtttttcatcatcattagccacgtggaaaggaaagacagtgtgtgcctatgaaaatactgacaaatcaagatgatttttccttttagattaagaaaaattctgaaacagtaaatggtaaattttgtcatatttatttacttattttagagatgaggtctcactatgttgcccagattagccttgaactcctgggctcaagtgatcctcctgctgtagcctcctgagctggggctataggcatgtgccacactgtctggttagtcacccttcattgacatttgggcatttgatatttaaattgacagtatctaggcaattatagaaattaacattattttgcaattggcatatgtattaaattttcttatgagaataattgccctgtttttttctggagagccactacctgattaaataatcacatattttttctaccttagctgcattttgaaaactcagtgaattaggtgactgtggttttctaatttgaatgaaggtaaagtaacctttaaaaatggtttttggccagtcacagccatgcctgggactcacgcctgtagtcctagctactctggaggctgaggtgggaggatcacctaagcacaggaggtcaaggctgcagtgaagcatgactgcaccactgtgctctgcactccagcctgggtgacagagtaagaccctgtctcaaaaatacatacataaatgaattaaatacttttttatattatagattttgaaataagttattaaaaaatttgggaactttataagatcaaatgctgctgtccttgagtatttgatagtatactgcttatattttgattttttgtatgcattgtccttgttcattatttttctcttctgcagcttttattcccagtatacaactaaatcttaaaaataatttttagatgaactgaaaaacattgcctaagatttttcaataaggatttttgtgaaaatgtgtgtggtttgttatttagagatgagatctcactgttttgcccaggctagtcctgaactcctgggctcaagtgatcctcctgccttgacttcccaaaatactgggattatagacgtgagccaccactcccagccaaatgtatgttttatttattgaataataaatagtggagttatttatttatgtgtgtgatatgtggtttttttaattattaattttttagaaaaatagaagcagggtttcgccatgttgcctagggtggtcttgaactcctgagctcgagcagagtgcctacttcagcctctcaaagtgctgggattacaggtgtgagtcactgcaccaggcctgagttatttgtttttacctcatgaaacaacaactaacattttagatttttttttccacttgtgaagcatgaaaaagtttacttaaattggatcttacaaggattcatgtaaccaacaggatttcctccctcagcgtcaactcacatgaaaagaggggtggacgtttgtgcaaattatactggttatgatattgtgaaatgtagtttcctggaaaagtcattattgatacccatttttggcatcttaattcaaattcagccatcaggctttattttaaatgatttacacagcaatctctagattcttcttgctacaagtattttaaaaattttgttgtggagttcttcggcatgccagttagagttatacctgtagcattggataagcactgtaaagagccaaaattagaggtaatacccttgctcttccctactttaatcatgtaatataggtcttgtgacttggaagaagattgtcttattaccattacatttgaacttttgttttaaaattaatctgttagatcatatattcaccaaagctcatcttttcactagccagagaaagctgtatttcaaaataacctaaagtaaaatagtatttaattcaagaagttagtttttattatatcaggtggcctcttggttggttatagtttcgtgcattctgatgcctgcgggctttttatccttcctgtctccactgcatagctggggaaaacctagggattgcccggtgaatgccaacagagctttaacctgtgtgtccatggcttgccttccctgaagcctcaaagagaacagctgcgagtgcaaaaaccttatgagcaaaatttctgctccaggaacacttatctgggctgaggaaacatattctaagaatatctgttttgtaactaaagcttccatgtacttgtgtaacgctttgtgtaaaaccacgtactttgtatagcctttgctggagagtttccattttcctccagctcttcagtgtaagtgaaaaaatgtgcccagaatgtctctatagattattctgccttccctcaccttttagttttttccatggaaagctgacaggtcagaataggcatattttattagaaactcgaagtggtggggggtagaagtacacatctttgcctcttttttccttcttgattacagaagtaataatgctccaaagatgttttttaataaaactgagtctcgctctgttgcccaggctggagtgcagtggcgtgatctcagctcactgcaagctccactactcctgggttcacgccattctcccgcctcagcctccggagtggctgggactacaggcacccgccaccgcgcccggctaattttttgtatttttattagagacgggatttcaccgtgttagccaggatggtctcgatctccttaccttgtgatccgcccgcctcggcctcccaaagtgttgggattacaggcgtgagccaccgctcccagccgctccaaagattttttaaaaagataaataaattttaacttgaggaaaacatggttattcaaaaattcgtgttttttctttttctttaaaaaaaattttttttagagacagcttgtcgcactatcacccaggttgccatgcagtggcaagattatagctccgtgcagcctcaaactcctggactcaagcaatcctcccacttcagcctccctagtagctgggactgcaggtatgcagtctaattttttttttttaactttttgcagagatagggcctccctgtgttgccccagctggtctagaactcctggcctcctccaggagcgatcctccagccttggcctcccaaagcacaatacgtgtatttttcagagggaattctcaactttcatcagatttttcaaggaatatgttactcaaaaaaggacaacaaccacagcatcagtttgacttggttggttattgcatgtccttcctaaatctctcttataagcagctatggctttataaggattcctatgtaaaagcatcatttttagtagtattttatttaaaacaaaaataatttaatagattatgaaggaaagtcatagtgagtcaaagaacaaatctgaacaaatcttcctcaagtattttatttatttatttatttatttatttatttatttatttttgagacagagtctcactctgttgcccaggctggagtgcagtggcacgatcttggctcactgcagcctccacctcccgggttcaagtgattctcgcctcagcctcccgagtagctgggattacaggcacccgccgccaagcctggctaatttttgtattttcagtagagacggggtttcatcatgttggccaggctggtcttgaactcctgacctcctgaccttttgtcaagtgttcagacaaaaacgtgcacaaatgtttataacagcattattcacaggagtcaaaaagtagaaacagcccaaatgtccatcaactgatgaatagataaataaaaggtggtatatctgtacagtggaagattctttggcaataaaaagaaatgaagtatcagtatatagtacaacatggataccccttgaaaacatgctgagtgaaagaagctaattgcaatagaccgcatattgtataattccatttacgtgaaatgtccagaatatgtaaatctatagagacagaaagtacatgagtggtttgagtgattgcctggggctgtggtgggggtgcaggagaatgggaaatcactgctagtgggtatgtagggcaggggggatcttttcggggtgataagatgttctagaattgattgtgtacaatttgtgaatactaaaagctattgaattgtgcattttaagtgggtgaattgtatggtatatgaattatatgtcgataaaggtgtcatgaaactcaactagaaaaaatacaagtttatcatagaaaatatgtaaaatacagagaagtggaagaggaaaaaagtaattagcatttttaaaaattccctatttttatttcaatgataaaaaataatataagcttattcaagaacaatactgacactttaaaacaacattctcatataagatttcagtgctctctgggcgcggtggctcgcgcctgtaacgcctgtaatcccagcactttgggaggccgaggcgagcagatcacttgaggtcaggaattcaagaccagcctggccaacatggtgaaaccgtgtccctactaaaaatgcaaaaattagccaggcatggtggcgggcgcctgtaatcccagatactctggaggctgaggcaggagaattggttgaacccgggaggtggagcttgcagtgagccgaaatggcgccattgcactccagcctgggcgacagagccagactccgtctcaaaaaaaaaaaaaaaaaaagaaacaaagatttctcagtaattggtggtgggagagttggatcctcacgtgcctatgataaccgtgcagtcacagtgtataccgtattccactagtgaacaaaactttaatttttacagagcagcatcgtgttcagtgactattattttaactttattgattttttttgcatgtcataattcgtaaatttgttttggtttaattgtgttagagttagaagcacataaaaattatgtttttacatccttttttttttttctgagatggagtctcactctgtcacccaggctggagtgcagtggtatgatctccactcactggaacctctgcctcccaggttcaagtgactctcctgcctcagcctctttagtagctgggaccgcaggcatgttaccacgcgcggcacatttttgtatttttaatagagacgggatttttccatattggccaggttggtctctaactcctgacctcaggtgatccacccccctcagccttccaaagtgctggggttacaggcgtgagccaccgcacccagccacaaattatatttcttaattctttttatcctattaccccttcccttggctaccaccccctaccctccacccacatccacagtgctttaagataaaggagattaatttcgcctgtaggaatccatgggaacttggccttcagacttcaggcaagcaccagagtggaaacatttggaagtctcattctaacatgtttttaccttaaaattttttaaaaattggattaggtttttatgtttttagaaccatcttgccctcccttttctagcttttgacgggacattgccaaattaataggctgttttgaagattactaagatgggcatctttcatttcagtagggaaaagaacatgtgctaaaggaattattcaggtgaaaatgcttttgtgattaaaaatgttcttcagaactgatacttctcatgaagtaaatttcaacagtacaagcaaaccctgttttcctgttgttatgactttgttgttctcacctgtcctccataccgccccaccacagcgtcactccctttatagcctcttcctactggtacctccttattccggttctctttctagaccctctactatcctctgtgtttattttgaactgaactttggattaaagtactacctttttgtagctgttactcaaagtttgtcttcacttgtgcttggaatttgaggttactctactgttgttcagactttacctttaaaattccaggagcatcctgttagtaaaacaatgagttttaaaaatttcggtaaaggtggtcataattcttacaggaaccagttttatcccatttagttcacagattttcattttgcctttttaatgggcatagaattctctttcatgtttttctgtagccgagaaacctagtcaagaatgtgaggtgaacctttcaagtaaaattgtagttgaagaaacaaaagtggaaaggctaggttaaaataaatttgaccctggcctaattccatttatctcatacccactttagaaaagaactaaaacagtctgtgcatggtggctcacacctatcatttctttgcgtttttactaattcatgcttcttttttggactttgctgactcgtccctgtattaatctttcactgacaaaaatatcctctgttctcaagtttccctcttctgtttcctaccagataatacttgtggtttttttgttgttaagtacattttaaacatcatctttagagatataaccatttttttctacatctgtttccttgggtaaaaggtagtgagagactttagtattgtagttcaattgaacaaacattaattaaacaccgttcatatgcctgggctatgttttggtgaggattgtaaaagaagtaatgggcacattctcctgctgcaagcattcaagcacttgaattccagatgggaaataatatatatgcatgaaataacttgagaaaaattctaaaacaataaataagcaaattcgagacagtgtctactaaataccaaataagttacagtgctttaaaataagctctaaaattatcgtgctctaaaaaatgggtctctgaaaatgtttcagtgtggattctgtattaaccattgccttcggctgggcgtggtggctcacgcctgtaatcccagcactttgggaggctgaggtgggcggatcatgaggtaggagatcgagaccatcctggctaacacggtgaaaccccgtctctactaaacatacaaaaaattagctgggtgtggtggcacgtgcctgtagtcccagctactcgggaggctgaggcaggagaattgcttgaacccgggaggcggaggttgcagtgagccaatatcgtgccactgcactccagcctaggcaacagagagactccgtttcaaaaaaaaaaaaactattgcctcaaattataattggcctcttctaaggctaaatagtattattacaatttctgttcctccttctcctcctaacttatcaaactcttcaaccccagctcaaattccatcttgcttatggaatctgccctacataccacaagcagcacagaatctggagccagtctgcctaggttgagtcctaattctgagaactgtttgactttggatgagttgctttacctattagtgcttcaaattgcttgtctgtaaaatgctagtgctaataataactacctaataggactgttgtgaggaattgttactatatgcatggcaaagcgtaagcactatataaatgtgtcttgttattctcatactctggtattacggtcacttctcacaatagacttaaacataaacatttctataaagtgatttatttgagcttaaatattttttggaattttatattttgtatattctgctctataatagctgtttgtgttaacataaaattagcatctctcttccatcctcacctttagaagtgaattgatgttaccagagagtgtccatttatcatcctgtgactttgcagatccctggtcagctttttctctttcctgtttctgttaagtatgtattcattctgccttgttgcccattaggttctgcatgtgtgcttttcactaccttattataagctcttcctcccaaggagcaatgctgtttcagtgatgacaacaaatgtgattattgaactcttagtgctatgcatcttgctatcactagaaaattcatgattcacaaatagccagtagctgggctaggtggctcacacctgtaatcccaacactttgggaggccaaaacaggaggatcacttgagcccaggagttcaagaccagcccaggaaacatggtaaaactccatctcttctaaaaatgcaaaaatggtgggcacctgtaattccagctacttgggaggctgaggcaggagaatcactagaacctgggaggcggaggttgcagtgagccaagattgccccactgcactccagcctgggcgacagagtgagactctgtctcaaataaataaaaataaaaatcacacagagtcctcagcagagtaaataaaacaaaatttctagcggttgacatctggagactatttacaaggatgttcttaatttatctttatggatgactttagcagtttcccataaattgtctcattttattcttacagcaaagaaacaaaggcttatagagttgaactaatttgactaagatttcacagctggcgagtatcagaaaactgtatttgcactgagaagggaatgactccaaaattagagcttcctttcttactgctctgtcttatctctagtcttagttcttgttttgaaagggaacttctggtacttacgaatgacggggcttatcttcttgaaagtggtaataaactgtactaaatttctaaggttaaaaaattaagatgtaacattaccagttttctcttttattgatggtttccttagattttttttaaataaataatctcttgtacctttttttgagaactgtatgtagatttcattctggacatataaatattaagggttaggtagcatttaaagtatttgtggtcagaaattaaatgaatgcatgaaatactgtactcttttgagtaaattctaaaaataatccctaatcatttcattacagacagttggacattattttgccatttaccaatatactttttttttaatataccttaaagaccagagagaaaggtaagaacagttatgaaattgcacttctctgattagaagacttattcaggaggactggaagcagaattttcagacgtttctttctaaatggattctattaacttccacagtactttgttcatagcagaccttcaaatatttggttggcttcatgcaaaaaggaggtatctctttactcccttctgtattgctgatgctaattgaattatcttttaaagattcagcatattttacggggatttaattttgagaacattggtgtctttctgaaggtttctttttttttctttttttttgagacagtctcactctgttgcccaggctagagtgcagtatcatgatcttagctcactgcaacctctgcccccagggttcaagcgattgccccgcctcagcttcctgagtaactgggattacaggcgcgcgccaccacacccggctaatttttgtattttcagtagacgggatttcaccatgttggccaggctggtcttgagctcctgacctcaagtgatccccccaccttggcttcccaaagtgctgggattacaggcatgcgccaccacgcccagcctgaaggtttctttatagcatgtaaaaaaaatgtaattcatcgaaatatccactcacatcctgatacttccttgagtaataatcttctgtctttagttgctatttctgtcctgtattttcattgcaattgtatgcttttcttctttaaccattcccatacatggatatggtaacagccacattggatgaaacttcatcagtgtctccatgctgtattttttctacccataccaatctttttttttgagacggagttttgcttttgttgcccaggctggagtgcaatggcgcaatcttggctcactgcaacctgtctcccgggttcaagcaattctcctgcctcagcctcccgagtagctggaattacaggcatgcgcctccacgcctggctgattttgtatttttagtagagacagggtttctccatgttggtcaggctggtcccgaactcctgagctcgggtgatccgcccaccttggcctcccaaagtgctgggattccaggcgtgagccatcacacccggcccatcccaatcttttagaaacgtagtctgggtccttgtaaagcacatggttgcttaaaaacattccattacagctgcaaactcctaatgtgttctagaggacattgcattttacattttccatttcttataaacttttacaaaagcaatataagtaaatagctgataaagtgttctttgtggctttgaagaaacgttagtagcttaggagatgccctttaccagcagcccgttagtacttggtttatattattttttattcatatgtctgagctggattctgtagggagaaatgaaaaatgttttataggcaaaattttatgagatgtctgctaatatcataggcaaaagtatttttgcaatatgtattatatctaattaatttaatggtatccagtataatataatatcctttaactggggtttttttaaatagaagtgtcttttcattacagcttaaaagatggttgtaaactttcatataagtcaagtacgcagttgttaataaccttatatgtatgtactccttatatttagcaagatgaaatttttcagatccatatgctaagagttatcagatttactggcccttcacacaaatcaaaaaacgaagttaaacacgactttgctgttgctgtttttctttcctctgccttctcccactgtattctatctctcaccatctgttactgacagttatcagcatagagtgacctgtacctggaggtgggttcataactgtcttttaccttccacatctactcagtcctgcaaactgtgaactccacctccatgcttttttttttttttgaggtggagtccctgtctcccagcctggagtgcagtggtgtgatcccggctccctgcaacctccgcctcccaggttcaagtgattttcctgcctcagcctccctagtagctggaattacaggcacgagccactgagcctggccgggcttacgttttgtatccttctcccctttaccccctagtaattggttcatggcccactaggggaagaaaagatggtctttcacaacagatagtctgaaaagcgctggtctcaattcctgtactgggctctggccccgcctccgtttatcaggctcgtcactactttacttcagcactcttattccaaagtctaactattcgctgttcattctgtacttcctcacctttttatttggtcctgtttatttcttctcttgagattacctctccatgcacctcaggtacgagtagaatggagggaacacaccatctcagagctgggttacaatgtcctcttgtccagtgttatctgctatatcaacatttcctccagaccgtggctgaagatgaacaaggcagctcagcagattgaaggtgcctggggccagcactcattcgccctgtctgagaaacgcagggacctccctgaccctgttgtccgcccgttagcgtgatgagcagctgtggatttcatctgtgtttcttgggcaggggggcctgtaggtatagaaatggatactaccaattggattggctgatttaatacctcatgaatatcagtaccttcatgagtattttgtgtctcctctggtcttgtgaatatttggtggttatgagtgctttcattccttcctgtgtttaccatacagatgccctgtttactttctctgtgtctaacttctcacgctgtttgctctgcacttattttcatctcttttatttgtatctttgattttctgtaatggaattggatattctcaaatattcacgcattacacctttccacagtaaaagtaaccttcattcctctgactctcaaagaaattgcctgtcattgatcacattcttctttgtagcaaagtttttttgagagaagaggaatgttagggcagggtttatagacatagcgtataattcattacctgctagagtatcagctcttgtatttttattagctacttttagaatatatagtcctcagggcatgttgtgtctcatctgtctctctcttgcctcattgtatttagtatgtggatcttgtttgttgtagacactcaaaattgattaccctgaaggctggtgaagtttagttaaagctctgaggtcagagttcagtctcatgtggagacttatttgctttgtttcatgtcctcatagtaaccttgaatgctggccaagtggcttttggttacaaagagcactgggtaagacaaagaattagcacttgtattgcataagcagtttaaaaccagtgttcctctgaatgtggggcaggagcatcgtgttcccattcaaagggcaacattatatcataatttttcaagataagaaaaagtagacaatgaggatggcagaagaaaatatatgtgaatttgcctgtaactgtactttttttttctttttaagaggcaaggtcttgctgtgtttcccaggctggagtgaagggatggtcatagctcactgctgccttgaactgctgggctttaagcagtcctcctgccgcagcttcctgagtagctagaaccacaggcacacgccaccaagctcacctaatattttagagtgtctgtagagatggggtctcgcttcaagacccaggctggtcttaaatccctggtctcaagcgatcctcgcagagtgctgagccaccatgcccagccacatatgttggctttcttgtataggtataagaattcagtgatgtatctatgttagaagaatccgaaatcgctaagaaatatgaaatttcaaattcacttatataagtcaacattttaagaattaattttctttaagtgaagtaaaccaggggcaagagtttcaaaaaatgcattcagatgtccacataaagtgggaagaatggcggtgcagtcaagaataaagagggagcacaaatgaaaattggtgtcgagatagactgaagaaacctggtctttccattatgatgaaaaaaattccagcgtaggtatcagtcttattgatactttgtactcaagtagaagattaaggtacaggattcttttagccagattgtggatgatctgcatgatgagattgatttgaagacagtgtatgaaaccaagtcgaatggagacggagtgtgtagtggaactcatctcagtagaccgtcccggcagccctgcagtcctccacagctgccaggacagttactgttcagtttcccacactggctattttaaaccttctatatgctccccaactccttgctcccaacataccactccctccctgcctccggtatatggatctcctatgagtctgtttctgctgtttttttcccccagttttcttttttaaatcaagacgtgatctcttgtatgcctggttgttttggattatatactgaatattacatatgaaaagttgtggaaatagtttcagcctttgctggatttatcttgcagagaggattgactttagtttctggcaggcaacaggttagaacagaccaccttaattcaaccagagattagatgattgattctgctgggccttagtccctgtgagcactgatctatttcaggcttgccttttcttctggggagtatcacttttaggtcccaccgcaaggcctgtggtcccctcttcttggaagacctcgaactctggtttttcgtccagctctgtgagcctgctcaacactctgctcagcttttccggcttccaaactgaagctttctgccagcttttctagtgatcagcaggaggggtttgtctgaaatgagccagtctgcccttgccagaagtacaagctttcttatgtttgtttttgcacatgtttaaaatgacagagccaggtgctggctcacatctgtaatcccagcactttgggaggccgaggcgggcaaatcacttgaggtcaggagttcgagatcagcctgtccaacatggcgaaaccctgcatgtactaaaaatacaaaaattagccaggcgtagtggtgcatgcctgtaatcccagctactcaggtggctgaggcggcagaatcacttgaatcgggaggcagaggttgcagtgagccaagatcacaccactgccttccagcctgggcaacagagactctgtctcaaaaaaaaaaaaaaaaaaaaaatatacacacacacacacacacacacacacacacacacacacacacacactatatatgtatacagcataagtgcatatgatttatgaacagatatacctacagtgggtatactcaacgatcagtttctttgcctacgctgggcgtggtggcatacatctgtaatcctggcactttgggaggctgaggtggcaggatcacttgaggccaagagtttgagaccagcctgggcaacatagtgagactctgtttctacaaaaaatttaaaaattagctggatgtgatggcacgcacctgtagtcccagctatttgggaggctaaggtgggaggattgcttgagcccaggagttcaaggctgcaatgagctatgaccttgccactgcactccagcctgggggacaaagtgagaccatgtcttgggggagagggggagatatatatatatatatatgtgtgtgtgtgtgtgtgtgtgtgtgtgtgtatatattactgatagtatgcttataagcaaagatatatggtatatctttgatatgtatctttattatatagtatatataatatataccttttattatatctgatatatattatatataaagctatatatctttgatatatttctatatataagatacatatacaagctctatcttatgtatcatctatatcaactttatatgagataaataagatacatagatatataaaagatctatatcaaagatatatcaaatatataacatatcttttatatatatctatatatgatatatatgcaagctatatcttatgtatctcatatatatcttagctatatctgagatatataaataatatataaatatataaatataagtacaccaccaaagtttggagactcttgcatgttagtccctcttttttaacgtgatgttggttcagtaagtatctgtggcctgcctggtaaaaatttttctaaatgcacaaagatgaatgtcagagatcttacgataatttctaatggggcggttatatagcccaacatataaacctgaagaaatggactcataacattaaaggaatgcagcaaataaagagtcttattggtgggttttatttgctgtgtaacctatttttctacattgtacatatttggaaaacatctcaagatattggaaattgttcattttgtggcctccttaaagtagcaatttggtatttacaacatatacacctgaaaacagctggtttttaaaagtaatttaaaaatgattatagtggttaaggatacaggctctggaatcagattctaaattgaatcctggctttgccacataatagcagcgtgactgaggcctatgcgtttaatctttctattgctgtttacttctataaaaaatggaaataattttagaactactttataggacttataaggattaaattatatatatgtaataaacttaaaacactgatacttagtaaatcttcaataactgttaaagagatggagtcttgctatgttgcgcaggccggtctggtactcccaggctgaagcaagcttctcacctcagcctcttgagtagctgacactacaggccacaccactgtgcccgactagtctcagcattttattcagataatgcaagctattttgtcaggcatcttaaaagaaggttctaataaattatttgcttttgccattgtattttcaagaattgacattttaaaacaatgtatagttttatgtgtctatttaatgagtaaagtataagacagtttccatgaggatatatagttgatacaggcagtaaacatgatttttgttttaaaagaggtggctatagtctgaaccaaagtattttcaagtcttagattctgttggttgtggcttaaaagaatgattgcagtacatttttacaacaaagaggtatttaaaaccaaataagcacaatttggatgtgtttacttctcttttgtttatttaagtaaaacttgtgtatatctgtgcataagagaaggaaaagagaagagagatgactctttatcttcatactgcttgggtatacccacaatgaggcttttgacctgtcatttccatttatgtaatggattttgaactcaaaagccctgtaaatacataagcgatcttgaaccaagccccattgtgaaaggcaggattgaggaatatgaaacaaattatgcttcctttcattcactttatctgccccaaggtttttttcggaatatgagtcacatagtttcagttaatttcttcatatttttaacagtgctttctcttcataaccgaaaatctgtatttgatgtttttttcccttagaatcattatcttcacatttattcttgtttttccttttgtgtcttgtaactttgtcacatttttatccttcttgcctaccttatagcataaattttctcttctgtggcctttctttttgctaaatgaagaactaaatctttatgaaattatattttttatttttattaaagaaatgttaaaacaatgtgatttacttttatactgtactattatgtagaaatttaagtatttagaatgattactgaaaggccgttttactagttttaatgacaatactatttaacttttatgaagtgccaggggtatttggaatatggggaagtacaaaaaaaaaggaacagcatgatctagtgatttacattgtgaatatgggaaataaggaggtaaaaattaattttaaatagtatctatttccttccacaagtatttgcatttgtttaattacagtaataataatatctatatccaggaaatacctatagcataacttgtgttagcaaggaagaatccagaatggagtgattcaccatgagccatatttggctactgtgacactgtcaaggcaatgtcatagacagcagcatcgtccaatagaaatatgtgagacatatatgtaattttgtggtctagtaaccacattaaaaattttcaaagggaaaattaattttagtaatagtttattcaatatatctaaagtattatttcaacatacaatcaatgtgtagaattaataaattcttttatattgattttattcatactaaatcattgaaatatggtatgtattttataaatgtagcacatcttaatttggacacaattttcattggaaatgcttgaactatatttcaatttcataaaatgtacaggtgaaaaacattcacatacccaagttattccaaacatacttgagtttttcagtaactgaattgatgtccatttaaaaatttaaatttattaaaatttataaaaatgaaaaattgagtccctcaatgtgtgttcatatttcaggtactcaatagccctgtgtggttagtggctaccattttgaatagcataggtatagaatagagctcacagttgaagatgtcagctaagaaaccctgaatcattattattattgttttattttattttattattattatactttaagttttagggtacatgtgcacaatgtgcaggtttgttacatatgtattcatgtgccatgttggtgtgctgcacccattaactcgtcatctagcattaggtatatctcctaatgctatccctccccctccccccaccccacaacagtccctgatgtgtgatgttccccttcctgtgtccatgtgttctcattgttcagttcccacctatgagtgagaacatgcggtgtttggttttttgtccttgtgatagtttgctgagaatgatggtttccagcttcatccatgtccctacaaaggacatgaactcatcattttttatggatgcatagtattccatggtgtatatgtgccacattttcttaatccagtctatcattgttggacatttgcgttggttccaagtctttgctattgtgaatagtgccacaataaacatacatatgcatgtgtctttatagcagcatgatttataatcctttgggtgtatacccagtaatgggatggctgggtcaaatgatatttctagttctagatccctgaggaattgccatactgtcttccacaatggttgaactagtttacagtcctaccaacagtgtaaaagtgtccctgtttctccacatcctctccagcacctgttgtttcctgactttttaatgattgccattctaactggtgtgagatggtatctcactgtggttttgatttgcatttctctgatggccagtgatgatgagcattttttcatgtgtgttttggctgcataaatgtcttcttttgagaagtgtctgttcatatccttcgcccactttttgatggggttgtttgtttttttcttgtaaatttgtttgagttcattgtagattctggacattagccctttgtcagatgagtaggttgcaaaaattttctcccattctgtagttttaatgaactcctcattaaagaaggaagaggctttattcgggcgggagctttggcagacttgcatcttaagagccaagctccctgaaaaagaaatccttggcccttttaagggcttacaactctaaggggtccacgtgaaagggtcgtgatagatcgagcaagcgtggggagcgtgactgggggctacatgcatcagctgacaggacagaaagtttcgcagggcttcctcatacgatgtctggaatttacagataacacaagtagtttaggtcaggggttaatattattattatttttttaaccaccagggccaggtggtggtgccagggtcgtctggctatttatcttacttctgtttctttccaactttttgctttctcccttttcgcctgtcttataaactaggcaaaagtgggagagaggagggcagcaggagaagtggtggtctccttccttaatggtatagggtgaatattttatcttgtacttttcatggttttagagactgtactttacatgtttctaaagattaagcatttctactcattaagttgaagaatctttagaagtcctctcactgaggtttttttccagaattactggattatttctttcatacctatcatttttcttaaaatgtaatacacttgtagataataagaggaaataaaagatgactgataaagggcttgcagtctgttttgtaaattttaaaaatattagtggtatccttcaagcagatttagcatttcttccaattctacactaagagtagcctagagttaaccatggcctttttttttttttttttaagtgttcaaaaggattttgatgacaactctaaggtaccttccagggcttatttttaggaaataaaaaataaaacgatagtataaatatatgctacctaaacttcccctcacatacttttttctaggttatttttttttaaaatcttcaaacattttcatttccaaatattgctgctgtttagccagagaagaacttatacaactagctttcagttgtctgctgagtgtccagggattaacataagagactaatttcagcacataacctatttaactagtcatttcattcaggcagtggtcccaacctgatgcacattagacttacctagagaacttgaaaaatagtggtgcctaggttccatcctcagagattctgatgtaatggtctagaatagaatttgggcagcctctcaggtgatcatcatgaggagacaggcttgacacctgtagtattcatgtgagaactagctgagtttggggttgggttgcatatggtgaaagggaatgaacttaagtcatttccttctcttccctatttacaatgaaacaacctaagagaaggggaaaatcaaagatcactgagaatctgcaaaggttagaaaatgaagtagcttttttctttttgtcattgtagacatggaaggtctttaatgtaactttaaatggttcaccaaaggatgctctaatggatgacagcgatactcctacatattatctgcaaatagaaccacaagatggatgtcatcctggtgacagcgtggaaaggagtgtgacctgtctgccttctgcatcagatgaaaatgaaaatcagcttgacggggacgggcatgagcatctgaccagcagtgacagtgcgatgggaaagccccaagtgtctgagcaggacagtctcaataataatgaaagctgcacattgagctgcgaggtggctgcaggtgagaacttgcaaaacaccctttgtgaagcctccagagatgaacaggccttcttgggaaaggacaaaaaaattcctggaaaaagaagtccaagaagcaaaaaagggactgctaagaagataccaccaggtattgtttaaaatagtatttatcctcttctttaattaattaaaaatgaacctccttccctcccatactgtgtttactgtcctgcaccttgcttctttgcttacgatattctggagctagttccgccgcagcacaagtagatccaactgcatgatattccagtgtgatacgtctccacactgttccaccgtatgggtgtaacacaatttatttaatcacttccttatggcccttcccagtcttttactatcataaacagtgctgaggccgggtacggtggctcacgcctgtaattagcactttgggaggccgaggtgggcggattacctgaggtcgggagttcaagaccagcctggccaacatggtgaaacgccatctctactaaaaatacaaaaaatgagctgggtgcagtggcgtgtacctgtaatcccagctactctggaggctgaggcaggagaatcgcttgaacctgggaggcggaggttgcagtaagccaagatcacgccactgtactctagcctggctacagagtgagacttcgtctcaaaaaaaaagaaaagaaaaagtgctgaaattgacatcctttgtacatgttttcacattaggtactttaaatatatgcagcctcctctccctcctttataaattagaccattttctaccaatatcaaccttaaaaattgccttctgtcattcctgtggctttgatccctaacctgtgagtttagatgctactgtgacctctttatagatctttccatctcactcagcaggtaaataaaatacaggaacatatattaatgtacaatttaatatgtagtgttgaataagacatctggttctaattatctgtatcactttggttaaaaagtaattcagagtatttcttgtttggtatgcagtttggcagttgaagtttagagctatggaatttttggcctgaatcacagggcccccttgggaaaaggcagcctctggttattttttttatcagaaacatatgggactagaaagttttggtatgccctagactggattccttagtgtagtaccactttttacccaagccaacagattttacatcagactctagtgaactaagtagaatgcctcttcatcttctgttctcttctttggttaattagaaatatatctgtctatatcgtattttttatttgtatttttaaaatttgaagtaaaatacaaaacttttcagtttctacaaaatccatatttattcaataaagtaatttgaaaactttttaatataattcataatctggctttctggttaatgtaactcataatttggcttttcacgtccctgtatctttttcttagtagactcaaaataatttttaaccagggatatgaaagctttttttttttttcttttttttgaggcgagtctcactctgtcacccagtatggagtgcagtggtgcaatctcagctcactgcaacctccgcctcctggattcaagcaattctccttcctcagatgattctcctgcctcagcctcctgagtagctgggatcacaggtgtgcaccaccatgcccagctaattttttttgtatttttaatagagacaaggtttcaccatgttggccaggctggtctcaaactcctgacctcgtgatccgcccacctctgcctcccaaagtgctgggattaaaggcgtgagccaccgtgcccagcaaaagcatttcttaaaagatctaataagcagaggatatttacagtactatgtatatataaatcagtttattctataactatcattcaagggcaaattcaccaggcctctcaatctgattttgtgattttattttattttcaagacagggtttcactctgtcacccaggctgaagtgcagtggcgtgaccatggctctctgcagccttgatctcccaggcacaagcgattctcccacctcagcctctggagtagctcggacaacaggcatgtgctaccatgcctgactaatttttcttttctttttatttttgtagataaagaatctcgcactgttgcccaggctgatcttgaatttctggcctcaagcgatcctcctgcctaggcctcccaaagtgttgggattacaggcatcttgtgatgtctttaagaactgatacttagttgcatacctatgagtcagtcatagctttaagattgtgagtccttttactcctcccttccatggtctttattccacttttcttaggtgtgattatattattattatatttattttagagacaggatcatgctaccttgcccaggttagtttcaaactcctgggttcaagtgatccttttatctcagcttcttgagtacctgggactacaggtatacaccagtgggcccagcttataatttaaagttatttagtatttataatactgtgagaagatatgtttagaattactattccctaatgcatttgaaacatatgatttataaaatctagggatagtctttatacagcttactttaaacattattttctatatcttatataaagtgagtttaagagagtaagaaaggccaggcgtggtggctcacacctgtaatcccagcactttgggaggctgacagggcagatcacttgcgctcaggagttcgagaccagcctggccaacatggtgaaaccccatctctaaaaaaatacaaaaattagctgggcctggtggcatgcacctgtagtcccagctacttgggaggctgaggtgagagaatggtttgagcctgggaggcggaggttgcagtgagccaagatcctgccactgcactccagtctaggcgatagtgccagaccttgtctcaaaagagtaagaaaacagaatgaggagttataaaacccaagtacaaatcttatgattccaggtcacttggtgagactgaagcagtctctaccttgttgttgtcgtctgtataatgatgatcttcatctacctaaatctatgaaattcctttttaagctgtgagtttcttagatttcatagtagagatggtatactctatacttgaataaaatgtggtgattcacctctagtgcatctatagagtttttatattttacagatacatttttgtttgtcttttaagttttgttgataaattaaaagaaaggatactcctgtctgcccgggctggccatggacgaggcgggactgagtgtcctggggtgagttagcagggcacaggtgtttgagatgggggacccttaattttaaactgaataggattcttttgggtgtggaattaatcctttctagatgtggaagagacctagaatgggaagaagctttagtattgcctggaaagcttccctcagagtttagttgctgggaccccaccctaagaacttgcttcagcctgtcgtctctcagtacgtatccatcacccggtctgagtaatgttatctccctgtgatctctcaagtcagtctgtttctctccatcttcactgccacagttcagcagcatcttcagctggagtactgcaaaagccccctacatttgtttcccatcttgcttccatcctccatgtcaaaaataatgcaaagagtttatgcataggagtttagacaaggatgtgtttactctaatttttcggttaaattcttagctcctaagtaaataaagtttcaaatttttcagacgtgtacttttctaataattgaatagcttctcaaatgtgaaatgacatataaaaaacatgatattcagttgcaaaccagaaatgcagttttttgtaggtagatgttcttgtaacactttttagaaaatgtaaaatataaaaataaagaaaaaaaagaccaaaaaaaagaacatgtaaaataaagtaaatttattcactctatgctcccttgtctagtttaatttgtagtcatttttcaattactactgtccaaaggctagtactggaaaaaaaatgatagtgcaggactcttgtcactaatagtcatgtcattcctaatagtcatgtcattaggagacatgtcactgtttatgggtttgctggaggcagtatttgtgtcaatgggtaaaaccttgatcttagcctcagggaagtccagttgtcatcatataatgagcttttttttttcccccttaagagaattgaatccccttgatatgcttaactaagcaggatttcaagctgtgttacaacaagttttcattatagggcgggtgcactggctcatgcctataattgtagcactttaagaagccaaggtggaggattgcttgagccaaggagtttgtgaccagcctgggcaacacagggagacctcatctctacaaaaagtaaaataattagctgggcatggtggcacgtgcctgtagtcccagctacttgggaggctgaggtgggaggatcacagcagcagtgagctgcatggttgcaccactgcaccccaacttggagacagagtgagatcctgtctcaaaaaaaaaaaaagaaaaagaaaaaatttttcactgtagttaaaatggcaaagctttaggtaaatattatcctaaaaactaatgaccattacttatttattattatttttcacattcttacctggggggagaaaaacaatggaaattaatgtgttttttaaacagttttattaagatgtaattcatatacatgcaattcacctacttaaaatatataattcactgatttttggtatactcacagggatgtgtaaccatcagcagtcaattttagtatgttttcttcaccacacaaagcagccacttacatattagcacccacttcttacttccacttagacatcctaacctgaggcagccattaatctacttactttttctacagatttgtctactctgaacattgcatattagtggaatcatacaatagaaggtctttgactggcttctttcatttaacatgttttcatggttgacccattttgtagcatatatcagtactttgttcctttttgtggtcagataatattctgttgcatggatagaccgtatttcatttatacatcagctgagggatgtttgggttctttccactttttgactattctatggacattgctgtacaagtttttgtagagacatgtgttttcatttctcttcgttatatatctctaggagtggaattgctggatcatatggtaactttatgccaaacagttttccaaagcaactgcaccattttacagtcctgccagcactgtatgagggttacagtttctctccatcttcaccaacacctgttaatatctgactatttgattatctccatgtagttttaaaaaacttgtaattcgtataccataaaattcacctttttaaagggtacaatttagtggttttagtatattcacaaagttgtacaatttaattccagaacattttatcctccaggaagaaatcacgtacccattagcagtcactcctcattcttcccttccccaagcggtggctaccactgtcccataaagtttgtatatttgtatgagacaagtttagatgatgtgttttatggttgtcgtaacaacactagatatttactcagcgctagtcaccatagtatcaaagcatttaacaaaacagttcagcaaatggcgggaagccagaaataggcagcacatggaaactgggaagggaagacctttctcaattgacctgccactatcagtgccctgacttgtttctctggaggccttcacagtgtggccagctgaaggatgacaaggaggctagaaccttaaaaagcctgagtcaggctggtgtagtgagaacaaagactttggatttgaatcttggttatttgagtctcggttctgcctgttcttacctatatgatcttagaaaaggagctcatttccctgaaccccttttctcatctgtaaggaaggctgatcctacatgtcttgcaggattgtccttagaatgaatgactctgtatgtaaagcactttgtaaagtacccagcataaaacagcttcttctaaatggtagttgttgtgtttatgtgtgtcacaagatggtatttatttatttatttatttatttaagacaggattttgttctgtcacctaggctggagtgcagtggcgtgctcgtggctcaaaaacatcctcaagttcccaggctcaggtgattctctcacctcagcctcccaagtagctgggactacaagcgcatgccgctgcgctcagctgaattttttttttttttttgtagtggcgggtttttgtcatgttgcccaggctggtcctgaattcctaggctcaagccatccaccagctttggccccctaaagtgctaggattagaggcaggagccactgcaccagctacacaagatgatttctgagtggcgtgactgggagtaccattaagcaaaattaagaaattaatttgatttgactttaagtccattttacttcttttgtcagtacttttttttatttcctaggaactttttaatactgtctcttttcagatgtacctgtccctgccccattcccctaatgtacattcctaaaaatatatttccagttccatactagtttaatgtcagatgcaacctgctttttgggatgttaactgatatcaaaagtaataactagtaatgccataaaatatgaatccccaaaggcctatttgcatttttatatattgacttcggctatagtagaacattgatagctggcctctaaatcagctttatggagacaattgggtaatatctgtactggccagagttgagatccctgagattggtggggactgtggtgaacaggagtctacatcatgccctgcctaagtgcattcaaatttttaaaatgtaaatgcctggctaagcccctgtaagcagaatgatagggactggggttgatgttttgtgattgtaacccattctactcactaggtagatagacggacagtttaactcccttaggagtacataccacactttcagaattcagaagtcctggtttaccttatttctgctcctagtagatgttccacctcttttaagttaacatttctttggacaatgacatgcagaaacagtagcctctcattttactcttccttctttaagggattgatcaatgaaggcaggccatgtcttttctgaaggtcagctagtaagaatagaataaagagttcctgatttatatagagtcaaataatttcacagtcagaagagacttcaaggtcactagccaaaactgtcttaggaaaaaaaaaaaaaagccccaatattaaaagtgtgttagttttctattgctactggaacaagttatcacaaatttacaaatctagtggctttaaacacacgacaacacaaatttattatcttacagttctgtagatgaagaatctgacatggttcctactgggctaacatcaaggtgttagcagggctgtgtccctttctggatgctccctgggagaatctgtttccttgccttttccggattctagaggcttcccacattccccagcttctgttacccttcctccatcttcaaggccagcagtggctttgaagtgagctcaagtcctcacattgcatcactttgaccagctgacacttctgcctctctcttccacgtttaaggtcccttgtgattacactgggtccacccatatattgcaggataatctccctttttaaagatcagctgggctgggcgcaatggctcacacctgtaatcccaacactttgggaggctaaagcgagcagcatatttataagttctgggtatggggacatgggcatctttgggagctgttattctgcctaccacaaaaagattttaatatagactagatgataactttacataacagaataattcttcactttataaaagtttttctgacattattttgtagacccgtacaggattacatagtcaatagatatttattgagcattgttgctgggcactataaaactgctggtgcacctccctttcagttttgtatgctcaagtgagggagccacgtaactaacaagtgcagtctagcaagacgggagtcataagtaagcacatggtcgtggaggtaacctgtcctggagagttagagaaggttgtcaggaggagttggtatctaagctgagttaggacaaataggtgctagtgaagtaaaagcaatgcggacaaagaggagaggaaggacgtcagagatggcaggcgtaccatgggctagagctcacaagacaagaagagagcatcctacatttcagtatctgctaatattcctgcttgagcagaataaaagaaaagagtgaatcaaggggaaatagtagagagtagagcagtagagagatggaggcttagaagattagcaaagtccagcttataaattgtttttaacatgaccagtttgggccttaacaacaggtttgaataagggaattgcattttttagaagattcctcagtctgcagtgtggagaattggttggagcaatggaagattagaagtaatacagagttaaggggttttacagtaacatctgccagagatgctggtgatctgtaatgagagagtagctgtacggctggagagaagtaagtgaattcagagttactaaggaggtggaattaacaggactggatcattaattagatatgaaaaaaagagtccaggataatctaattctcagttatctggtttaagcaccaggatgcttgataatgccatttattgatttattgagcataggaatacagggagagaaagagcaagtttggagagaagagagtagaagacagtgttgtgcttttgggtcaggtgtctggggtgtcgtagacgtctgagtagacctgttaaacaggcttctggtcttggctagagatacagatttgggagagttgctagagagggccttaaaagtgacctagtctaacttcttagattttacatgtgaggaagttaaagatttaattgagagaatacattgttcatttttgcaggagacagaataagaattaggatgtgaatctagggctcctaatgagctagaatgtgttttctatgcatcagaggcctacttctcccaccaaacaatgagacgccaggcatggtggctcacacctgtaatcccagcactttgggaggccgaggcaggaggactgcttgagtcaaggggtttcaagaccagcctgggcaacacagtaggacctggtcttttcaaaaaataaaaaaaatagcaggcgtggtggcatacatctgtagtcccagctactcaggagactgaggcaggaggatcacttgagcctgggaggtcaaggctgcagtgagccatgatcacgccactgcactccatcctgtgacagaatgagactcttgtctcaaaaaattaaaaaacaaaacaatacaaaacaatgaggttctgttggtagggtaaaaatgatgatgagccaccaactgttagtgattttttctattgtagaaatatttgccaagcattaggaatacagtaaggacaaagcagatcttgtgcttaccctcctagacccctggtggagtccagtgggaaggcaggtattaaataaaattaatggcctggcacggtggctcacacctgtaatcccagcactttgggaggctgaggcgggtgaatcacctgaggtcaggagttggagaccggcctgaccaacatggagaaaccccatctctactaaaaatgcaaaattagctgggcgtggtggcacatgcctgtaattccagctactcaggaggctgaggcgggagaaacacttcaacctgggaggcggaggttgcagtgagccgagatcatgccattgcattctagcctgggcaacaagagcgaaactcagtctcaaaaataaaataaaataataaataaataaataaaattattgcaagggtgtatagtctgcttctagaactgacacacattcactgtgtgtgtgtggaatggaatggagagagcagtttggaagatggtaggagatgagttttgaagtattacctcttggatattctgaatgctaatgagagaaaaccctttagtggaaagcttagttaagggttgatagttgggagtaacacaccacctacttataagaggaccctaaactgatggttagaatgatagaaatgcattccctgctgttatctagctctttccaacagactgcaccatttccaggagtgttgggaaaggtgtttgttacaattgaaagtacaaacgtcagaggaagggatcaacaaaatataataaaaaagcagaaaattgaagaattgtgcatggtctgtgcattagctatctcttgcagcgtaacaaaacttagcagctgaaaacagcaaacatgtatcatctcgtggtttttgtgggtcagaatctgtgtgtggcttagcttggagcttctgacttaagtctcttatgaggttgcagtcaagggttggccagggctatagtcatctcaaggtttgatagaggttggataatctgcttccaaggtcacatggttcttggcaggcttcagaccctcgccacatggcccactccacagggctgccttacaccatgacagctggcttcctccagggctagcagtcaaagagagagagcactcaacctggaagtcatacttttttaatgacctaattttggaagtgatattccatcacttctgcatattcctttcattagaagcaggttactgggtccaacttgtacttatgggaggaggttgtaaaagggcacaaataccaagaggcaggaatcacgggggcccatcttaaaggatgccaggagaaagtcggtgcctcagattgtggcaaggaccccgtgagaatgtaatggcaattctattcacagttccttttttccctctgaacacctttcctgagattgcaggtggaacccaggatatatgatggtacagacagcccagttagatagttttctttttgtctagttttttttttttatgatttcagtcgtgctgttaaaatgcagtatctatgcagagagaaggtgaaaaagaaaagaattacaatcaatcaaacctttcaaattctgtcccaaaaaacagcattctccaagtctcagtaatgagttaggtattttttaagtaatgtgatattttatgtgaagaaaaattaagaaatcaaaactaagaaattaagagatttacctccagatgcatgggaatatttatgcagttacatacatattaacctagatgaatgaagactttttaaaagtttttagatataagcatataggctatattttaaaatacggtattttattactgattttataggactcagattagtggaagcttaggtgggagtttagggactcttggcttctcagttctttactgtgaaagtcaaactttccaatatttaatcgttttctaaatagtcaccttttgcttttctgtttactccttttgtttttactggatcacgatctctacaaagagtgactgttttgtcttcatttgtttaaaataatggtttctaggcatcactgatagggtgagaactacaattaagagttttttgttgtcttgtttttttaaacaaagttatatgcgcctgccgcttagtttgtaaaaggcacacaagtgaacatttggaaatgtagtcacacaaatgaaaagcaggtagaggttatatgcatgctatttagcaatgaaaataaataaaatcctaatacatggtgtaacatggatgaatcttgaaaaggtgctaagtgaaagaggacatatgtgtgaaatgtccagaataggcaaatctatatggacagcaagtagatgagttggctgcctagagctagggaggcagtagggggatggggtgacagctaaaggatgtgggatttctctttggggtaataaacgttccaaaatgtaacatggtgatggttgtacaacacagtatactgaagtaaagccactgaattatgtgttatgagaattatatctcagtaaagccgttaaaagaaaaaaaggctggacgtggtggctcacactgtaatcccaccactttgggaggcctaggcgggtggatcacctgaggtcaggagtttgagaccagcctggccaactggccaacacggtgaaaccccatctctactaaaactacaaaaactagccgggggtggtggcgcgtgcctgtaccattataggcatgagccaccctgcccggctactggagagactgaggcaggagaattgcttgaacccgggtggcagaggctgcagtgagccgatatcgcgccattgcactccagcctgggcgaagacgcaagactccatctcaaaaaaaagaaaaaaaaaaggggcttggtgatagttggtttgatgatatgaagaaacggtgtagttatttgtctccacaaaatttaaaaactactagtgtaatggaaattgatgtaacaattttctgtaaactataataaaatgccattaaatgtgtttctctgtgcgtttgttttgatctattgaaagttcagggttaacccctgggcttctaatgcttccgttcttatatgatttcattaattgcaaagagaatctctgatgttagtagcttttagagaattatggaatattaaagaaggggggcttttaaggaaaatttcactgtttggtttgctttggctattaggctctcccccttctcccacaaatatatatattttcaggagacggaatatatatatataatacttatatttattgttattattttgagttgcactcttgctgtattgctcatgctggagtgcaatggcgtgatctccgcccactgcaacctctgccttctgggttcaagcgattctcttgcctcagcctcccaagtagctgggattacaggcatgcaccaccatgcctggctaatttttggatttttagtagagatggggttttaccatattggccaggctggtctcagactcctgacctcatgattcgcctgcctcggcctcccagagtgctgggattacaggcgtgagccaccgcacatgcaccattatttttgttttgaatttaaatacatgcctttatatttgttagagaaacaaaatatgtttattttcagacatacgagaaaatcatatacttgtaagaaaatcatatactttcttataaggtcatgtaaattttgagaattctgatagttgatgaattcagtgtgcttggaatgaacagggaaaatatggtaaaatttagccattttgatattagcaaagtcagtgtacttccaatggataaacaatgaatttaatcggatttgaaaaatccaaaatatggtgcttgagttgtttgtggacctggataagtagttttaagaatttggctaggcacggtgactcacacttataatcccagcattttgggaggccaaagcaagggagtcgcttgagtccatgagttaaagaacagcctgggccgggcgcggtggctcacgcctgcaaggctctaatatcagttggaaccccgggagcgcgccaacagacagcacaaggcggtgtggagcatcacgctgttttaatgcgcgcctgggtgcagacgggctgaggcctaaaatggcgtcagcgccacatgaggacggggcaggggttttacagtctcctgtaaacaggaagtgtccctgtctgatgtaacggctacgtggtacctggatggcctctctgtctatcctcggtggtgggtgtcttccggccggggtgcgtgtcttccggccggggtaggtgtcttccggccggggtaggtgtcttccggccggggtaggtgtcttccggccggggtgcgtgtcttccggccggggtaggtgtcttccggccggggtaggtgtcttccggccggggtgcgtgtcttccagccggggtaggtgtcttccggccggggtgcgtgtcttccggccggccctcttcctgcttctgcttctcgctgacgcgcgctgctggtgcaagcggccttgcgccttgggactgggtctgaggagggaggagttattcatccccccaagctttcggccccggggagaatctttcattcctgtctatttggttatagaaaaagggaaaaggggcgactttctccataactacttcaggtgtgacatagggggtggcgtgggcacctcggaaaaaaagaaaaaattttggcgtattcttgagagacgggttggtatccatcgtgtcgttgtagcaggagcatcgtctggattgtctggcggttaactgtagtttcaacaagagttttaatggcttttattatcagtgggataccacaggggagaaacaggaggaccccaatgatgaagattactgtccctaccagcgttttaaatccccctaaattagagaaccaccctcctagaaggtttgttgggtcccatcccttccaggtttggactggtacacgggctacttttctgatgtttgaagcgatttctagaaccgcttttccattatcatctatgttaagacagcaattggacatgttaaacttagcacagaccgcaccctcttctgttaataagtagtctagagccagcctgttttgataaattgctgggtgcgtttggttttgttgtcacacgagcatttccagggctgaggcggtttggttagtgattatctctagagcagcctgtagtctaattattctatttaggatatatgtgggagtgcgataaccccgtgaaccatcctcagcccaggtggcaggaccgtaatattcgatgatccattgcggaggccactcgtcctctcacggtctttggcttcctcctgcctttaaggaccgtttttctctggttatcatacgcagggactccgagggtgttgcccgcctgctttggaagtaagatgaatccaggttgaattgtgcgtaggaagctagtgctaaggtagccgtgagcaagcctgggttccccatatccaaaggaatccatcggggcagtccgtcgtcagctggtgttcctaggattgtcgcatagtgcacttaggcaggcgtatgtggcagaagagttagtggtgtttgtacagttccaggccttttttgacaagacacaattgaggtagctgaagttagagggagaccaggctccggggggtaaccttggccaccactcggctgtggaggcgttgactgttagggtttggtgacgggctttcacctgcggcacgatgggttttatcagtccacttgcgggatatgcacgccgtccctcttactgggttggtaagtgtccaggtcgacgggcgttcctgagaattcaaagtgaggctggggttttgaaatgctagtaattaagggggaaggtctatcccatgccacggccactgttcactcctgcgggctcccccgcatacccagcaattggacacattcgtggtaagcgcgatgccctctcctagatctacaaaccggttttttcctggctagggaggggatacgtctgcttatggtttttgtataaagggatggaagtaccacgggtgattttcgggggagttaaccccgggagcgcgccaacagacagcacaaggcagtgtggagcctcacgctgtttaaagagcgcctgggtgcagacgggctgaggcctgagatggcgtcagccccacgtgaggaccgggcaggggttttacagtctcctgtaaacaggaagtgtccctgtctgacgtcactgctacgtggtacccggatggcctctctctcgatcctcaggagtaatgtcttccggccagccctcttcctgcttcggctaccttggtgacacatgctgctggcgcaagtgtgctttgggactgggcctgagaagggaggagttattcatccccccaagctttcaggccccggggagaatctttcaacgcttacaatcccagcactttgggagacagaggtgggcggatcacgaggccaagagatcgcgaccatccagaccaacatggtgaaaccccatctctactgaaaatacaaaaattagccgggcatggtgtcacccgcctgtagtcccagctgctcgggaggctgaggcaggagaatcccttgaaccggggaggtgaacattgcagtgagccgagattgcaccactgcactccagcccggcaacagagcaagactccgtctcaaaaaacaaaacaacaagaaaacagaacaaaacaaaacaaaaaccagcctggaaaacatagagaacctgtctctacaaaaaaaacaaataaataaataataaataaataatttaaattagctgggcatggtggcatgtgcctgaggtcccattgactcaagaggctgaggtaggaggatcatcactagaccccatgagttcgagtttgtatgatcctgccactgtactgtagcctgggcaacagagaccctgtctttaacgtttttttaaaaaagaagaggtttaagaattagcatcacaaattgcatgcttgggcaaatgtcttacacagttttagtttttaataaaacgtgttaaagtgtaaaatgtctaatcaaacttctgagaggaaaagtagagaatccaaacattaatgcttattgacatgttctacataatttagatgctaaatcccagaaatatttatgtgtactgattgtgccttgattagaaagcctgaagcaggctctagacagtggtggagcttgcgggagtcacataaatgctgtgtgatcaacaggatttaagcccgtgggttacctgcttttacaacctaagcaccaagggatggggagccttggccgttagcagcctaagggagctcttgttcccacgcatttttcaaattccactggagtttcatgaggttcgttttaagactgccacctgaaatcaagtccagtggctgttcctgtcttcccgtccctgtattgacattaaaaccacttagtcaacactcaagtgcaagaatagtgtcgccatgttgtatgcctagtaaattctggatgtacgttgtacgtcaccttatttaaccttttgccattagtttacaagaagacgggttgagcgagtcaggttgcttactttaggttaacagggcagctggactccagcctaagctcttcagtgaagccctgcatcactccctctgcaggcagagggtgcaacccgggggtgtgggagggagcatggcacactcagcacgtggtaattatgtcataatcacataatacattcttttggcccgaggtcaggtcagaaggaagttgactaatttccagatttatttcagtcataatacccgtgtctagtgttgaggaaaaggaagggatgtttcctgtttgctgcttcggtatggttagccaatgactggaggtatttaaaaggtgagcactggccaggcacggcagctcacgcctttaatgccagcactttgagaggctgaggcaggcggatcacctgaggccatgagtttgagaccagcctggccaacatggcaaaaccccgtctctactaaaactacaaaaaattatatgggcatggtggtgggcgcctgtaatcccagctacttgggaggctgaagcaggagaattgcttgaacctgggaggcagaggctgcagtgagccgagatcatgccatggcactccagcctgggcaacaagaacggaactctgtctcaaagaaaaaaaagtgagcattgtccttcaccctcctttccattttcatggcattgatcagaaccttagaggatgaaacatgtcagaaaaagggagcagggcagagagattcttcacaggaaccacatcaagcgtgtgttaaaatttatttctgatctgccttccaaaattatgcccaagatatgcatcagcattaatgggtaaggcggtttgaggaattcggttatgcaatgactcaaagacccattaaatcacagaactgaagacatttttttctgtacataaatgtgccattttaaccatttcattctacagttcagtggcattaattacattcataatgttgtgcaaccatcatttatatctatttctaaaacttttatctccccaaacagaatctctgtgccattaaacaataactcccagccaggcgcagtggctcaggcctgtaatcccagcactttgggaggctgaggcgggtggatcatgaggtcaggagttcaagactggcctggtcaagatggtgaaaccccatctctactaaaaatacaaaaaattagccaggcatggtagcgagcacctgtaatcccagctacttgggaggctgaggcaaagaattgcttgaacccagaaggcagaggttgtagtgagctgagatcgtgccactgcactccagcctgggcaatggagcgagactccgtcgcaaaaacaaacaaacaaacaaaaaacctccccattcttttttatattttctgtcttttttattgatattctcattttttcctacattgtcttcctgatttcctttagttcttcatctatggtttcttttaagacagttgatttaaattctttgcccaggaaattcaatgtctcggcttcttccgggatgttttctgtctatgtatttctttcaccagaatgggccacactgtactgtttttttgatatgcttggtgatgtctttgtattgaaaaccggacattggtgtattatgatgtggtaactctggaaattagggtctcgcctttgttcagggttggctgttcttgattgctgaagccttagcttgtgtttcttttccagtctttcagattggctctgtgctcaggtactcctttaacacttagccaggtcatctataattctgccccagccttcacttctgcttgcactaagttgatgggtcttctctggccctttctaagcgtgcgtcgtgtcctgagctgtcgcgtgtagctttctgaattctacagtaccacaaacatttttgaatgctctgatttcccaaggaagcgatcttcctggcttttccccctggctttagattgtctagtttatgcctcaaccgtattttttttgcacccctccgcccgcttggccgtgggtttttgatcacctgacaatattttccagcaacacctgctgcttttctgctctgaacgtgttctgagttttgcaacagagaggcaagtgccttgtttcagtctttgggtagccccagacagattagaacaaacacagtgatttgcaagtaagatctgctctgctcccttcaaaagcaagtactggggtgccacactgggaatgagggctgctgttgagctggggaaaggggtgaggtaagggcaagtaaaaacacccaaagctttgctactcttttgacattgcctttctcttgattcggtggtcactgtcttgttcaggcatacctttgtttttcacagttctaagaaagttacatcttatagttctggatgttgtttttttttaaaatatttctgtgaaagcctcagagtttgaagctgcctgttctgtcattttgcttatgacactcaaggccttttcattttagggcttccagtagcaagaactgtgcccagagggatggaattagatcgaactgctctgaaagagtactactatttcatatttttatacaaaagcatattttagataaggatgtcattgatttagaaactcaaaccaattaatctttgggaagtaatattatctctgttttagagatggaaaaaaaccagcacagatattgaagtctcaagacactggttgagatagagttaaaataatagagctttaggaaaacagttacacatagaattaccatttaatccagccattaacttctaggtatatacccaaaagaatagaaagcaaggacccgagcagatacttgtacactaaggttcatagcagcattattcacagtagcaaaaaggtagaaacaatccagatgtccatcaactgatgaatggataaacaagatgtagtatatacatataatgaaatgttcagatttaaaaaggaatgctaatctgatacacgctacgtatggttggatggatgctacagcacagataaaccttgaggacagtatgctaagtaaaagaaaccagacacaaaaggacaaatattttatgattccacttatataagctatgtagaattggcaaattcacagagacagaaagtagaatagaggtttccagagctggagcaaaggggaatgaagaattagtattttatgagcactgagtttctctttgggaatgatgaaaagttttggaaatggatagtggtgatgattgaacaacattgtgaatgtatttttttgtttgtttgagacagggttttgcatttgttgcccagactagagtgcagtggcacaatcttggctcactgcaacctccacctcccaggttcaagtgactcttctgcctcagcctcccaagtagctgggattacaggtgcatgctaccacgccgagctaattttttgtacttttagtagagacggagtttcgccatgttgggcaggctggtctcgaactcctgacctcaggtgatccacctgcctcagcctcccaaagtgctgggattacaggcgtgagccaccgtggccagctgtggacgtgtttaatgccactgaattgtataccttaaaatgtttaaaatgttaaattttgtgttatgtttttttaaaaaaatagccccccaaaatcataacaggtcaggcgcagtggttcgatccaataatcctagcactttgggaggccaaggcgggcagattgcttaagcccaggaattcgagaccagtctgagcaacatggtgaaaccccatctctaaaaaaatacatacaaaaattagccagggggtgtgcacttgttgtcccagctacttcagaggctgcagtgggaggatcacttgaactggggaggtcgaggctgcagtgagccatgattgtaccactgcactccagcctgggtgacagagtgagaccctgtctcaaaaaatatatatataacactccaaactcagtgttagggacatacaaagcttaactaattgaaatttgctgagttttaaaacatagttctcgagcatttattatttactatatgccagccactgtggtacatgctttatgtggattatctcatttactccttgtcacaatcttatcaagcataatacaattagctccaatttatagatgtgggatctgaagcacagagagattaagtaacgtgcccgatgtcattgctgaaaagtgtatcactgagataaagtacatcccaggacttcatcccaggtagtctgacttcagactttgtgtctaatggttaagctatactatctcacttttgctgaactttaaaagtgtgcttaaagcaatacatgactttccacaatttgccgcagaacaattattgcacattcctttcctcagggtgtgttggtggctatgattcctgcctgccagcctcagcaagacaaaacacaatcagagaaaaggtggatggttcactcttaagggaagtagtggatttgggtttgtttcagtaatcgtctctgaataatggcataaccttctctcagatttttaatttgatctagtttcattgcagtgaaaggaagctttaacacttggatcaaagaaagtatttgtataaaagcagcgaatgtagttttgaatgatagggtacttgtactctgaatagtagtatacaatatttgaactgtatgaggcctttttttattctttctttctctctctctctctcctcctctctacctctcctcctctctccctctctccctcttcccgtctccctcttctgagtctagctttgtcttccaggctggagtgcagtagcctgatctcggctccctgcaacctccacctcccaggttcgagtgattctcctgcctcagcctcccgagtagctggaactacaggtgcacaccaccatgcccagctaattttttgtatttttagtatagataggtttcaccatgttggccaggctggtctcgaactcctgacctcaggtgatccacctgccttggcctcccaaagtgctgagcttacaggcatgagccactgcacttggcctgtgtgaggtctttaaataacccttccctatcctcaaaaatgcccatcagcttagtttatgcatcagtaacactacaggttgaacatcccttatccaaaatgcttgagattggaagtgtttcatatttcaggtttttttttgattatggaatattcgcatatatatagtgagatatcttgaggatgggacccaagtctaaacacagcttttttatgtttcctatacccaccctgtgtatagagactgaaggtaattttatacaatattttaaaataattttatacatgaaataaaactttgactgtaacctctcacatgaagttaggtatagaattttctccctgtggcatcttgtcagcactaaaaaagtttcaggttttggagcatgtcggatttcagatttacagatcagagatgcttaacctgtatcatcgtatatataataattgccactctttacctaggccttggtgttttctgtgtgacatctttccagtccccattttgactgcaataaatttttttttttttttttggagacagtctcgctctctacaacctccacttcctgggttcaagtgattctcctgcctcagcctcctgagtagctgggattataggcatgcgccgccacgcccagctaatttttgtatttttagttgggacggggtttcaccatgttggtcacactggtcttgaactcttgacctcgtgatctgcccacctcagcctcccaaagtgctgagattacagatgtgagccaccatgcccggctgactgcaataattttttattctcttaattacttactaactagagtaccagctgtgagattttgctcttaaacatccagtcacatcattttcccaatcatgcaaagaaatggtaatatccttagtgatattcacagagcattgtgaatatctgccgatcaatgctagactattaaaaggaacgtgaatgtcagggtacattcctagtgttttaaggtaaaagtcattaaaggatactactatattgtttcacaaaatgcctcttgaccattatcagagatagattctaagctaaacggagcagttatatgttagaactgacacagaattcaggcggtgtgatcaattgaataaaatttctcaatcaaggtaatttccccagtctttggcccatggttattacaaaaaaaaaatttttttttctttgagacggagtctcgctctgtcacccaggctggagcgcagtggcgcgatctcggctcactgcaacctccgcctcccgggttcacgccattctcctgcctcagcctcccgcgtagctgggactacaggcgcgtgccaccaggcccggctaattttttgtatttttagtagagtcggggtttcaccgtgttagccaggatggtctcgatctcctgacctcgtgatccgcctgcctcggcctcccaaagtgctgggattacaggcgtgagccactgtgcccggccacaaataatttttaaaaagaaataatacctcttcacagctactcaggagactgaggcaggaggatcatttgagtccatgagttcaaatccagcctgggtaacataatgaaaccccatctctgggccgggcacggtggctcacgcctgtaatcccagcactttgggaggccgaggcaggtgaatcacctgaggtcgggagttcaagaccagcctgaccaacatggagaaaccccgtctctactaaaaatacaaaattagcctggcatggtgatgcatacctgtaatcccagctactcgggaggctgaggcaggagaatagcttgaacccaggaggtggaggttgcggtgagccgagattgtgcaattgcactccagcctgggcaaaaagagcagaaactccatctcaaaaaaaaaaagaaaccacatctctgaaacccttagtagttacatgtaaactgtcatctccattttagagcttaatgaagttgacaggtcttaaattaggtcttatgaatgtgcctgttactgtctttaaatacttataaatagcatcaccaagttatttaatgggtagtttttaactataggtcacttggctttcacggatgacaacgataaatagaactttttgttcttgtctagctatatggattcatatgtggcagcagaaagcttcatttatattgagtgagattttgtagggaattacatggggcggtatgttttgatttggtttttctccttaactataaatatatcttgaaaactttttgtgtatcagaaggaattttaggtcagacatggtggctggcgcctgtactcccagcattttgggaggccaagatgggaggaccagttgaggccagaagttgaagacaagcctgggcaacatagcaagacaccacccccactgcccccccagaaaatttaaaaatcatccgggcttggtggtgtgtgcctgtggttccagctactcgggacactgaggtgggagggtcgcttgagcctgggaggttgaggcttcagtgagtcatgattgggccactgcactccagcctgagcaacagaatgagacttatttttttcttttttcttttttgagttggagtctcactctgttgccaggctggagtgcagtggcccagtcttggctccctgcaaccttcgcctcccgggttcaagcagttctcctgcctcagcctcccgagtagctgggactacatacatacgccaccacgcccggctaatttttgtatttttagtagacacggggttttacaatgttggccaggatggtctcaatctcttgacctcatgatccgcccaccttggcctcccaaagtgctgggattacaggggtaagccactgcgcccggccaatacttttttttttcaagcaaaactttgtaagactcatgtgacatcaaacgtaataataaaaattttttgaaattcacacggaaaaatactaaaatttccgtgttacatcatgaatgctttaatattactttaaaatcttagtatattataaagacacacaattcacaattgtcaactcacagcacatcagtctaagtactcctgattatgctaatgtttattttctttattattgcttttactaaaaataagctcttagcatattatcccttactaaaaagaaatgaactgtcaagcattaaaagacatagaggaaaatttaatgcatgttactaagtgaaagaaggcaatctgaaaaggctacatattgtatgataaaatgtgaaaaaatatatacaagctcaatgatgttcaaacctacagtattggtgaataataacctaagcaatttaatactccagcttagttcttataactcctattattcactatgacatgagtcatataaactttattagctttaactacactttcctctgaatgtttgtcctcaaataagattggacttgtctcagaactgctttaccactcttgtgacctttttcagttaagtgacaataaagctgtttttcaggctgagacttaggggcactcctgcttttggcatgcactgtctcatttaatcctcacactaatattataaggtagatgcaacagcccccatgttacagaggaaaaaatagaggatcaaagagattaacttgccaaaagtatggctaataagtaggtgaagcatgctgagaacttagggctgccttaatatccatgtcattcttccaactctttggcaacagttttctaatatgagttctttaccccattaatgctgtgaaactaagaacaccatattttaagtggcttaaaattccaagcaaccagaatatggctagtgttactttcctattttatatgtgcctaaagtaaagtacatccttggtcatttcataacatgtataacaattgctatgattatttgagccacgatagaattctattctaagagcttggcagagctagaagaacaacctgctctttggtagggagtattgcagcacgcttcttgcaaggacattcagttttcttgcctgaaaagcaaacacaccactatttgtgtagtcaccagtctaggcaagggaggaacaatggttttaaaaatacacccagaaaggaactagaagatacttgtattaggtgggtaaccttaccttccattatcgtaaatagttgctcaagcttcttcacagtaatggtctgcatttcttatgtagcaaaacctctggagattttgaatgtttttgatggtcagaactagagaacttctctatccaatctcttcgttttaggtaaggaaactatataggtcagcaagtaaaaagtctaatcgaaggtctcttggaaaaatcatagcagaactgaagtctcttgctcctttcccagtgctctctgattttatattactctgtccccacaaggaatgttatctcaaggtaagatggttttgtatagtaatggttatctctgaagctcatgttgtttaaggcctgacagataatccttttgtagtatgagtcttgtagttttgctaacgtcttcagtgatttagtgtgacccctctgagcctagatcatattttccttcccctccctacactcaatgattaaagtacgatattctttctaattgcccattagccccctgctgctcttggaatccttagacttctgtgggcttttggaacttctgctgttaggtttcatgaataatagtcccctttctgttgagtttctctggttacatcattttatttaccaatgtattgctttttaatatcagtaacattgaatattaaagtaggtgataaaatggatcaagcaggaaacttgaccattacaaatcgatgctaactaaataaccgagataaccacgatgcaggttgccgattatccaggacccttttttgatctcctttggaaagggagtcatcaattctgtcctttttccttaactttgaaagtccatccttctttggcaatagtcttcaagggttttatttagctcccttttactaaaaacaagcatcacaaaatctcatctgttttttacaaagaagcctggagtaataccctgataactataggggaataatgtcatcaacagaagaatagaatttgggaagctgaccttatcacagtctatgagattaaatgtcttgggcatagtagtgtagctagagaaaagggaaaaaaaaaaaacactaattctcttagtttctttgtagttctccgtggaaaactcctttacccacattggtacccttttggttttgctgctatggtggttagaaaattagaaagcagaagaatcacctcctgtttttagaaataccctaaaaaatggcaggccatcactgggccttgtacttctaatggccaaaatgtatagcaacataaagtgtctagaagagaattctctaaaatacaagtaatcactgtaggtgattttttaaagaagcacagcacgtggaattgtagtgttgaagacaccatgctgggtatcactggaataacccctgtgctgccagcgttgatgtgaaatagaagatgacatcttaaaccaattactgtactgcaacctagcgtcatacgaggccatataccaggttcagaggaaagtaacttgacttcaagctcatgttatagggaaagatgtggattttattagagtagaacataaataggcttaaacaggaggaaaatattctagccgttaggatctgtaattgctcagaaaggcaggaagtattttactttgggagatgaagaatggaccagtctggccagggcagtgggtttcacattcaaatccaaagatatgaactacagggcagtagaaggcagggctctgggcacactctacagggaggacggcttcagtcatggtgcatacacacgatgggctctgggcacactctacagggaggacggcttcagtcgtgcatacacacgatgggctctgggaacactacagggaggacggcttcagtcgtgcatacacacgatgggctctgggaacactctacagggaggacggcttcagtcgtgcatacacacgatgggctctgggcacactctacagggaggacggcttcagtcgtgcatacacacgatgggctctgggaacactacagggaggacggcttcatcgtggtgcatacacacgatgggctctgggaacactacagggaggacggcttcatcgtggtgcatacacacgatgggctctgggcacactacagggaggacggcttcatcgtggtgcatacacacgatgggctctgggaacactctacagggaggacggcttcagtcgtgcatacacacgatgggctctgggaacactacagggaggacggcttcagtcgtgcatacacacgatgggctctgggaacactctacagggaggacggcttcagtcgtgcatacacacgatgggctctgggcacactctacagggaggacggcttcagtcgtgcatacacacgatgggctctgggaacactacagggaggacggcttcatcgtggtgcatacacacgatgggctctgggaacactacagggaggacggcttcatcgtggtgcatacacacgatgggctctgggcacactacagggaggacggcttcagtcgtgcatacacacgatgggctctgggaacactctacagggaggacggcttcagtcgtgcatacacacgatgggctctgggaacactacagggaggacggcttcagtcgtggtgcatacacacgatgggctctgggaacactacagggaggacagcttcagtcatgcatacacacgatgggctctgggcacactctacagggaagacggcttcagtcgtgcatacacacgacgggctctgggcacactctacagggaggatggcttcagtcatgcgtacacactatgggctctgggcactacagggaggatggcttcagtcgtgcatacacacggtattactgaagaagttcctttctgaggcagtctagctaaaggtatgcacataggcagatagtctattaaatttgaacatgaatattaaaactgacactgagatttcagtgaagggtgaagttataatttataacagtgtttaaaatttggtgtatttcagtagctgttagttaagcatttatttattagtgatttttgagaagtttgtgttacttctttttattaggaaaaacatttgactagccattagctctggcatctgaattcctgctactctcctagcatctagaagtatttctgatgttatcagacagagtttaatcagaaagactcaacttctttagtggtttcatatgataaacacatttaccttcctgttcaggtctgttttagtttgggcaagccagggcatcaa

SEQ ID NO: 746 - DNA, 93012 bp, Homo sapiens
aaaacttaaaatgttttgctacaataatcacctgaaaaaaaagtcagtcttctctacagtataatgtggatggacacaaatgagtggttttaagattatgtttccttcccttgtttttaaaaaacatttataataagtaaaattcttcaacaagagcaaaatcatatcagtttctagtatcagtgtttgccaaagactgctctttaaaataaagggatcacctcagtccaatctacttgacatgatcctaccttgtcagacaagctagtcaagatttggaaaaggcaactacatttcaatcctttgaaaatctacataatcctaagcacagacttatcaggattggtaatgggtcaagtttagggacacgttacaattacaatgtaatttttggctgtagttgatcagcaagtttacatccatatattcatccaagttgctcttcctcaaaaaaattaatatgttgacatttctacctgcaagatttgtgattcatgttttaattattacaattttcatataacatgttttagaatacctgatattgtgggtgatctcaatttcttcctgggtgatctttcctggtttaatatttgtatgattccaatgataaatctcagataatataaatagcaaaaaattaaaatactgagaaaataatatacaacttattaggggagaaagaggaagagatgctcccttagtggcacacagaaggtgggatgcctggtctgctttttctatatttttgcatatttggggttcagaaaactgaaacccatagagtcaccatatgctacatacactgaacctaaagtaataagtagttctgaaagagaacagaggagaagagggactccctacagggataaatggtccagacttaaggtatggcttatttatgctttcaacaccccagggactacaatcccagctgaccaattaaacttcgagagtttcagtggagatttaaggtcctgggattacttctggaaaaaaattaaaaagcttaccgtgcaattggcccaatactcaaaccaaaatctaatggacagaaaatatacaatttacaaacttgtgctttttttaaatgttaattaaaaatatgtttattaaacccacagatttttttagttggaaattttaaaattaaatttgattaatgaaaaaataaaatataaggaaaaatgacatttggaagcaaaatgaagaatttcagaagaaagaaaacattcaactaaatgatcttttgaacatattgaattcagtttgctagtgttgagaatctttacatccatgatcataaaataaattggcctgtaattttcttataccgtccttgtctgacattggtgttagggtaatgcatgaaaaaatgtgttggaaagtgcaccctttttaattgtttggaaaagtttgagaatagcattaatctgtctttagatatttggtagcaatcaccagtaaaagcatcaagtcctgaacttttaagtttattattattattattggtgatttaatctctgtactagttattaatttgttcaggtttattctttcttcaggacatacatgtctaagaatttatccatttcttctacgttactcaatttattgacataattggtcatgataatctcttatgaccctttgtattttggtagtattgactaatttctcctgctttacttatagttttatttgagtcatctctcttagttttcttggtttgtctacctaaaggtttgccaattttcctcacgtttttacagaaccaactcctcgtgttactgatcttttcttttgtctttcttatctgtttaattctgctctaacctttataactttcttctttcttctaacttttggcttttttcttcttttctaattcccagagtgccaagttaggttgcttatttgggatcatttctctctctgtctcagtagctatcagaactacttttgctgtaccccatgatttggtatgttatttgtccatttttgtttgtctcaggatatttttaaattgtctttatttttgggtccatttgttgtttatgagtgttgagagtggggtattataatcccctactattatcatattgctgtttatttcttttttgtgttctgctcatgtctgctccatccattttggtgttccaatgtttcctgggcctatattgaggcaccctaactaataacactttgcacatcaattcatctcatttctcacaaaagcaaacagaacaaaactgttcaaacatacataagggagtcctagttgctgatacaaacttttagatagtcttccaatctttttatcctactttaattctccaatgatataataaacatccaagacaaaaaaaatgaaaaaagcacaaatgattccttcactgaaatcaggagacaaaggcaatccatcaactataaattacacgtaaggaaggggaagaaagtcacggacactcatcagaattggtacagaaactccatattggaagcaggaagtccggcagagaagagacccagtcaaggtcactggtggtggtaatgataaaaaataccaggaaatattattccccaagaaggagagggtcctctcacaagtgtaaactgctatacccaagcctgatgaacacggagccaggtagcaatctgaggattattgaagagatagatgcagggagtatacctgggaaagaagtggtggagataacaggacaatcttgcctaaactaagggggtcaccatcccaggcataaccacgaataggaaggtggtagaaatgaacatggagaagacagcaggaatgcatacaatgaagctgtagggcttgagaaacaagaatattccccaatgcctgcaagccctatgcaatccacctggtaacaactggaaaggcaaatcaaattctgaaaaatgaaattagaaaatgcaacgtctttccaaaaatactatagaaaaaaaataaatctaccccaaaattattgccttaaatcggagctaaatactgatataaacttcaaatactctacaaccccaaatccttaataaagcagttttataaatgagaaaacattttaaaacagaaatatgacggttcagagaactgatgacccactaaaaagagacgacaatcggccaacagaaagatgtgaaatgggaatcaccctgagtcaggagagaatttaaagggagtgatggggacgaagctgaatggctgctccgtggcttgtgagtgattgtaaaataataaagatgatggagaaaatataaaagcaagtgtaaagaaatagtgataagcactagtgtaaacatattggctacaattgaatgatgaaggaaaggagaatagacatatcttctgaaatattttctgttcttccttatgctaggaaactagtagatactgtgtaaagagagggaaattaaggatattttagtcttataaaatatgttttatgcataggtatttgtacataatatacacattttgttaaatagaaaatattaaataccacacaatgaaataattttgaaataaaggcaaagagttgattttgtcttcttactgcaaagaattataagtatgtgaggtgatgcatatgttaattacctcaatttacccattccacacaatatacatattttaaaatatcacattgtacatgataaatatatacaattttatttgttcatcacaaaaatttaaaaatggcaattaaaataaaggtaataacaaagtgtgagggaatatgattaaactaatggggtatatcaataaacacaatgcatttaatacactgaataaagaaaaaaagattactattctctctgcctggtggtctcttttccgatacgttgtgacccatttcttcaactgatttaggtctctcttctctgctctcttgattatcagagaagacatctctgagcagtgaatataaaacagtaattatctcctacacaccctattttactcttctttataatgtttatcattcctgatagtttttttgcgattattatctcttctctaccatagaatgtaagatccaggagataaagcattttaccatttttatcactagtgtctttccaatgcctaaaatatagcacctattccaaaacagacgctcaaaaataagtgtttcttgagtcaatgcatttattcatttttgaggaggagagattgggttaaacaagagggttaaaaactcagaatagaatgacaaccaaacgagagcatagtcagtattaatacagaaaatatttacaagacctacttgaaagaagatatagttgtaacacattttccatgattgttcagaaatttatatttctgggtacattaacttcttaggcaactagagcttacttgtttaattctttaagcttaataaattttaaagtatggagtacaatatgccaagtgaaacaagtcaggcacagaaagaaaaatgcagcatgagctcatttatgtgtaaaataaatggaaattgagtaagataaatagggagttgaagggcagttgccagagtcagggaagtagacaaattgggataatgtaggtaaaagaagacaaaattacagttatgtaacataaagatatttagagatctaatgtacaacagaaggactatagttctattttattatacattacaaatttgctaagagaataactagattatatgtgtttttatcacaaaaaagtaaactgcagacagtgatggatgtgttaatttgctagcatgtggtaattatttcactatagatatctacatcaaaacatgttgtacatcttgagtttatacaataaaaaaaaatactcgatttaatgaccaatctggacttatttattttaatgtttatttaaaatatttcatgctgtctgtggcctggtatttgggagaaagggggataaaatacttcaatcaatcatgtcaacacaatttttgatgagaaattgaaaactgaattgttcaaattgttccagttctcaagaggaatgcttccagattttacttgtttagtatgatggtggctgtgggtgtgtcatagatggctcttatttttttgagataagttcatttggtgcccagtatattgagggtttttaacaagaaaggatgctgaatgttatgaaaaatcattttgcttctattgagatgatcatgtggtttttgtatttaattatgtttatgtggtgaatcacatttactgatttgcacttgttgaaccaaccttgcatcccagaaataaagcctacttgatcgtggtgaattcactttttgatgtgctgctggatttggtttgctggtatttcgtggaggattgtgtgtctatattcctcaggaatgttggcccgaactttacttttttttgtcgtatttgtgcctaattttggtatcagaatgatgctggcttcacagaatgacttagagagtattcccttctcaatttttaaaataatttcagaagattttgtaccaactcttatttatatgtctggtaggagttggttgttaatccatctggtccagggcttgttttggttggtaggttttttttaatcactgacttaatttcagaacccattattggtctgttcaggatttcaatttcttcctggcttaatgtcaggaggttaaataatcttgggtggagaaatagataaattccttgtttcgagggatttatatatttcttctaggttttctagtttgtctgcagagaggtgttcataatagtcccttagggttttttgtacttctatgtagttggttgtatttcaactttgtcattcctgaatttattaagcatatgaaaataataaactataaaggaataaagaaaatagatttagaagaaaagaaagtgttcaaggaaattaaaaagcatattgaatcataattttatactttaaattgttttatctgtgaatataacattttatcatatactatacatgaagataaacagatacttcgtgcagttggtaaccgaaagatagccagagtggctatgttaatgtgagacaaagtgagtttatgacaaaaatttttataagtaaaaaaaaaatcgtatactgtttgggatcatttgtgtatcttccttggagaatgtaatatagatctttagatataaaaattgtaaacatgaatgaatgtaacagagacccaaaatatatgaagccaaggtggacagaattaaaggaagaaataaacagttctgtacttatagttcaatacttaaatgtccattttcaataatgcatagtgcacttagacagaatgttaatatagtagtaagtgactagaacagcactataaaccaaatgacctaatatatatgtggagaatactgaaatagcagagtatagatgcttctcaagtactaataacacattctccaggataaattgccaaaaacaaataagactaaattttaaaagatttaattcaaagtatcttttccaatcaatgaaataaaactggaaatctgaaatagagggagaactacaaaagttacacatatgtggggattaaacaccacactgtgaagcaccggtgggtcaaaaaagaaattggaaatgaagttagaaaatatattcagatgacttaaaacataacaaaacatataggatgcagctaaagcaactcttagaaggaaaattttagctagattgcctatactcaaaaaaagaagaaacatctaaaaacaataatatatttttacaccttaaggaactagaaaaagaagagcagactcaatacaaagcaaacagaaggaaaaaaaagtattggaatagagattaataaaatgcagaatagaaaaaacaatttgactatttcgagctttcaaaagatcaacaaaatatagaaaactttaggtaaacttaccaaagagagaaagagagaagtcttacatcatgaatacataaatatgaatataacatgggtacataacaactagcctttcagaaacacaagcaattataagagaatattacaaataattgaatactaactagataccttcagtgagatgaaaaccaaatcctggaaacacagaaactaccaacacttactcaagaagaaacttaaagtagtgttaaacaactaacacactgaaaattacaaagtactgctaatagcaaataaaacataaaccgatgaaacaacatcgcatgttaatggattgggagacttgtggttaagataatacaaccaaaatatatccacaggttcaatacaatgcctataaaaattccatggctttttttttttgcaagagtagaaaacactaaaaatcatatgaaattacgagcgactgcaaaatccaaaacaaccttgaatagaaaaacaaagttggaagatttacacttcctgagtacaaaatttgccaaaaagatacactaattttaaaagcctgataacagaataaggatatatgcataaataaatagaagacaattgagaatctaatgagaaatacacgcatgtgtctatggtcaataatcatctgacaagcatgccacgtccattcaatgggaaaagaatactcactttaacaaattgtgctcagacaagaagatatccacaaacaaaagaatgaagtggcattacaaatcatacttaaactcaaattgatcagggacctaaacataagaagtaaaattataaaaatatgagaaaagataaggttaaatattcaagaccttaagtttagcattttttttagcatgataccgaaagaacgagcaataagaaaataaataattggacctcatctaacttcaaaatttttgtgcttcaaaggtctcaatcaaaaaagtgaaaagagaggagagtgggaaagctggcagaacggaattctttaacaattgtatccccatagaaacatcaattttaataactattcttacacaacataccttcacaaaagctagtaaaggcatgtgagagatcatagaacctggtgatacaattttcatcttgttataaaataataagattagaagcattgaagagggcaggaaggagagttttgattacctgcattttttatccccaacctcagacagcacagtgcagggagaaataccaaacacttggagaataaaaacggaagtaagtgtgggacttggtcttggtgcccaacactaggcccaccacagaagaactgaaaaccaggcagcccccacaaccactgactccaggccagtacacaaagaccgagcctccagatctacaccaacactaggcagaaacctgcagcccatgcaaagcagaattaatttgcagtcatcatcactgccacccacccagagtggccttaagctctggaaagtatccactggcaggcaggcctcagtgaacatgggcttcagacttgcatcagtgctgcaccagccccagtggccacaggatatcatctgggacccacaccagttccagtggccatgggattacagcactgcactgcaccagtcgtggcagtcccaggcttagggcaccacctagggctgcccccaccacagcaaactagagcttagggaccacaccagacaacctgctcagaatctctagacaggcttactattgaagaatgtttcaggataaaacaagtctgcaaagactggaataagtacctattatattagatgcatgactgcagacgcaagagaaatcaaggaagcatacatcaccaagcaaacaaatggagatgcataaactacctgacaaagcatttgaaataacagtcttagggaagctcagcaaacttcaagaaaatacacagaaactattcaaacaaacgataaaaataatatgaccacaatgataaacttagcaaatattggaataacttaaaaatcaaacaaattctaaagctgcaaaatataatgaacaaaatgtaaactgcagttgagaccatcaacagcagaatggatcaagccaatgaatctgtgaactcaaatacaggttatatgaaaatagagaagagaaaagaatgaaaaataataaaggaaacatgagatttactggacagcaacaaaacagcaaatttttgagtcattggagataagggagttgaaatgataaaggagtagaaagcttatatgaagaaataatagaaaacttttcaaacctggaaaaagatataaataaccaggtacagtgaggtaaaaagtaaccaatcagattcaatccaaacaaaactacccctaagacatattataatcaaaccaccaaaaattgaagggaagcttctctgtattggtggaaggtaggtagggcttttctagcccctacttccactctatcccctgagttccacctgcactgactcaaggaagagtaagcatctagagctagtgagaatgggaggaacttacaaagtcaagagagaagcctattgttccttgctcacccacagattacgtactattactcaaggcttgctgtatttattatagaagagaaaatcttcttgtattatatatcagctgagttattgcttatctgagaatcaccagaagtttccacccgagacaggataagagaatagaaccaacatgttgggatttccagagcaatcaagagaaaagaaaatctattgtgttattattgcccctgagaaatcacacttttgtctttcctaggaagctgatgcttacaacaatggagattagcaatacctggacagagttgagcttcaaaggatactgagaaatagctaaagcaggtaaaaagagagaagactggaactttgtctatgcttatcatctagcttcaaggagaaacacagttgagttcagccattttgaaacaatggttagaaactagataaaaagttcttaagcttttcattatttatttatttatttatttatttttgagacagagtcttgctctgtgtcccaggctgcagtgcagtggtgagatctctgctcactgcaacctccgcctcccgggctcaagtgattctcccacatcagcctcccaagtagctggggttgcaggtacctaccaccgtgcctggctaagttttctatttttagtagagaaagggcttcatgatgttggccaggctggtttcaaactcctgaccttaaatgatctgccagcctagacctctcaaagtgctgggattacaggcatgagcccccgcacccagcccttaagctttttatgagcaaattaatatttcaaattaaattgaaccaaatggttttctcatacgatggagcaacattcctcatgctggaaaatgagatgctcctgaagtctttgcatcttggtcctctaccgttgttttccacattgatatttatgtgttctgtttagagacttgatgtgttcccagaactttctgaagagccccaccacatccttgtttctcaggatgtagatgagggggtttagcatgggggtgagtacagtgcaaaatacagacacagcttgtttctgctcagggatgtgggagaaaccctgtgtcacgtatattaaacacacagttcctaagtaaagaccacggaaagatgggaggagcagttggccaaagctttgttcctactttagggggatttcatatggaggactgtaaggaagatgaggtatgagaggccacaagtccaagatgaaatggataagaagtagagagccacaggccaagatcaaatgggtaaaaagtagagagcctgcatttgaaccaggtagtctgactcagggtccacacatcatctcaatcatggatgactaccacagacagcttgttcctttctcatccccatattctggcttctctcttgccatgtacacctccccttagtctccatacctggggccacctgcccccacaatcctgttcccataatatctcaccttgaatgaagagctaagccaggaaggaagcatctgaaatagtgttgaagaaaagctgaagtgagtggagaaggacatcactttgtgtcctttactttctgttggccaatgcctgtctcccggtctagaccctaccacctacaggtgaggcctcaagcacagctcatctctggactgtctccatgtagaaccaatgtccctgctcagattagatatatgaaatcccctagttgtagatgtgggggcctatggaaatgaacctctcataaactgctgaagggtacaaattaacacagcttgagagaagtggcctggagtgagcttcacttcacactaggccaggaccacattattactcccaacaaaatagtttgtttataatccttttcgtggactccagaagaggaagatggcagataggaggcaggactaacgtgcagctcccacttggatggacagagcagcatgtggagattcacgctgtgaacttttgctccaagaactaccataggacataccaggaaagccaagagaatccaaagaccctttgaaggaggtggcggccactgtaggctccgtgccaaaaactgagtgccaaaatgtgtgaaagtgtaaaagggggatgctccacccccaaacacagatcctcactggggaacctgacggtccacatggtgggaaaaggatttaatcttacgcggagctaagaggaatttagagagccaagcaaaatattcgagtagaggaaacaacaagaagagccctgtgggaaaccatttcggactttgtcttgcaggggtcctttgggagggctgccagtggaattggggaaagactacaaggagaagcaagctttcagatgaattttgtaataatcttgactaacgtgaagcttcctggacagaacctgggggagggggcaaactgggagtgcagatacaagctcagaagctgaggcaggcagagaggcatgaaacctaaaagccctgcttgctttcttcatgaggggcttgtagcctggggcaagttctcagccctgctcaccagctgcctggaaaaaactcagtgctactgggggcacaaggtgggagtgagactggccttttgggctgcctgggagctgagtgaagcatgtaactgcccgttcccccccttctctggtgacctgcatgacccagcagaggcactcataatccccgtggaaacataactccatcagtctgaggaccacaccccaatcccacacagcagccacacagcaagccccgcccaaggagagtctcagctcagacacgcctaacactgcccccacctcttggcctttctctacccaccctgggagccaaagacaaaggacataatctcatgggagctctgaggcccggcccattgcctgagaaatctggatacttatccaggtaaccctaaggcaagctcgtatcttccctacactactgcagctgatgcaactcttgaaagaatcaactgctggctggagaccaaccagcaaacttatcaaaaatacagccaaggaccctcacagagtccacttcactcccctgctccctccaccacagcatgtgctggtatccatggctgagagacctgaagacagatcataccacaagactctttgcagacactctccggtaccagccagtaccagagcacagtagcttcgctgggtggttagatgtggaagagaaataacaatctctgcactttgtttctcaggaacccccatccctagaagaaggggtagagcaccacatcaagggagcaccccatgggacaaaagaatctcaacagcagccctttagccccagaacttccctctcacatagtctacccaaatgagaaaaatccaggaaaaccattctgaaaatatgacaaaacaagattttctgacacccccaaaagatcacactagctcaccagcaatggattcaaacaaaggagaaatttctgaattgccagaaaaagaattaagaaggtcaattattaagctactcaacaaagtaccagagaaaggtgaataccaacttaaatttaaaaatgtgttacaggacatgaatggaaaaatctccggagaaacagatagcataaataaaaaacaatcacaactgctggaaatcaagaacacactagaaaaatgcaaaatacactggaaaatctcagaaatagaatcaaacaagtagaagaaacaagttcagagcttgaagacaaggctattgaactaaccgaatccagcaaagacaattaaaaaacacacctttaactgtgttttcttatacttcgggctttttgtaggttaatgacttttcttaattcctaagtaccatctgagtaattagtcacatggttataaagaatatcaaatgtcagactaaattcttttcaagcttccctcagcagcttaaagttgaaaccttttcattccttcttctataatcttgggtatttgaaatgggtattctcccacttgaacataggcaaaatctaatttcttgtctctaccctatggaatctcatttagtaattatttctaaacttatcctgatgccatgcatcattggtttgttataaatatatctaaaggagtacacaacatttactaaagaaacacattccccgtgtgatgtgtcctgataagaaaaatgacctccaaatttacattcctgtacaggtatgatgatttcactctaccatactttattttatacccatctattgtttcttccacaaatatacataactggagtcatagccaaaacttgtattgcctgggcctatttgagcataaacagcaggtattagccctaaatagggggtcttctgccaacttgggtgtgttaggaaacatggacaatattcaaaatggcctgcaggactccagtttcaaagtgaaagataccatgcccatccaagacattgcagtttgcctttccctgatgattagtgatgttgagcactttgtcatatacgtgctagccatttgtatgtcttcttttgaaatatgtttttcgatgtcttttgcccatttttaaaatcaaattatttgtgagataattttggtactcagttacttgagttctttatatattctggatatgaaccccttgtcaaatgcattgttggcaaatcttttctcccactcgtatgttatctattcactctgtgaattgttttcgttattgtgcagaacctttcagtatgatgtaatctcattttttaattttttattttttccctgtgattttgaggttctactttaaaaattcttgcccagatcaatgtagtgatgatgcattctgcctgtgttttctaccagaagttttacagtttaagatctgatattaaagtctttaatccaatttgagtttaaaatagtgaaataagtgtctagtttcattctgtatttggatatgcattttttgcatcaccatttattgaggaagtagtgcttttcttggtgtatgttcttttcaacttggtcaaacatcagttgactataaatgagtgaatttatatctgggctctcaggggttctcttctgtttgtgtgtctgcttttatgccagtaccattctcttttgatgtttaatagcttgtagtatatcgggtagtatgatgcctacatattcattcattttgctcagaattgcattggctatttggagtcttttttgcttccatatgaactttaggattgtttttttctatctctgaagaatatcttttgtattcggatagtgattgctttaattctgtagctctcttttggtagatggacattttaatgatatcaattcttctaatccacgaacatggggaatctttccatttatttgtgatctcttcaatttctttcattagagttgtatagtttttcttgaagagatcttttactttggctaaatttattcctagttattttgtatttactttagtttttgtaaatgggattgccttatttctctttcagattgctcactgttggcctatataaatgctaattttgtatgttgattttgtatcttgcaaatttactgaattcatttatcagttctcacagtttttgctggtgtcgttaggatttttttaatatatgaccatgtcatctgtaaacagggaaaatttcagttccttctttccaatttggaggcctttgtttccttcttttacctaattgctctaagaccagacacagcttctcttttttctctcctgaattcatgggaattcaggatgttattgtttttgaatagtttccagttctatttttgtgggtgtggatgaatgatgctggaggatcttctattcatctatcttgttgctataactcctctctatgagtctttcttaactttttaaagatacagtttgctgttagagtatagaaactccaatttctgtctgttgatttcctgaaactttcctgaatttgttagggaatagtttttgttgaaggctttatgtttttttatatgtaatattactttattaacaaacagaaacatgtcacttcttcctttcctatttacatttctatttatttttcttccctaattgctttagctgggactttcagtgctatgttacataaaagtggcaagagtgaccgttctggtcttttgctggatcttagagaaaaagctttcaacatttcatcattaagtattatgtcagctgtaggcttatcatatatggcctttgttatggtgagatacattccttgtatacctaatttgttgagagttttggaattttgtcaaatgcttctctccacctaaataatcataaaattgtatcattcattctgttaatgtgctatgtgatgtttattaattggcatctgttgaagcatccttgcatccctgggatgaatcccattttatcatgatgaatgctttttgaaatgtgcttttaaattcagtttgctagcattttttgaggaattttacatccatgttcccaaatgatattgacctgtagttcctttttcattcccatgtccttctctggctttggtattaggataattctggccttgtataatgaatttggaagtattcccacttcttcaattttttggaagtgtttgagaataattggtattagttctttaaatttttgatagaattttgcaatgagtccatattgtcctgggcttttttttttttctggtgggagacttttattactacttcactgcattattcattattggtttgctaagatttactatcgtaggatttatgtatcagtcaattcatgtcttccagcttatctaatttttgacatgcaattattcattatactttcataatcttttgtatttctgtggcctcagttgtaatatttcctttgtaaatttctgatttgaaccttcttagtctagtttattttgttttttcacaaaacaactcatctgatgttttgcattgtttttatcatttttttatttctcctctaatcaatattaatgtatctactaattttgagtttagcttattcttgtttttctagttaattaaggtacaatattacctttccttatttgaagtctttcttctttattgatgtagccattcattgctataaactataaacttcctctttgaactgcttttgctgtgtcctgtaggttttggtatgttgagttttccatttttatttgtctcaaacaaccttttattttcccttttaattttttcattgacccatctattgtttaggagcatattatttaatcaccatttatttgtaaactttctgagaattcttgcattcgtttataaactgctgtgatcagaaaagatgattgatattattttgaacttcttatctttaagacttttttgtggtcaaacatgtgatctaacctagaaaatgtttcatgtgcaatcgagtataatgtgtattctgcagctactgaataaaatgttttgcatatgctttttaggtccattgccctagagtgcaacttgaagctgttatttcattgtttacctcctgtctggatagtctttccatggctgaaagaggggtgttgaagtttcttagtattattttattgctatctatccccttagatctattaatactttattgtatttaggttaatgtttcatacatagtcacaattattatatactttttgttgaattgactttttaatcattatatatgatcttctttgtctctttctacagttctggacttcagtctattttatctgatataagcatagctactcctgctcttttctggttacgacttgcatgggatatccttttcaaccacttcacttcgtctgcatatgtccttgcaggttaaagtaacctgttgtagttggcattttttatacattctgccaccagatatcttttgattggataatttaatacatttacatttaagataatttttgatacatagggacttaatgctacaattttgttagttttccagttgttttctagagactttgttcttttcttccattcttactatcttcttttaaggttaaatgatgttttttctagtggtatgcattgattccttgttttttaaaaatttttgtatgtctactacaggtttttgctttgtagttaccacgagacttaccaacatattataacaggttattttaggcagctaacaatttttagcacaataaagctctacaaaaatcatttttcatgaaattttgctacatttcctttcacaaggatgttttaaagataaccatcaaatgtgtctataattataatccagcaaattgagagttgacaaatgctctttaattcatacaaagttagagtatgcattttatattgtctgagttcaggaaaaatattaaaaactagttctctcatatttttccaaagcactacagaatctttatattatagtcataaaataattgagtgtggtgagagaaaagaagaatgtgtactgttgaaaacacctgattattcgcaagttgtacatagccaattaggaagttatagcatgcagctaccacatgtatgcttttaggtaacaggttcagcaggccccacctcaaatgccctcctatcagcctattctcgggtaaaggcatggtcgactccacttagatcaacatcatttagatcaccattctcatgtacctggtctctatgtttttggtcttgcacatctccaattgatcaccacacaaataacatttctaaaatacaaatctgatcatttcactattgtttgtaaaaccctgggccacacaagggcaagaaataagcctaacatgaaataagaaagatctactgggcattgatctctctcgcttgctcagccctgtctttgctcatgctgtgccttttcccttgcagcgtgtctcagcaagttcccctggctccaacatcacacactcatctgagggtaacttttcgtcactattcagcactgagccccggagtctcctctcagctccttgtttgaactcagatgtcacagatagaattagtgtgtccttatgagctgcacccttcacacgagtatcaaaacagcttatttattttcttacatttgtttgcataaacaactacatgtatttttcaaactccttggtaaaagccatgtgctattcaaaatttaatcttatttaactatttttaattataaaatagtacaaaatgcttgttaaataaatgaaggattgaatgttgatgccatccctctgcttgtttgtataacaagttacatgtttgaaatctcagctcaggaatcaccctgggcaggtaaccttccttaaaactccttccactcaggtgtcatattttttctgcagtcacttatgtggtcctacatcctcaatacaccacatggcagtaattatttcggagagataaatccactagacgccatcagaattggaccatgcagaaaaatgtagccctcaataaagaaggggcgatgactggattttctcggtaatgattagatataatgaaatgagcatgatttctaagatgtcacactgccaccaagcagaaaggagaatattttcaaaaagggagaaaagcctggtatttaattatttgtaaatgatttcaacttcacaaaaatcattaaaaaacaatagtacaattaatacctatataccctttacccatactcatgtgtggcagcaacattgaactcagtttgtttcattgcccctctctatctccctccctctttccctctcatcatttgaacacctcatgacctttttgtctctaaatattaagtatttcctgaggttaagaatattttttcacaaaattagagaacagttatcaacttccaaaaatgttacattagtataacacaattgtaaaagaattttggatggacaaagactataaaatagagtttccacacagtgaaagaattcctcaaaatgagatgaatatgagatgaggcatcattgtatgagagtctaaggaataacagggataaaatcctaagtatctgatgggtagagaaaaggaaaataaatctttatatccaaatttcctactttataatttcctaaaggacgaatctcacagttaacattttcttcagagcccccatgacatccttattcctaagactatagattaaagggttcagcaccggagtgaggatggtatagaagacagataccatcatgtccttctcaggggtgtggtaggagctggggagcatgtaggtgtagacggcagccccatagaagaggatgaccacagtcaggtgggaggagcaggtggcaaaggcctttttccggccctctgctgagttcatcctgtggacggtgaggaggatgagtaaataggagcttgaaatgatcgtcacagggatgaggagcatgaggacacagcataggtacatgagggtctcatagagtgaggtgtctgagcaggacaggatcgttacagcagggacttcacagaagaaatgatgaatctcccaggatctgcagaaggggaagctcatggtgatgggagtgagcatgaagccatccactgagcccaggaaccagcagcccgatgccaggaaaagacagaccctatggttcatgaggacagggtaacggagaggatggcagatggccacgtagcggtcataggccatggtggctagaaggaaaaattccgaacctgctagtgtcagatagaggaacatctgcatcccacactcaggggctgagaccttattcacacccatgacctggtccaggagcatcttgggcacagtgacagaaatgtacgccatgtccatgagagacaattgactgatgaaaaagtacatggggctgtggaggtgggcgtcacagtgtatcagaaggatcaggacagcatttccagacaacgccttcaggaaaaccacaaagatgaccacactaagtagagctggatgtttggattgtctgaagagtcccatgaggatgaaatccaaccttccagtgtggttggccatcctggtgatgttggccatgaggtttcacctaggccaccaaggagagttttggagtcagtgtaacgcgtccctttgtaatgagtgtttagtgagtactcacatttgtgtatgctcattgtgctaacctgagtcccgtgggtctggggatttgagtatataaatgacatataacaaattcacaaaacaaactaagaattcacaactataggccagaagaattggtaactgatagtaaggttgtcacggttcaaattcataaactttcctgatgataatgccatttatcaacaagtactgaaaatttgcagaacctccctcctctgctaacacaaacagtgactcattgaaagaaagataaagcaaactccttattgtagagtttttgtcatagacagctgaattgaatcaacatcgctggtttaagaaacaataggcatcttcaaaatactcagaggtatatatgatataagaaagatttagcaagtaactaaagcgtaacttggaaaaaaaattatgccagatgtttgaacctcctcctcccataggatcaggccatgctgtgaggctctgtgattgcgtggagcgagcctcacattctcatgagcagggaagggtcctcacacacagctgaccctttagacatcgagagacgtgaagtgaggagcccacacacagtagactccagctatgggtccacctttttctctgtctgccattcctttctccaatctacatcaaaaaggataaaaatcatgtttgagctcaggtgtggtgagggtaaaatgaggaaatgtaatgaaagtgcttagaatagtacagtttccgatgaataaacacatatactcttagtgtagatgttaactctttaagctaactattctgcacaacctacctaagagattgttgctactattattatataagatatattacttccattctccagattcagtacctattcatacatttaagaagctgactttcaaaataaaaatggcagaagttctgcaaaataaagcatatgacccactttaaaaaaaaacaatttggattttatatttgtgtgtttatgtgtaaatactctggttttatataaatatatataatatatttatgtaaacatacacaggtgaatatataactataacatttcttattttaaccctggttatgcagagctttttggagactcctatgtccttcctgcctagtatgtggtcctccaacctcatctccttaaagctcctctcattttaaagctcattaaatctcagcgaggaagaactagaatttggagggtcactgctgtttatcagacaaggctttagttgtttttgcaaacctcatgtgctttattacttgccacaatcaatctttcatacaaactgagaagcagggaggaaaatcaaacaacactgaggcatctgacttcaactcactgtttctccctctaccgtgacactcacagcctgtgttatactgacgatgaatcgcctctgacttcaactcactgtttccttctctatcatgatactcacagcctctgtgttatatgcagaagatgaatcaaagaaaaattgaacttgagtgcacttaaggaggtcacagtcagtctattcagggaacaactattatgtaaatgtgatttgaagttgaatttttaaatagttacaaaataaataagggcaatagacacaaaatatatctggccgttctgaaataatccataatagctgtttccacattttctctgaaagaaattaaaactttccaacttttcaacttctgacatattaaatgttaaattttgagagcccttgccaagaataaggacataataactcctctttctgggaagactttagctgtgattatgatgcagggacattttggaatgaatttacaagtttcaaatatattttgtattcttgtagtaattacaaaaagtatttaagacattcaactcaccaaaacttccaacattctgggatgcttcggtgctttaatataaatatccaacaaatctgagacacattttatgtacatatgtatatatatgaatagatgatgatgatagatagatagatagataatgtgtatcaaacactacccctactggcaaatggtggctgagatctgtgtacaatttaaaaacattccaataaactgcaaaacacacctgctgacctcgtccattatttgtggccaaagtgaagcaaggaccagaggagcgaccagcacatgtgaagacctaaaaggtgtttgctcagtaaattgagggggagcaggagggcagggagatgcggggtttcctaagaaatctctgctgctctttaggaaatggccatcactatcattaagccactatcattaagccactatcaacagctcaaccaggacacgggacagataagggaacactatccacacacagtgaactggccccctgttcattcttcttctgtacccgcttgtttgactttcatgtaaattgcttaatgcatgtttaacttggggatttattataagtataaatggagtcaaacctttatttgaagcatacagcatcccaggaattgttctaatactaatactaaaattaatactttacatttcttctttcccaagagcctatgagttacttcctattattttctctctttacatattaaaaaatgcaggttctcagggtacctgcctaatatcacacacctaacctgagatagaacgcacgtctcagcccgagagtgagagccagcgcacgtaactctgcctgattcctctcagggacaccatcctccctctgcagtctacactttggatttaggccactgtctgtgggtttcatcaaggaaacataaaatgattgagacattgtttctagtgttttgtaaccctcagaaataatcccctctcaaaagaaaatcagtcacttttcctctataaaacttcagtgacaggaaaataaatacatcattgtatgaaaatctaaaactatagaatatatattattatgtccataaataattggaaattaaaaatccatttaccattatgtcacagtaaataagtgttgtatagaagttataagaaagaataacatttgcttttctccattaaaaacagatgataaagaaaaaatgaggaaatgctgtgaagaactaatagaacgtttcagaagcagaacaagtcgagagcagtgatgacccttttgttcctgctagtacctcctgtctgtctggccgaactcaccatcagatgatgtcttgaacctcacctagatgggctggtggtgtgtggccaggttaagagcaccaacaggagtaagaaagtgacctgcctggttttaccgtgtgtactaggggaggggttgaaagctttcggttgatacatcacctctgggagttgaagaagaatgcaattaagagagctaaagaagtcagtaggtatctctcctgaacaattctggttttcttctaatagcttttacaatttttacctctgttatgaaatgcaaacttttaaccaatattagtaatagtaatctcaaatctcatcatcatcaaaatcttatttatgaaatataggagttagttcatatacagccttagccttttccacattataaaatatattccatatatatgtgtgatcttcatttaatattcaagtaaatgttgtaagatattgttatttttattctaacatttcacaggtatagaatctgaaactcagaggtcaactgatgtgtcaaagatacctccacaaatcagtaccttgattaaaactaaaattggagtcatcttcatatctccatctttctccctcttcattaggaccgattgtagtctgtttccctctcactcacttgcaatctttattgctttagtgttgcatttgatttttatctttgtttttgttttaaatactgtcattaaagtcatagaaaaatctaaaataaaactggttgaataaaaattttaaaatcgactctaatgtaataaaccagacaaaaatgatactttaaatgttatatcttccctttaaactacaaatattcattgagtgtataccctgtattaggctgttggaataaaacagggaagaagacagaagaaactgcaccgccatcttagatcttgcagccaaattcctctgaacttttctctaaagacgtgctctggaaaaatgttgatcattttcctacatcatggaggtcttttcatgaccacctttgtctagacaatgtcctgtttttaggtgcacgtttgagggctggagtctctgacccacagtgctgcagcctgcacgtggtttgtcctgacttctttgctacttcacttttcgtaaggctctgagagtgcaggcccttgtgggtggacactgcagggtgagaggaagaagtaaactacttttttccgtttctgatgggggtgtgggtcagcagctataagcaacagggaccatggggggcctcagacttcagcacctgagaggcagtttcagtcgtattggggagatgcaggcatctgggttgctgcacatcaccagggcagggttctctcagcagccctggagtgcagagttcccatcagctcagcagtgaggggcacatggggctccagtggtgaggactcttggtccttggatgacaacactcccctgcccacttctccagccttccctgtaaccctttgccacctctaaccaatcttctgtgttacatctcttcggtttgcaatatgtagtgttcgtatatgactggacagtatctactggagttaatatctatcagagtaattatatcacaattgcaatcttctcctaagagtgaatagtgacattaaaaatttcaacattataaattatgcagaaataaaactaattatacaaaaaatacactctgaatgtcagtttttccctgagacaatctaccatttgatatacggtgattcacacttcttaatatacaacattgaattacttttccaaaagcctcttcaaattttgctgcagaattaaacttcacttgcaccagctctgaattatgtgtgcttttccttcttggtcaatttcataggtgtatcattatttgtcttttttaattaatatgtttatataacttttcatgtttatccatgtaactactgcttttgtgaaacgtgtgtttttatccttttcacatttttttctattgaaatgttttctttataaatataaatgtgtttttggtatgaaaataataactggccagatgcggtggctcacacctgtaatcccagcactttgagaggccgaggtgggtggatcacctggcctcaggagttcgggaccagcctggccagcatagtgaaaccccatctctactaaaactacaaaattagctggcgtggtagcacgtgccctgtaatccaagctacttgggaggctgagacaggagactcagtcgaacctaggaggcagaagttgcagcaagccaagatcacgctattgcactccagcctgggcaaaaagagcgaaactctgtctcaaaaagaagaaaaaaaatagtaactctttgtgaatagtatcaactaaaatatttatatttcagttttcattctgatattttgtttcatcagaattttttaaagtattttgtttaatatattaactttaataatttcattaactgtctcgtgcttacaaagtctttatgcatttggggattatgtaaagcatctacctttacacttttaatgagtttcagaggttttttggtacctttgagttataatacaaaaataatttatttgggtgtgatatgcagtgaattgctaacattattgcttttaattaaagattaaattccaatgttgaatgatattttctttaatttcaaaaataattagtaactgttccaggcactatctaggtttatgatgtttgaaacaaagattcttcccacacagcatttatatactagtggtaaatacaggcaataaactaataaatatgtaatgaaatatcaagtattaataatcacagtgaataaaaaataaaggcagagagatgagataggaatgattagcgaatctatttaacacaggctagttaggagccctttatttagaaggtgaaatttcatcagatccgtaaatgaagcaatggagtcactcgtaaacaacggggcagagatgtttaagcagaggaaacagagaaagttaaaagctgtgagactgaaagtaacttgcaacgtttgaacagcagcaagaagatctgtggccccagattgaggtgagaaagttggcaaaacagaaaatggggttagaaatggagccaagaacaggtcgtataatatcatgatggtcctgggaaggaccagggacaggcagaggtgtgtttaagaaagggaagacaaaagtatacacggcactcaagagagtgcatgtgcacttagaaaaagaaaggaagtctcagccaatgtttggcccctgtcttctaagaactcttcaggaagtttaccaggcatgctcacagtctgttctgactgtagcctggcttcccctccccaccccaccccaccatacaactcccagcaacagacagcactcagagaatctccagagagtgaagggccccaaagctttgactctccttgcttcttggttaatcccactctgagatatcactggaggacggacagagaggaaagacatttggaacaggtatatgattatcactgagaaggcttgagcgagaatgcaggaaagggtttgagctagtcctgatgagacatatggtgtctgggcaaggggtgtggtggaggaggagaagttggattgccgtttatacacacaggaatattggggctgggcaggttggcatggaacgctgaaactgaaatttgggactccagttgcccagtacacatctacatgaagatgatgcaaggctagtgtatacacgaatccagagttcataagagaaggcagtcctaaaatcatggttttgagaaccagtgtgtgtggaggaaacaacgggatcgcacaaggaaggagggtcaacatcttataccagaagccagtgcaggggaggctaagtttccacattatctcttcttttccattggtctttcactgaattcctttaaaatatcttgttttattgggtgtcccctcatgataattttaaacaactagtgaaacaattcttgtcttcatgtatgttcatgttcaaaataagcaagtttttgtttttcctttcagttgatctatttggctaggttcaaaagatctaactaattgtattgattagaatacaatgaaatacatttgggaagaattgatattgttaaaatgttgcagatttttataaacaagcacaataggtctcacagagatatccaaatacttagaggtcgggtctggattttgaagtaattttaataaaattcttccacaataattgagattctgagatatttttataatttaattttttggagaatatttttcatttaaaaatacttaaaaagcattaacagtgacagaaaagctattgatatatattttttcaacattaatatttatggtggaaaccctgcttaaagttctactttttttttacattttaaatgtaaactgagaaaatatttataaaaacaaaaataacattttaagaattaaactataaatatataaaacatgtcaaacattttgtaaatgatcctgaaggcaccatcagagatataaagaaatgcaagatacatgcacagaacaaaggaagaggggccaccacctttatggactggaggtcaggatatcaagccaaagaggacctcaagtcctgaaatctaacgaaacttgccctgccaggcttcaagtttgctttggctctaagacttctatttaacttccaatttctctttttcagaataggaatgtctatcctatatgtgagtgtcactgttgcattttgacagcagataacttgctgtctggtttcacaggttttaaattaacttattgagtaaaatctaagttgaataatgtgctagagaaatattcttaatacaaagagattaaaaacattagcaagatgtttgaagaggagctcctataatcgtatcccctcaaagcagcaataatatagcagcctgtctggcacaaaagtcccttggtgggaacttctggatcttgacaggaagtgtcaaaactggtgaatcccaacactgaagagagctattttgagaaggcagggccacacccaggtggcaggctcactgactgtggtcctggctacagacacagaattaacatccctctggactcagctagtgccctgtttggcattggtcctgccacctgaaccatctgccaaggggcccaggggcactcacattgaccagtaccctcaagtaacaggcctgctaaccttagttctagctctgaaccctgaagcagtccatgacccagctccagtccccctcagccatggtctgggaatagaccttcctgcacagagacctgccaggaggcaaccctgttcatgtgcctagaggcaggctctcaaaactacgtccgactgccaatcttgaagcagctctgttacttggcacccttttccattgttcaaaagcagtcctgcccactcagtgacctcctgggtgacacattgatcgatgcccctgtaaacaagactgctgacatcagtcagctggagatcctgaatcagccctcttatccagctccagcttccattcaaccacagcttggggatatcttatatcttatatttacagggactatgcaggaggtacacccatccatgcaggacagaagacctcagactcagctgtggtccatgacacagccctgagactcagttccaggtcctctcaactgtggtctggggacaatccttcttgcccagagactttcccaccaatataatgggagtccttcaagggactcaatagaatccacacccatttctgtacctcgtaagaggcatgccatctacagaaccaaatgtgaaccctgaagcagagtgtcctagcgatagccctattgaccaaggtactagaggcagtcttctctaccaagagaccagacaggatttatactcaactcgacttctggtaacaagcttgccaactaaaaattctgctgtagactcaggagtagccacatgacatggctctaaccctgctcaactgcagtcctggaggtaattcttattagcctagagaaatgacaggagaatgtctttacctaccgaaaccagtctatgcagaccagaagagctgtttgcaacttcaaatgtgcacacatcaatgcatagctacttgagtcacaaaaaatcaggcaaatgtgacaccaaagtaataaataaataccaccaaagtaataaagcttcattaagcaaccccaaggaaatggaaatctatgaattgcctaagaattttaaaatcatattaaataggatcaaagagcttcaaaatagcagagatctaaaactaataaaaaaatgcataaacaaaatgagaaatataataaagacattgacatcataaaaggaaagaattcttgtgctgagaagatttgtagtcaaatttggaacactctagtactgtaatggaggtgtgtaaatctcgttaactttagtgtaaagcttgtaaaatattctgaatacaattatggaagtgagaaggtcaacagagtactttaataacatatttcatcatacagcgaaaggaagcaatgaacttgagtttagatcatacagttagaggaacaaaaaaaataaaatgcagaagcatctgggaactataagacaacatcaagcaaatatatatgtgtattatgacattcacagaaggagaagagagaaaaacagaaagctaaaatgacaacatttcctaaatttgtgagggatagggacatgcagattcataaagttcaaaggaacccaagcaagaacaaaccaaaacattatacctgagacatattatgatcagtttgtcaaaagtcaaagacaattctataatttggaaaaatatggatgagcccagaggacaatattttaaataaaataagcctggtataggacaaatattgcacaatttcatttatatgtgaagtgtccaatagtcaaacacatagaaacaaagaataaaatggtggttaccagagtttggagtgaggaaggaaaagagaagatgtgggtcaaaggatacaaaattttatttaagcaggagaaataagttcaggaggtttatggtacatcatgctgactacagtttcaacaattatgtacttgaaaattgctaagaaagtaggtataagagtactcagcacatgaaatgattacttgaacccaggaggcggaggttgcagtgagccgaggtcatgccactgcactccagcctgggcaacagagtaagactttgtcttaaaaaaaaaaaaaaaaaaaaactcccaagaaaagcctaggactagaagacttcatgatgaattcatccaagcacttaaagaactaacacatatcctcctctgattttttcaaaacattgaagggcaaaaacacttccaaattcatttactgaagccaacattacctttaaaccaaagccagataagaacactaactcccaaaatattataggtcaatattcctgacaaacagctttcataatttttggtaaaaattaacaaaatactaacaaaccaaagcagtgcattaaaaggatacttcaccttaatcaagtgggattattcctaggatgtataaaccaaaagtatgtcagacaggtctcaatcagattgaaagtttatttcaccaaggtaaaggacatgcttggaaaaaagaacacaattacagaaacagtctgtggtctgtgcttttctttaaagataattttgaggactttaatatttaaaggggaaagcaggctagaggggaaagagggagagtatgataatccacaggttgcaagaagaaaagaagcaaagaagcaggtaggtgaatagtcatttatgtattcctttcacactcagtagaaggatcatcgctttacgtcaggtaaggagaatgtggagttactgcctgttactctaacattttatcagtagttaactgattaggaacaaaaaacaaaaaccaaaggaaatgcagtttcttgcataactcagctttcagcttagtatcttttttccttttggcatagtaaattggggtcccaagtttttttcccacagatgcaaagatggttcaacatacaccaatcaataaatatgatatgccacattaacagaataaatgacaaaaacaattgtgcatctcaatagacatagaaaaagcattggataaaattcaacatcttttcatgataaaaactcagcagatttgttatagaaggaatgtgcctttacataataaatctcacagctaaatcatactcgatggagagaaacagattttccgctaagatcaggaagaagacaagagtgctcactctcactgcttctattcaacataataccggaaactagccagagcaattaggcaataaaaagaaagaaaaggctttcaaatcagaggaagttaaattatcttgccatctgtttgcagatgacatgattttacatataaaaaactctaaagactccaccaaaatcccatcagagttaaagaattcaagaaacttgcaggatacaaaataaacatatataaatgagttgtatttctatacaccaaaaaggaaccatccaaatatgtaattaagaaaagaataccattcccaataccatccaatagaataaaatacataggaataaatacagctgagggagtgaaagatctgttcactaaagaggagataaataagtgggaggatatctcatgttaatgggttagaataactaatattctttaaatgtccatattactccagaaaatgtctgattcagtataaccccaactaaaattccacaggcattttttacataaatagaataaaacaactctagaaattttgtgaatgcacaaaaatatcaaatagccaaagcaatattgataaaaagaacaaagctggaggcttgactccgatttcaaactatattacaaattatagaaataaagccatgcttatatggtcaattagtctttgatgagggtgccaaaaatgcagcatgaagaaaggatagtctgttcaataaatggcattgggaaaaccagatacatacatgcagaggaacgaaattggactcttatcctacactattcccccaaaaccaaatctaaatggatcgaagacttaaatggaagacctggacttgtaaaagtcctagatgatgacatagggaaacagctctttgacattgatcttggccgtgatatttttgatatgacacaaaaattaaggcaacaaaagcaaaataagcaagtaggactgcatcaacatgcaaaaacttttgcacagaaaaggaaacaataaaatgaaaaggtaatctctgcaatgggagaacatatctgcaaaccatattttggataaggagttagcatccaaaatataaaagaaactgacaaaatcattagcaaatatcaaattacccaacttaaaaatggtaaagacagtgtgaataggcatttttccaaagaggcaatacaaatagccaacaggtgaatgaaaagatgttcaacatcactaatcatcagggccacacaaatcaaaaccacaatgagatatcagctcacacctgctaggatggctattaccaggcaatacatagcaagtgctgtcaagtgtgtgtaggaaatggaacacttgtacatgtgcattgctggtagaaacgtaagttgcaacagcctgtgttgaaagctgtatgacagttctataaagattaaaaatagagctactctataattcagcaatcccactctgtacaccttcctgaggtaaataattatataaataatataatgacaacataagaacattgttaaattagtcatctgtggtgtccatttgagcagttttgcccatttatttaattacagcaatttctgaaaccaaattttacctacctctaacaaccccctcttacaagtgatatttctgcaccacttggtggaatttacttccaaattcagatctctgtacacaaactcagacaaactcctttcatgcactgcaggaataattttcagtgagaagcaaaagtgttcggtcgatgtgtcatgtaaagcaagtacttgtcatttctctcgaagatgcgataggcatgggaacacctggcttccattcattgtcggtaaatcaggcatggtcagggctgtgccaaggggaagtaaattaacagcttcacgatacagctcgagattcagcttcttgcatattaattagaacaaatgtatttctttcctaatttctcacgttccagaaatactacacccatgaattattttgttaatgaaaatgatagtgatctgatgctcatagatttacagaagttacgtttgtagcatgatatacatctggcaaactaaaggttagtgacaagtttataaccattttgctggttttcccagtttcagaagaaacatgccgagggggttaagctttcctaagtctccattatcgcacgcgactgttatgatatttattgtaaacatagtagaccattgtctggaatagactaaatcctaaagaaactaaatctggaactacttttatttacatactatgaaatagatgaacctattctttgaattttgaaatggattcatttttggtttaggtggttccaatggccaatgctaaaactactggtgtttacactacaaagttcacttcagcctttggagaaaatgcgtttctttgtacttactgagatacaatagcagaaacactgaccccagtggctgccaatgtgaaccgaggtttacaatgtattgcaaagggagggagcagccaatactcctcctctagggctctgctaggattctaagtctttacaatgagtctcttcgaggggtaaagtgtttaagaccaagtctcatactaaaatgctcaatgaacctgggatgggagataagataaaaggcactctataaggtctttcataggtcagctactgcagtgcagttaaaaacactctaaagatattaaatctaatgagataaatgggagcaataagcagtatggagggaaaacgccacgtataagaaagaaggaaaatatgagtgggctttgtgctggggacccggagacctgagggcaaaagagaggagagatagggagtaacggaattatagaaagaggaggggacaatgcttgtcctttactacttttcttggttcattcttgactgcatcatgctcctcagagccctggtgacatctttgttgcggagactgtaaatgagggggttcagcacaggagtgaagatggtgtaaaaggcagacaccatcatgtcctgctcagctgtgtggtaggaactccggagcatgtaggtgtagaaggaagcaccgaagagcagcagcactatgatcatgtgggaggagcaggtggccaaggccttcctgcggccggcggcagaattcatcctgtggatgagatgcaggatgagggtgtatgagctggagatgaccatgatgggggtgagaagcatgaggatgcagcacaggtacgtgagcatcttatagagggagacgtcagagcaggagagcttcagcagggcaggagtctcacagaaaaaactcaggattttcctagactggcaaaaggggaagctcatggtaatgggggtgagcaacaaaccatcaaccattcccaaaacccagcaggctgacaccaggagctggcacaccctctggttcatcagcagtgggtaatggagaggtctgcaaacagcagcatatcggtcataggccatggcagccaggaggaaaacctcagctccagccagggtcaggtggaagaacatctggatcccacagcctgacggggaaatggtatcatctccagtgacctggcccacaagcatcttgggcacagtcacgcataggtacatgagatccatgagcgcgagctggctgatgaagaagtacatgggggtgtggaggcggggctctgagtggatgaggaggatgaggagggcattcccagtgagggccatcaagaaaagaaggaaggtcacggtgtagaggagggcagcatgcttgctctcagcaaagagtcccgtgagggtgaaatcagtgcttgctgtttgattctgagaagtctgattccctgagcacatgactggctcacagtttccccctgaggaaaaaaaagtcattaattttaaatctttcctatgtacatggctttcctaacctttttctggtaagacatgtgctttgaattatttttctaaatattgagttaaactgacataaaatcataagttcaaatcttaggtcaagtcgcatgttggccacaagctaaagtgaactacgaaacagatctggggaggtgactattcctgagctaagtcaagagtgaagacaggtacactctatgtcttatttccccccagaattaagaacacaagtatactggccttgtgggatggttagagactgaagtagggaatgcacgttaggtctgtaacacagtgttagtgttgggttgagattttcactactttttggatacagtagctcatccaggactcagtgatggaaatcatggctgataaggttaatattaatattgttaatggtacaaatatcataactaataccatgaaataatctgaaaactggaaatctccttaaatttcttctaccattatatatctccatttaagtccactttcctcatgaaaacttttcaatttattctgctattcctcacaaggttgcattccataagtagtgctgactggggcagaggagcagagggagagtcccgcctgcctgaggagagtagcttggagtgcagaacgagtgccgagcaggagagcagcagtaggcacagtgagccctcttcccagtccccagtgaaatctaaggcatttaatttattaactgtcaggcagagaaatatttttacaagaaatcacagcaataaatgctgcagatgccctaaatatcaagtatttatttgaaatataaacaaaatatttattttcaaaatgccatatttatcccccaaaatcatgcctaaaatgtccaaaattccgtgcatggtgattgaaaaatgaagttaaagcacatgaggcagttgtgttgaatctttcataaaaccgcagccctgcaaccaagcctagggatcctcttgtcctgcatctcctttgcataacaaactaatcaccaccccctcccataaattcatagctttgctcagtgactgctttgtctgaatatttcagttttaattttccagttgaattgtttcaatcatgcttgatacaattgtctcaaagttaaaaagcccactaacttctagactaatgaagagtcaggagctccatgactgaggtttggtcatcctcagggttgctgtactgcaggttagagaaataatgctgaggaaaaaactaacagtgactgaggcacgtggaaatgcaaagtgaaatacaacgcactgttcctagggcaaaaaaaaaaaaaaaaaaaaaaaaaaaaacaacaacaaaaacaaaaccatacacacaaaacaagagaccaaaaaaaaaaaacaaaacctgggacttcaggaaacctaaagtcagaattacaaagagctagcaacaagagtcaggtatctttgttccttacttatcccctttataaagcactgaagaaacgggttatcaagacacctttccacaaagagacgaacattgcacatagagcacaaaccatttgctccacctcttctgctccatcagagaataaatctaagccacgccagctcagtgaagctgctttcaccattctaaggccaaagcaaaggggtttaaattcagaatgaaaatgagaaaattacatcatcagtttcttcacattagggaattgagatgagtgtttattgcttaattctttgcaccgttttcccttttttttttctgcttattcatcttccctgtacttggcattgtctcttccctggagcttctactttctttaagaccatctcagaatccattattttggtatttttgttttgttttgctatttgtttttgatagttatattctaactttccagttacagtccacgtggtaattaaacatgtttttcatttatgcgatgcgtctatccaaaagcaaatccatctttttcatgacattgcacatttttaaacaacttcatttttctagtttaaaattatattttcgtatcggacatttaaagtaagctctttgtaaaagcaaatctgaatttcacaaagggaggatcatggaaaaccagtgtcagaaatctgtaaactaaatataaaatcctaagacccctaatcaactgaacagacccccttctaggacaagagaatctcaggaaagctgaaaagcttaattgcaggacataacaagaagggagacacacttcattatacccctgtctgttggaatttaggcacaactgaccagcaataacattgaaatagagttcctaagactgacaaaacagactctgagtggcaataagataccaaattccaacctgactctagtatagcatcacatgacagatagcagaccctgaggaaaatcaaaatattccaccccaaagtatgtctttgacatattttgaaatggccctacaaagccatctttcgtggggaaaagttgcatctatagagactttccattaacacagcaggggctttcccagattcaggagaaaatatcggagtctgacaacatttaaggttctaaaagaaacatttaccatttattatatttgcttccaattaattgtgtaatcttagtcaagaccctaaaagctctgagtgtcacttcctcaatcaaataaaaggaggagtgttatgtacttgctatgcttctgtgactcttaagacatctatgaatctgatgaccgaatgtggtctaagatttctccatgacagggtgaccttctcccacatcgcccctctccttaaaggctcagagacttcccttgaaatattagtctcatcgaatttagattatataatttgggaatgaaaaagaatggaaaaagggagccacttttctcagtgcctgcaaggttccgagactttgctgagtctttctagcatgacaaacgtacaaatactgagtagtgtattcatccctgtgtacagtcatccctcactatctgtcctcagtaccaggacatcgtgaaaataccaaaatccatgatgctaaagaccctaatatgaaatggcagagtatttctatataacctacaccaatcttctcgtatgcttgaaatcatgtctagattacttataacaactaatgcaatatgaatgctatgtaaatagccgttatactattttttttttacgaaataatgacaaggaaaaaaagtctggaggatggaacaagatgacagaatagaagtttccactgatcatccccctgcaagaacaccaatttaaaaactacctacacaaaaaacacctttacaagaaccaaaaatcgggtgagcactcacagtacatggagttaaattcatatttctgaatgaggcattgaagaagttagaaaaacagtattgcatcactgacactaccactccttcatcccccagcagtggaggtgtggtatggagagcttctctgtgcactggggagagggagagccagcaattctaagacactgaactcagcaatgcccttgttatagcagaaagaagacccagaccaaattcagctgacacccaccatgaagggtgcatttaaatcagccattgctggaagggaattgcgaatcccagtgtttggaacttgagttacccaagcctcaccatgaagggctaaagtggctctggagccacagacaaacctgaagggcagtctaggccacaagagctgcaaatcctaatgctaatctgggcccagagccagtggactcaggggacacatgacctgttaaaacaccagccagggcagctaaactcatcccctaacctcagcctccacggcttgtggctccaaaagaggcctctttcctctgctttaggagaggagagggaagagtgaggaggactttgtcttgcatcttggataccagctcagccacatcagggttggataccagccagagtcatgagggccttgggtgagactctgagacatgctggcttcaggtgagactcagcatattaccagctatggtggctatggggcaagactccttctgcttgaggaaagtggacagaaaattaaaggagattttgtcttgcactttagtgcaactattgttaccattgttattcaacatattactggaagttctagctagagcaatcagacaagagaaacaaacatatatatatatatatatatatatatatatatatatatatatacacacacacacacacacacacacacacacacacacacacacacatgcatacggcatcaaacgtcaaagaaaagtaaaattatctttgttcacagatgataggaccttatgcttggaaaaacctaaagtctccccaaaaacctattagaactaataaacaaattcaggaaagttgcaggatacaaaatcaacatacaaaaggcagatttctataagtcaatagcaaatagattaaaacaaatttaaaaagtaatggcatttatgatagccacaaataaaattaaagaggaattaaccaaagaagtgaaagagttctataatgataactataaaacagtaataattgaagaggacactaaaaaatgaaaagatattccaggttcatgaaccaaaagaatcaatattgttaaaatatccatagtactcaaagcaatctatagattcaatgttatccttatcaaaataccaatgacatttcttacagatatagaagacactatcctatcatttgtatgaaggcacaaaacacccagaggagccaaaattattctaagcaaaaccgccaaccaaccaacccaccaaaactggaggaatcccattgcctgacttcaaattatactacagagctaccataaccaaaacagcatggtgctggcataaatgcagatacatagaccaatgaaacagaatagagaactcagaaacaaatccacacacctacagtgaactcattttctacaaaggtgcaaggaacatacaccagggaaaagatcatctcttcaataagcagcactgggaaaagtggatatctatatgaagaaaaatgaaactagtcccgtctctcgccatatacaaagatatagtcaaaatggactaaagactttaagacctcaaactatgaaactaccagaagaaaacattggagaaaatctccaggatatttgtctgggcaaatatttcttgagtaatactccataacacagacaaccaaagcaaacatggacaaatgagagcacattttgttaaaaagcttctgcacagtgaaggaaataaatcaacaaagagacatcccacaaaatggaagaaaatgttttcaaactacccacctgacaaggaattaataaccgcaatacatagggagctcaaacaaatctataggaaaaaatataataatctgatttatatactgataaaagattgaatacacatttctcaaaagacaacatacaaatcaaaaacaggcacataaaaagtgctcaacattgatcagagaaatgcagatcaaagctacaatgagataccatctcatcccaattaaaatggctcttatacaaaagacatgcaaaaataaatgctggtgaggacatggagaaaagggaaccctcataaactctgtgggaatgtgaagttgcatttaaagttgtatttaaaggtgcaacagagaacagtttggaggttcctcaaaaaactaagaatagagctaacgtattatccagcaatcccactgctgggtatatagccaaaagaaaagaaatcaatatactgaagagacatctacacttccatgtttgttgcagctctgttcacaatagctacaatttggaagcaacctatgtgttcgtcaacagatgaatgggtaaagaaaatgtggtacttatacatgatagtgtactatatagccacaaaacaatgaaatcctgtcatttgcaacaacatagatggaattggaggtcattatgctaagtcaaataagccaggcacagaaagacaaacattgcatgttctcagttatttgtggcaccttaaaatcaaaacaattggacttatggagatataaattagaaatatgcttagcagatactgggaagggtactgggggggggtgaaggggtaggtggggatggttaatggatacaacaaagttgttagaatgaataagtactagcataatagactgacattgtcaataacaatcgtacatttaaaaataactaaaaggatatagtaatattgtaacacaaaagataaatgcttgagaggatactccatttttcatcatgcatttattatacattgcattcctgtatcaaaacatctcatgtaccccgtaaatgtatacacctatgtcacaacaaaaataaaatttagaaaagtctgtaccaatgtgaccatgataagcctaattatattttcaatccatgattggttaagtccatgattggttgaatcttcagatgcagaatccaactcataagcccaactgcagaagcagatactgacaccaggagacagaatgagcatattctgtccttggctggtacccaccctatcttccaacattgcttcttccaatatctcagagtatccttaaaccacacactttcatattccttcataacttcttgtatcctgcttccttgctgtgaatttaccaaatgcatttctgtataaactctaccagtcataaacacttagataatatgacaatttctttatgaaggcgtgctctactcaatcagtgagaactctcacacctcagacataacaatccttcttttatacccttcacacaagcctcaactcactcttgtattttaattatttctaagtttcaatgaaaattccacatgaatatgtataattagaaattactttaatgagctgtataggtatgaaagttaaaaaactaaataagtgtttaaaaatcgcaggtggagggttgataatacgtaaaattgcaaaattctagatacattttaggtactgctatgaaatccttaatgagctgtacacttattttttttatggatatacttcaatagttgtacaagcttcatgtatagccacaaatataaacatattcaagaacataaaatgacaaaatggtcaacaaatttatcatcttaggtccttgagggacttttgatgagtggaccctgagtaccatctgacagatttacaatgtgaacatcacataaacaatgtttttgtgcagcttgagatgttactatggcattaccttgtgcattctgactgatccataattatatttaaaatttgcaacagtgctccctattttatgttcataacatatatcatcatctggcatgaccacatcatatgttttacctattcactgtttgggtttttgttattgcacaaggagaccaaaatatattcattttcttctctgttgctttctaacattagcactatgcctggcatatatcactttcgcaccaacataatagtaaaaattgattatttgttaaataaatgaagaagggaaaatgatggttagagagattagtgcaactcctttagagatgaatttagtaatatctcataacattgaagatgttctttcttcactacctaagacttccaaggagattatacgaggatagacactctgttacactataaagcatgaaaaaagtggtaaacctaaatattcatataaagaaaatgcacacatgaccaatattaataccaatttattgtgaacatttcaataagtaaagttgaaggaaaatatatgtggcagaatgatcagtgtgttaccatttaacaaatacatcctgctaaaatattacatttggacacatatctgcaataaaaacattaaaaattgatagggaagatacacacctactgtttaaaaaaattggtctgaggacactaagagagggaattcaggagagcacagataagactttgatgtacctgtaaaatatatacccccatttttgagtcagggtcttgctctgtcacccaggctggagtgcagtgtcacagttgtggctcactgcagcttcaatctcccaggctcaagtgatcctctcacctcagcctcctgagtagctaggactatagacacgtgccactatgcctccctaatttttttaaatttaatttttggagagatgaggtctcactatgttacccaggctggtctcaaatacttaggctcaagcaatcttcccacctcagccttccaaagtgttgggattatagggcataagccactgcccctggatgatgtacctatgatatatatatatttttttatttcaataggtttttggggaacagttggtgtttggttacattaagttctttagtggcaatttgagaatttggtgcactcatcacccaagtagtgtacactgtacccgatgtgtagtcttttatccctcacctgctcccaccctttcccccaagtccccaaagtctattgtatcattattatccctttgtatcctcatagcttagctcccaggtgtgagtgagaacaatgtttggtttttcattcctgagttgcttcacttggaataatggtctctaattacatctagtttgctgcaaatgccattatttcattccttttcatggctaagtaatattcatatatatatatatatatgcatatataggaatatatgtatatatgtgtatatatgtatatataaatatatgtatatgaatatatgtatgtgaatatatgaatatatatgaatatatgaatatatacgaatatgagaatatatgaatatatatgattttctttatccactcattgattgatgatcatttgggctgcttccatatttttgcaattgtgaagtgtggtgctgtaaacatgtgtaagtatcttttgaatacaatgacttattttcctctgggtacacaccaagtagtgggattgctggatcaaatggtagatatacttttagatctttaaggaatctccagacttttccatagtggttgtacaagtttacatttgcaccagcagtgtaaaagagttcccttttcagcacatccacaccaatgtctatttttaaaaaattttttgattatggccattcttgcaggagtgagatggtattgcattgcggttttgaatttcatttccctgataattagtgatgttgagcatttttttcatgtttgttggccatttgtatattttctcttgagaattgtctatttgtgtccttagcccactttttaatggctttgttttgttcttgctgatttgagtttcttgtagattctagatattagtcctttgttggatgtagagactgaagattttctcccactccatgggttgtctgtttactctgatgattatgtcttttgctgtgcacaagctttttagtttaattaagtcccatttatttttgtttttattgcatttgcttttgggttcttggtcatgaagtctttgcctaagccaatgtctacaagttaacattttctgacgttattttccagatttttaataatttcaggtcttaggtttaagtctttgatctatcctgagttgttttttctataaggttagagatgaggttccagtttcattctttacatgtggcttgccaattttctcagcaccatttgttgaatagggtgtcctttccccacttttatgtttttgtttgctttgttgaagatcagttggctgtagtatttggttttatttctgggttctctatactgttccattggtctatatactgatttttatgccagtaccaagctattttggtgactatggccttatagtatagtttgaagtcgagtaatgtgatgcctctggtttcgttctcttttcctagtcttgctttggctatgtgggctttttggttccatatgaattttaggattgtttaggattgtttttctgtgaagaatgatggtggtgttttgatgggaagtgcattgaatttgtccattgctttggcaatatggtcattttcaattattgattctactcacccataagcatgggatgtgtttcaatttatttgtgtcatctatgatctctttcagcagtgatttgtagttttcctcatagaggtcttttacctccttggttaggtattcctaagtattttattttgcagctattgtaaattgggttgagctcttgatttgcatctcagcttggtggctattgctgtattaacagagctactgagtcgtgtacattaattttgtattctgaaactttgctgacttcatttaccagttccaggagctttttggatgagtctttagggttttcttggtatacgatcatattatcagcaaaccgacagcataacttcctctttactgatttagatgccctttacttctttctcttgtctgattgctctggctaggacttccagaactatattgaatataagtggccaaaatgggcatccttgccttgttccagttctcagagggaatgccttcaacttttccccattcagaataatgtttgctgtggatttgtcataggtgacttttattaccttacagtgtgtcccttgtatgctgattttgctgagggttttaatcataaagggatggattttgtcaaatgctttttctgcaactattgagatacacagaattaaaaacaaaagtcacatggttatgcgatgtatcacgagttgactcatatatgttaaatcaaccctgcatccctgttacgaaacccacttgatcatgatgatttatctttttgatatgttgttggattctgttagacagtattttgttgagaatttttgcatgtatgttcatcagggatattggtctatagttttgttatgtcctttcctgggtttggtattagggtgatactggcttcatagaatgatgtaggaagttttccctctatcttgtggaatagtgtcagtaggattgatgccaattaattcagctgtgaatccatctggtcccagactttttttgctggcattttttaattaccattccaatcttgctgcttgttactggtctcttcagagtttctatttcttctttgtttaatctaggagcattgtatatttccagaaattaattcatctcctgtaggttttctactttacacgcataaagctgttcatagtagccacgaataagcttttgtatttctgtgatattggttgtcatatcacctgtttcatttctaattgagcttatttggctattctcttgattaatcttgctaacagtatcaattttacttattttttcaaagaacctacgttgtttcatatagcttttgtattttttatttcaatttcatttagttctgctctgatgtttgttatttcttttcttctgctgggtttgggtttggtttgttcttgtttctctagttccttgaggtgtgaccttagattgcctatttgtgctctttcagactttttgatgtgggcattaatagtatgaaccccatgtgattcaggaattccattactaaggatgtatccaatttaattgggcatgtcaaagagatatctgcactcccatgttcattgcaacattattcacaatagtcaagatatggaatcaacctaagtatccatcaatggatgaatagatatagaaaacaagacatatatccacagtgaaatgtaattcagcctttaaatagaagaaaatcttgttcatgtgtcaatgttctatattgtgttgtatatatcaaaacattataattgtatatataatacatatgtgtatataatgtatattatatataatacataattacaattatatgtgtaatatatatgtgttgtatatatcaaaattgctaagtgggtacattttaaatgtctcaccatgaaaattggtgataatatgttcattaggttaatttcatcattacaaataatattcgtatattaaaatatcacattctaccccataaaaatctatattttaatatttcaattaaaaatatttttaaaaataatgcaataagaacatgaaagtagaaaaatgattatagacctttggtgtggaactgaaatcagaaacacaaatattaacctatgatttctacatacatttataaataattgatggtgtctacttcattctttactcgttttctttccacattttgtagatataatttgagatttttttattctatcttcttgaaataggagattagtcaatatttaacctttcttcttaatgatctacagggataaatttttctgtaaccactgcgttagctgcatcctacacgttttatgtcatgtttatattattgttctgtcaaaggcccacctgtgtttgattttggtgagaatcccacgtgaactagaaaagaacttgacttttcttattgttgtgagcattgttccatatgtacaaagttttgttaccattaagtatgttgtataaatcttctataactttagtaatttggaggtttctgtgctctatcacatattggcatgttaacatatatactattaaattgagcaatgactgggcaaaaggaaaaatcaaaagagaattaaaatctcaagacagacaaaaaatacactatactaaaacttatgagatgcaccaaacccagtactaagagaaaagttgattgcaatgaatagctacatgaaaaaaagaattcaaattaaccaactaactttatatatcaagaaactagaaatagagagcctaagtccaaagttataatacagaagaaaacattaaagtagaaatgagactagaaaaactaaagaaaaatcagcaaatctaaattgttttttaaaaatttaaaggtgataaaccttagctagactaagaaaaagagtatcctcaactaaaatgagaaataggaggagtcattagaacaaatgcctcaaaatgaaaaggatcataaaagactattatgaaaactatgcacttataaattagataatctataagaaatcaaacttgatttatgcaacctaccaaaactaaatcaagaggaaataggaagcctgaacagaggaagaagatcaaattagtaaacaaaaacttcccaaagaaaagaccgaaccaaatggcttcgtggatgaattctaaacattcaaagaactaatagcaatccttcttaaactctttcaaaaaccaggagaatgccccaaactcattttatgaggccatcaaacacttatatcaaagccagacaaagataatcaaaagaaaataaaactacaggtcaatatcactgataaacataggtgtaaaaatcttcaacaaaatactaacaaaccaaattcaacagcccattaaaaagagaataaaccatagccaactgaaatgtatctctgggatgcaagaatgcttcaacataggcaaatcactcagtgtgatataacacattaagagaataaaaaaaaattgcagcaaaagcatttgacagttcatgtcaaaactctgaaaaacaggtatagaaggaacttatttcaacacaacatatcatatatgaaaagcccacagttaacataataaaaaatgaaaatgtttctcctatggtctggtacaaagcaaggatgttcattgtcaccacttttatttaacatggtactgaaagtcctatccaaagcaattagacaaaaaagcatcaaaattagaaaaatattaaaataatctctgtgcaggtgacatggccatatatataaaaaccctaagactacaccaaaaaactattcgaataaacaaattcagtaaagttgcagaacataaaatagcacacaaaaatcagtgacatttctgcacacaaacgatgagctatttgaaggaaaataagaaagcaatcccatttaaaatagcaaaaaataatatatttaggaatacttatccaatagggcagaagactcctacactaaaaatcataataccttagtcaaagatattgaaggagacacaaataaatggaaagacactgtattcattcatttgaataattaacaaatcttcaaatttgtagatttgaataattaacattgtttaaaatgtccttattaagcaaaacaatctataaattgcaatttctataaaatatcaccggtatttctttacagaaataaaaaaacaataagtaactacatctagaaccataaaagatctcaaatagccaaatcaaccttgaacaaaactagaggcatcacattgatttcaaaatatattacaaaggtatgggaattatcactgtaaagaactgtcataaaaaagaaaaatggacatatagactaatgaaacacaatacggagaacagaaagcaacccgagcatatttggccaactgatcaacaaagtgagaaggcaacctacagaatgggagaaaatatctgcaaaccatatatctgtaaagagggtaatatccagaacttataaggagctcaaacaactcaatagcaaaaaccaattaccttgattaaaaataagcaaagggcctgggtaggcatttctcaaaagacgacataaaaatggccaccaggtaaataaaaagagctgaacatcactaagcatcaggcaaatgcaaactaaaaccacaacgaggtatcacctcccaccggttagaatagccatcattacagatcaaacaaaagagagggaaagtggagaaaaagaaacctttgaatattgttggtgagaatgaaaattggcacagcaattataagcaaacagtacagagtttcttcaaaaagttaaaaatagtactatcatatggtctagcagtcatgcttctaggtaatggttcacccaaagaagtgaaagcgggatttcaaagaggtatcagcacaccagtgtttattgcagcattattcacaatagcaaaaatagaaaaataactgtaaatgaatgaaaatgtaatgaaaatataaatacacatacttgcacaatgaaatattctttattttttagcccaaagtaaatcctgccatttggcacaacatgaatgaacctgaactatattatgctaagtgaaaaatacacagaaagacaaataccatatattctcacttatctaaaatagtagactagctcatagaaacagtagcatgttggtcccccgtgaggagtttagggaaacgaataaagactggtcaaatgctacaaagttcagtcatgcaaaagtgaataatttctagagggctaatatacagcatggtgactatagttagcaatattgtcttgtatacttgacatctgttaagagaataaatcttgtatacttgacatttgttaagaggatatcttaagtgttctaaccacaccaaaaaaaaaataactgtgaggtgatggaaatgttaacgagcttgatggtggtcatgatttcataatgtatgaaatatatgtacataatgtatgaaataatgtcggaagacaccgacacgccgcgccgccggagccccagtgcatgctggttgcgctgaaggcgaccccgccccagaatgcacggagcctccgcccaggccccggaaggacaatgtgcccgacaactggcgatggctgtaggaagccatggtgaggcgggggatggatggaaccaccctgggcccagcagctgtgattggcaggaggagccacatctttcattcttacagcctcagtctctctgcatccttatacttaaggtgtctgtaatcataatattgtataatctgataatctcagtattttacttggaacatttagtatattacatattttattgatacataatatttctacatacttatggggcacatgtgatattttgatacatgcatgcaatgtgtaataattactgatataattggggttctatgtgagctataacttctaaccatattctatttggcccatctgtttcacgtctctttttcattctttcgttgcttcttttagaaatataaaaatctatcattttttcattttataaacttgttttggcgtttactataaacattacagcatgtactcttgatttactaaagtttaacacaaattactacctctactacatcaatattgatatatcttcaacatgatttttcatacatttaagttttgcacaaatctaaactgtatattacattaaaattattgctaagtcaatattgattatgactcatttacatattactctttggggttgatgtttgtcatttttgcttatatttctgagtttacttttgagataatttttctatggctgaagaattttatccacttttgtttgttggaaaaatttattttactatcattttttataattggagttagactcaatctacatctagttcatccctattactgagacatggtcctactggactcttgattgacaggctggtagatgtccctatgctctgtcttgaaagcatttctcccaatatcaatgtggctcattaacttgtaaactccacatctttgctcaactataaccagtgaggattagcctaaatccctacataaaacgtgacccctacacactccaagacccctctcctgctcaagattttccaacacttttcttctgataatactccatgtcttcttctcaattaccaaatttattttctgtatacaccctttaagtgctaaaaaagatgaagatttttatttgttttgctcactgatgtatcctcagtttgtagaacggggcctggcaaactataggggctcagtagttatttgttgaatgaatgaatgacttggggcctaaaggaagattatgtagtcatggaaagttatcttcgtatccttgtacttacagataaaaaaacattccgaagagagggaaagccacgtgaaaacattgggtatggaaagaactatagtgtttccaaggttggagtatggccctcccagagggagaggcaatgcagtgtggaaaaggccacagactccacaagacgtggcacatgcagtggtcaggggcagggactccggcctgcctgcctgggcttaaatccctgttgagcactttataagctgcacacccttttgttcatgttactcaaacccatgggtttcagttaaatcaactgtagaataaggctaataataggctgtgaaaataaaagtgttccatacatgtcacgcactaaaaatggtgccagatcataataatcacacaagacgttataattattatgttatttgttaaatacaaatacaaccatgcacatacgtaaaactgtgatttgaaattatattctaagtatgtgtcaccattggcttgaacagggagaagtgtgcgaaacttccatatttctctggttaagtctatgaataaaccaattatactccaaacatgttgtagcccatgtctactggatagcccatgtctctgctctaattttgggaggtttgacttcttatatgctcacagaaaataagaatttgattgagaacacattctagaaattctgatggaagaaaaatctcaactgtacatttagcatctctgaggtcttgaatgtgtttatctccaaatgcctatggatgaatgaacccccttgtccctgaggatcccctgcttggggcaagtcaggggaagcctcaaaggctgttttgtcatttgtgaaatgtgggtgaccttagcctcagccacagagggtgaaggtcgaatgaggtggtgaacgaaaagcgtttagcacagagtggatgctgaggaacactctgaatatggtgttatttcatactcatcaatgggcccatgatagcaaaacaaattttctctgtggtggaaggtgctcaagggtcataaacacatttattttcatatttctccactgtaatctaaaaaaaggaccattggccccgaaggactggactagagatcaatgctacgagggaagggggggataagtgaacatcatctcaagtgtgattataggagggaagaacactgggctgaatccccctgaaggacaactcagggagtcagacactaccacaatatgctgattgtttggtggaaggacacctaaagtgaagagagactctaagaagagaggaccaacttaagttctttcacactttaatatggaggtttctgcacgctcagcatttttttcaaagcccttgtgacatccttattcctgaaactgtaaatgataggattcaagacaggtgtaaggatagtgtagaaaaaggatgacatcatatctttctcaggagtttggtaggagctggggagcatgtagttgtaaatagcagctccatagaagaggctgaccactgtaatgtgggaggagcaggtggtgaaggcctttttccgaccctcaactgagttcatcttatggatggtgaggatgatatagtagtaagacactgaaatgaccgtcacaggtatcaggagcatgatgacacagcacaagtacatgaaaatcttgtaaagtgaggtgtctgagcaagagagcttcaaaacagcagggacctcacagaagaagtgctgaatctcatgggatctgcagaaggggaagctcatggcgatgggagtgagcatgaagccatccactgagcccacaaaccagcagcctgatgccaggaggagacataccctatggctcatgagcacagagtaacggagaggatggcagatagccacatagcggtcataggccatggcggctagaaggcagcactctgcacctcccaactgcaggtagaagtacatctgggtgccacacccaaggaccgagatggtcttgtctttggccagctggttcaccagcattttggggacagtgacagaaatatatgtcaagtctatgagtgagagctggtttataaagaagtacatgggagtatgcagagaggagtcaatgtggatcagaagtatcaatgtaatattccaagacacagccatcaaaaatatactgaagataagcaagcagaggcggccagggtgtgagatctggctgaagattcccaacaggaaaaagtcaccacccagggtctggttggccagccgcatgctgtatgatcggctgaagtggctttacctggaggacaaaagtaaactttatttataatcatgtgtgtaccacgtaaaagtatgtttgcttcactttaccttttaaaaatcaatgtgaaaatcagagtgtatttccaacatgaactgtgaatttgcactaaaaagagacagcacattagattgtgaatctgattccccatctagaatgggaatgaaatatttatattctcaatgaagaggtccatacaactgaaattaaattatttcctatagattatatagtcactaatagttatttttacttatatatgttcacattttgtgtgtgttagtatcttatagttgcatgttcctgtattgcccaaatcccattcccatgggattttacagagctaataaccaatatagatatttctatatatttgaccctcaagagtcatgtctgcaaaaaaggattagtaatacttgtgtttcttaaatctcgttacaaatctacgaacatacaatttttcaatacttaaaagcaatatattaagccaccagtaattgtaaacattttaaacataaaattccaaacccttatataacgttacaaatttagtcaaatttctttaaatgtattaaagacactagtacaacttgtaaatttctctaaaatgatttacttttacacatatgtgatttataaaatgtatttttatacttccacttaacctattacaaagacattaatcttgtgagttatttattcatattttcataatttccatcaagatgttctaatccgttgtgtttctgccaatctttcaagatatcaaaaaaaaattatggctatctcagatcaatgatgctttaggaatcagcattatcatccaatcagtttattctgaggtgattggtctgaacctcacttggaatttcttgatgtgaaccttctttataaaattaaagtaaaatgtaattggattttacaagcccacatcttttcttccaatctccccattttgcctgtagaattttggtgagagaaagtttgcctcaatttatacttatcttatcgtgacatccaacatatttattgtatgcaggtaggtcatcctaaggtttcttctcccagtggttcaagcatgggggtctctgaagttgcaattttttttaaagactactcaagtgcactagtgagaagggaggaaaatgtagaacaaggaattctatctgtaactggctgtgaacaatcaattgagataactatcttcagatcatccaagttccaatttcttctcagagcatctagtcaattaatcaccttgtaataggctgtaggactcttcttctacctggctattttggggggtcagtggtgctggtcagccctttcccgttgatagcactatctttctcttgttcagaattctgtgatttacatatggatgctcattattattattctctacttaaagaaaatgcatatcctttataaaatgaatagttttagatatcattaatgttcaatatattaataacgtgtcaaatgtttatttaaatcagacacatattcatcctttttatattgcagcttttcttatgtaaccttttacattgtaatgtacactttatattttttatcattaacttaaaatttataaataagaattattgcaattggtcatattatttccttttttatttcaaatatcttgccctggccaagactaaactcgtgggttttcattttgttttagaaatacttagcaaaggacacagaaagcataagagtaaagtaatgccagtttttaacaaattgctttcttatgttaagagacttaaaaccaaaggggacttaatgtattttcagtaaataaacatgtcattggccataacaaatggtagattttagtcaattaataaattactagactaataaactatattttcctggagcagaaagtaattttctaagtataaaggcaaaataaataattcccaataaacttcaaaaattcagtggaattatttagtagattccaaaagacaatgaagcaacatcatctagaaaaatttgaaaaaaaaattatggtccaagaatgaagcatatatccagcagtgaaacagcatagaggccctgtctctcagatatccaagaactcagaaagcagagaatcaggtaaaccgtttcagaaattcactatcagccctgctccagccactgtcagtcaatgtctgtcccgtcaaataaaacaactgcaaaatgtgagagtcatggtacgcctggaccaaaggcgaaacctgagacaaataaaacacacatgtgccaaattgaatgatcatcgtccatctgtatcacataatgtctcaaagaaaaatcaggaagtaggcgcaaaaggggtaaggaaaagtagacttaacggaatttccacaatttataggagataagcattttcacttgctgcccagcttctcagtgaaataagtgtatttaatgtccgctcccaaaaatggagtccatttagggacagtgtccaggataagactggtgcctgtcagagctaattaactctaggtctatgtaaggaggccccttcccaagttgaacaggtggtttacaatgagtataattatgcaaatcagcagtgagatggacatgagctagtcagggtgagcatatctcaggtttattcaggagaacaaaagtgagagtggatattgcatttcttggccatgtagttcaagctaccgttcttccacagacactgaaacaaggggactgagtccataaggctgcagaacaaaactccccttaaccaaatcaattaatttatccacttctaggaaacaaatgacaccagcacagacggccacgcaaggcaaaagaacagcaattaggttcattcaaaagcaataaaatattttaaagatgaactgctatttccaaaatgaaacctttatgacaaagcaagcaaaccagttgtgacaggcttcacagtagtaacatctgcactgtaggaaggagagcacccctccttcttgagtgggtatttatactccaaagtgatgtgtcatgcttcacccaggaagtagaattatgttgctcaccatgaggctgaaacctctatcaaccatctcccactcatccacatcttcctgttttggagtctgggagatcagttatttaaaaacaaggggaaaaaaggaggaaaggaagggagggaggaagaagagaggaaaagaaaactaatattcaacattgctccgattttcagaggaaaaaatgtttataatttaagtcagatttgcctggaaaaatataccaccaggaggaaaaggctcaagatctgaaatcagttatttttttagtttagttctcttcttttccgaggtacgttgcaagtcacctaaaacttttgagtatcttttttttccatttatacctgtaggggtacacactacttatttctacagcctaattaataggattgcagagagtttcagatataatatgcacagcaagtactttctaaattatagctttgtattaggttaaatatgcttatgagttattttatgtgatctataatataacaatgttagtataattttaccaattatatttgctgtattaaatatatattaactgttacattggtgattaatatcaattgataatataattctataatacatatattattaaaagttaataacaataaattattcctttcttactggaacaaaggaagaaatgtaataccctgaggaattttatttccaataagatacttccagtatagtcgtcccgatgaatgacagccttgtcattttcgttgtgatcaatctgctctgtgatcagtgaaacaccagcctgcttttctgcgaaagggtttcagatgatgaaacacttatgaacttgatgactctccctgaagagcagctgatgctgccgagtctaacacgtgcggtcctgggacgacaaacttgaagaatgatgctgtccacagggacccctcacagggctgtggtggcctccatgggagcagtcctgggggagtctctctggcctttgttgaatggtagggcctgattctatagacttttccaattgcctaactcctctaaccctccaaatgaaaacaagcatctactaatggcaaacagacttcaccagactgtttccttgaagacaacttcgctcacaggtcaaaccattgcatcatcttgccatgagggaaaagagtgaaacgaacctgaattagacaattgataacacatttaatagagtatattcttccatttatttattggttttcttagtaataactgtagaaaattttaaaactaagtattattataaaaaggagaaataacaacacatactataaaaagccaaagataactagagtttgaatttttcttgcttttaggcaggcattttcatgtgattttctttatagaattttgtatccatttgtctttgaaaatatgacattttaaaccaaagtgtttgcatttgagtgtccataaaatgtaaaacttatttgttatttctaatttcttatttatctcaaacaattgtgcataggaaactttttaattatgaaaatggacattcgtgattgatatcgctttgttaaatgtataaacccttttaactgaaattttcatcagaagatagggttattgctgaaaatttgaaaagcattgaataatgtaaataatacaaaataacattttttacttttaacccttagaagcaccaatttaggaataatgtaacatttccctccaggatgtgtttggagacaactgatatatccaaaaatttggtttttgcatttcaaacagaagattatagaatggcctttacactgtagcatatgactttgaaataattaatgtagaacattggctgagtaaacacattatatgacctccctgtgtcttaagtcttcagggtgtttttcacgttttgtaacatgagtgatatttcaataaacagttctctgttcaatgtgtttattttggtggaattacaaatttgaaattccaggtgtgatggtcagaggatctatacctcttagaacattccactaaatgactttccaaaatgtaaccactattaaaagttttatagttatggccgggagcggtagctcacgcctgtaatcccagcactttgggaggccaaggcgggtggatcacgaggtcaggagatcgagaccatcctgggtaacacagtgaaacaccgtctctactaaaaatattaaaaaattaaaaattagctgggcgtagtggcgggcgcctgtaatcccaactactcaggaggctgaggcaggagaatggtgtgaacctgggaggcgaggcctgcagtgagccgagatggcaccactgcactccagcctgggcgacagagcgagactctgtctggaaaagaaaaaaaattatagttatttatggtcccaaaacaacacattcgttataaaaaatttacaaatacaaacttcaaggaaggaataatctacagaaattgaatgtgccattgaatattctagtgttttatactaaaaagtgtatcaaacgtactttaccatgtgagtgttattaacatcagtccacctccaaaaagtgtgtgcatgtcacatgaggatacgttccaagcacacggaaagtgttcagtgattgatccaatcagtagtcatgcagagtaggtgctaataaacactaccccgagtgaggatgcagacacggagacgcaaagggcataggggaatttccccaagtcagacagatgagtaacagggcagctggactcaagacagactgataagtaacaggacagctggactcaagaacgtgcttctagaaccacaatgctgcactaactcctaattgcaattcctggtaacagctgaaggatcttctgattatattgtagtccgtatttagtagactttttagaaaataaacagacaaaaaatgcaaaagtcattagcgtacagctcaagtagtctttggaaactgaactcaccacagcctgcccacagatgcacaatcagaagtgagttagcccccacgtagacccccagcctgcatcccaataccctccccaaagaaactgtgactctgccttcctataaagtagttttgcctggatttgaaatttatgtaaatagagtcacaaaacatgcactctttcatgcctaccttcttttactaaacattatgtaagattcaagcacatttacaggtagttatgttggtggttttttcattcttactctgtattgtatgctctaagaacaaagaacaatttgtttattttgttgttcatggcaacttgttttctatctatggctattataaataataccctgtgatcatttttaatttgaaattcacaacttaagaagagataatcagcacacctttacatccactaataacacacagattgcatagtacaagctaaaaggataacgcaaaaaaacaataccacagctaaactgaccattttgacttttattaattggagaaatttattgtaaatcatttaagttttataaaactatatacttttaaaaatatatattaaccactacaaaaaatttattcagtaaaatatttcacctacattttaaaacatgtattttggtaaacacatgtttgcatttctgttgcatatataaccaggagtgggatatctgggtcatagatgggcacatattcagctctatcagatactatcaaactgttttccagaggttttatcaatttatagtctcattagcagttattttaatcatcataaccacactgacagatgtgctatttcattgtggttttaaagtgtcattttttgacaactagccaagttgaaaaccttttcatacatttattggaatgtacattttgtacatttattggaataatttattggaatcatggctatcatatttgtaaattcccattctagtcttttgccatttttaagtggattttctgcttctttattgatttgtaggaatttcttctatgtgttctatatgaatccttcatacatatatctatttataaatatttccttgttttctatgggttgcttttttacaatattaattttttaaaataaattttaatttaatgaagtccaacttactatgttttcctttagtgttagcacttttgttttctgtttaagaaatacttgcttacctcatcattataatgtgttgttctatattttcttctaagagattattttaccttttatatttcaatctatacagcccatctgaaatatattttcttatcctgtagtgtagggatcaatattcattttttccatgtggattgtgcagtggagtcagaactattaaaagcatcctgcatttcccactctgagtggttgccctggtcataaatccaatgtacatgtaggtgttgatccatttctaggctttattttctgttccatctgttcatttgacaatttgcacagataccatgccgtataaattggtatagttttaaagtaaagcacatggaaattggctgccaccagcaaggaatggtggtatctgtgagaggagttgacatttgaagagtaactcccagggctttgtttgagagtgctaatttagaagagtacaaagaatggctggaaataatgtgttaatatccaccactgggagcactaacttggctgactcttccattttcaatgctaaaatttactgaaacctccaaggaaaactcatacttcacattttgaagaataaatgcctcagatggaagagagtgatattgattcaagaacctggaaaacaaaaacttataagaggcatgaagactattaatataatggaagtctttgttatgaagataaagttgtcttggaaaatcacatgaaacaataaaaagtgttattaatatggaaattaaaatgtgctgtgtgaaggagtcagtggatgaatttgaaggtttggattctccggaatttgaaaatttattcatggtcttgaactttagggtttcacttttaatgacctgtgcaaggctgagtgtagagttagtgcagcaccagttgtattcaattgttcacataaaggaatgaatgttctaaaagcagtgacaacccagtagcaatgaatgagcacacggagtgcctagatcttggtttctaaatgctaatggtagtttgtatttctgtgggatcagtggtgatatcccgtttatcatttttcattgtgtctatttgactcttctctcttctttattagtctagctagtggtccatctattttgttaatcttttaaaaaaaaaacccagttcctggattcattgattttctgaagggattttcgtgtttctatttcattcagtcttgctctcatcttagtcatttcttgtcttctgctagcttttgagtttgctcttgctcctctagttctattaattgtgatgttagggtgtcaattttagatctttccagctttctgttatgggcctttagtgttataaatttccctcttaacagtgcttgagctgtgtgtcctagagattctggtatgttgtgttttgtgctcatttggtttcagataaattatttctgccttaattttgttactcagtcattcaagaacaggttgttcagtttccatgtagttgtgcggttttgagtgagtttcttaatcctgagttctaatttgatagtactgcgatttgagagacggttacggtttccattcttttggaattgctggggagtgttttacatccagttatgtggccaattttagcatacatgctatgtggcactgagaatgtatgttctgttcatttggggtggagagtcctgtaggtgtctgttcagtccgcttggtccagcctctcttaccactcctattcaacatagtattggatgttctggccagagcaatcacgcaagagaaataaaggtattcaaataggaagagagaaagtcaaattttctgtttgcagaggacatgattgtatatttagaaaaccccatcgactcacccccagaactcaagctgataagcaacttcagcaaagtctcaggatacaaaatcaatgtgcaaaaatcacaagcaatcctgtacaccaacaatagacaagccaagaacaaaatcatgagtgaaccccattcacaattgctacaaagaataaaatacctagcaatacaatttacaagggatatgaagggcctcttcaaggagaactacaaaccactacttaaggaaataagagacaacacaaacaaatggaaaaacattccatgctcatggataggaacaattaatatcgtgaaaatggccatactgcccaaagtaattttagatccaatgcaattcccatcaagctactaatgactttcttcacagaattaggaaactatttgaaatttcatatagaaccaaaaaagagccagtagagccaaaacaatcctaagcaaaaagaagctgggggcatcacactacctaaattcaaactatactacaaggctacagtgaccaaaacagcatggtacctgtaccaaaaacagatatatagaccaatggaacagaacagagacctcagcaataacaccacatatctactaccatctgttctttgataaacctgatacaaacaagcaatgggacaaggattccctatttagtaagtggtgctgggaaaactggctagccatatgcagaaaactgaaactggacccattccttacacattatacaaaaattaactcaagatacatttaaatctttaacttaaaacccaaaaccataaaaaccctagaagaaaacctagtaataccattcaggacacagggatggacaaggacttcatgactaaaacaccaaaagcaattgcaacaaagccaaaatcaacaaatgggatttaattaaactaaagagcttctgcacagcaaaagaaactatcaccagagtgaacaagagacctacagaatgggggaaaatttttgcaagctacccatctgacaaaggtcttgtatccagaatctacaagaaagttaaacagatttacaagaaaaaacaatcccatcaaaaagtgggtgaagggtatgaacagacacttctcaaaagacatttatgtggctattaaacatggaaaaaagctcatcactggtcattagagaaatgcaaatcaaaaccacgatgagataccatctcacgccagttggaatggtgattattaaaaagtcaggaaacaacagatgctggcaaggctgtggaaaaatagaaatgcttttacactgttggtggaagtgtaaattagttcagtcattgtggaagatagtgtggaattcctcaaggatctagaaccagaaataccatttgacccagcaatctaattgctaggtatatacccaaaggattagaaatcattctactataaagacacattcacacatatgtttattgcagcactatttacaacagcaaagacttgggaccaaccaaaatgcccatcaatgatggattggataaagaaaatgtggcacatacacaccctggaatactatgcagccatgagttcatgtccttcgcagggacatggatgaagctggaagccatcattctcagcaaactaacacagaaacagaaaaccaaacaccgcatgttctcacccgtaagtgggagttgaacagtgagaacacatggacacagtgaggggagcatcacacactggggcctgttgggtggtggtgggggaaggggagggagagcattaggaaaaatacctaatgcatgtggggcttgaaacctggatgatgggttaatgggtgcagcaaatcaccatggcacattatacctatattatacctgtgtaacaaacctgcacattctacacatgtatcccagaacttaaagtaaaatttaaaaaagctctagagtctttgtgtggtgttaaaccatatctctaaacaaaatgatactaaacaaaatttaaaaatactaatatgtgtgatttgttgtttgcaactttctctcgtgttcatactcccaacgtgggtaaattcaggttgctaatatgatgtcactgaccacacagttgggaaaggatatgaataatcatatctcaccagctagtgcaagctggccccagcacaacactgcagaaatgttagaacagagactacttccaggaggagaaaataaggagggttaacaggacaaaataataggaataaatttctgaggtgagaaatgacacctgtctcaaatccaaaaggtatggtatagatactaaactgggtaaatgaacccaacatttttattttattattattactttatatttttgagacagtcttgctctgtcacttaggctggagtgcagtcgcacgatctcactgcaacctctgcctcctgggtttaagcgattatccttcctcagcctctgaagtagctggcattacaggctgtgccaccacgtccagctaatttttgtattttagtagaaacttggtttcaccatgttggccaggctgttcttgaattcctgacctcaagcgatccaccccgccttggcctcccaaaatgctgggattacaggtgtgagccactgtgcctgaccaacagtagctgtttttttctgcttctctctttcctcccaccctccatcctctagtgggatccagtgtctgttgttcccctttgtgtcctcatcatttagctcccacttacaagtgagaacatgcaatatttggttttctgttcctgtgttagtttgctaagaatgatagcctccaacttcgtccatgtttctgcaaacaacatgatctcattcttttcatgactgcatagtatcgcatgatatatatgtatcacattttctttatccagtctaccattgatgggcgtttaggtcgactctatgtctttgctattatgaacagtgctgttatgaacacatgcaagtatgtgtccttatgatagaacaatttatgttcttttgggtatataccaagtaatgagactgctgagtcgaatgctagttctgtctttatatctttgaggaattgccatagtgttattcacaatgattgaactaatttacactcccaccaccagtgcatatgttcccttttctctgcaatctcatcaacatgttattttttgactttttgataatagtcacgctgacaggtgtaagatggcttcccaatgtgggtttgattttcatttctctaatgatcacagatgttgagatttttctcatatgcttcttggccacaagaatatcttcttttgaaaagtgtctgtacatgtcctttgcctactttttaatttttttcttgtaaatttaagtttcctatagatactggacattagacctttgtcagatgcatagtttgtaaatattttctcccattctgtaagttgtctgtttattctgttgatagtttcttttgctgtgcagaagctccttagttagattccatttgtcagtttttgcttttggcatcttcatcatgaaatctttgcccattcttatatgctgaaaggtattgcctgggttgtcttctggggtttctagaggtttggattttgcatttaagtctttaattcatcttgagttgatttttgtaaatggtgtgaggaagtggtccagttctaatcttttgcatatgagtagccagttttcccagtaccatttattaaatagggagtcctctccccattgcttatgttttaagctttgtcaaagatcagatggttgttggtttgtggccttgcttccgagttctctattctgttgctctatgtgtctgttttttggacaagtgccatgctgtttggttactgtataatcttgatgtggtcccaaaatgggaggaagtgcaatatgctccacctggagagggagatggagaatgccaaagatttctggagaggtggactaaggcagaccctagagggcttggtagggacgataatcatttctaccacacagtgttgttaaaagattcagatgcaaaatctcccataaatcatagcaggaactacacaatccataaaaagcaacctagtaagatttcagtgagtaggctactaattaatcagtatgtttcccctaagccagcaaaaaccaattctaaaacagagtgagaagaaacctactccagaaagcgagcatagaaatacaggtctagaattaaaggttcacaacatgtgcaatatctgtggtgaagcatcatcacactcttcaaattggacaaagacagctggatggaagtctctacatggtacacaggtagatttcacttaaaatagtacaaaaatcccaatatgacctttatcaagctttgttgatttattattcttgttatgctggttctattgttcatacctcccaattctgtgagctgctgtacgaaaaataaagcgtctccgtgctaaaagaaaaaagccaaagaacaaggcggcctccacacttctaccatctaaatctcctcacgtgcacctcatcaatagaacctaaattactggtgaatctcagataccatggagtttgtatacatagattttagttttccagctttaccagtcaaaagacatatgaagaagttgggatgaaaacaagcaagccaactacagtatcctcggcttctgcaacacacatttaggttttgcctttacttcaataccctttctctttcaataggtctgtccgttcaatttatgcaaattatgcaatttcaatttatggaaattagaaatggttggtctcttttctgacaccttatttttgctatgcttccttttttaactttttatttctccccatgtatagttaattatgtgtttgtgtttgagagctcggtttttaaaattaaaattttttactttttcattttattcattttttccaacctcagaagagcacattgttcttttagatctttggattactcttatatttcaaataatatgctcaaatgtctagtttttccacaatctaattactatttaagtacatttacacatttgccactctctccaccatgcactcaattttagtttttcagttacattattcctcttaaaaccttttagcatatccctatactttaatcatataattatatccgtattaactgattcatcaagtataaattgtaaagaggttggtctgccaaggaaggtatggattttgtgaagatataaaagaaaataaaagacatgtaaatactggtagaaggagacatctttattagtcatttccacatccatctccccagtttctagatttttttatattgttatcacagtctatattgtctcagtttgttacatttctattttagtcataccttcatttacttattcatatagagtcattttctcatgtgtttttattaaatgcttttacatattatcaggaacctttccattatagtttctccaggcatcctttggtgggttaaggtttgtcctcaacctgttttattgtgatgtatatatgtggctattctacttttcctttctcttaaatcttaaagaatggctttgttttttaaaagatattccactaaaatattgttaagtattgctctattttttatcatttaatataaataaaattcaaagaccggcctaataccactatattgtgatattttgcctagatttcctagtaattctaacttagacacacacagtaccatatttttgtgggacatatctggatatagaaaatactatatcacattttgaaaaagtatctgcatgtacattttcattctaatcatttacatgtatttttcaaccacaatatttatgtttgaccctttttgttggtttccaaatccactgacactttttaacctctctctttattttcctcaggatttttaagcctctttttctggtccttcattatttttaagctgtttctcttcatttgttaacatatttttattttacttttatcttctatttattctctaacatctgtcacctcagtattgatttctgtttttgctttataccgattcctttgaccctcatgtagcatttgaattctattacaaagaaatatcagatttcatttcaactttatttcaagggaaccaacttttcataattttggtagatattatgttgtatgttttctattttgctttagctttctttttacttttgatatatgatgttgcctaaaacgaaatatttaagtaaatgtatttccattcctagctacctatgtgttttaggcagatatgagttttgaaatgtatttgaaaccttttggatcctttatatatgctacatagctttcataggacaccaagcgacgcaatgttttacagccttgtcttgtatattctgtcctatccattgttacatgtctgagaccaaatttggctgtttttatcatttctcttaaacatcagaacctcatctccatcatttttctgtaaaccttgctttgaattcttcagtctctcctatctttagttatctaataacacatgcaatttaattcagactgataaaggatattgtcttaaatctttctgcctctcttttgtccttactgtgcccccagtgaccagcataggaatgggcacaaagcaggcacctgactgtggagtgaataaaccaatgcctggcaacatttagaatttataatcggcaaatccactacttaattatattgagaggattaatttaaaacaatcaacttgaaaacagttaaaatggtagctcagttcatttactgaaaacaaaggaagcattttaaacaattctcttggtcttcgtaacctttcgggactagccccctaattacctgcaagaatagaagagcccagggacctcctgagaagcccagtttcctccgtgttccttatgctttttcccttcgtggaaaaaagtgattgcacctttctttccatttcctaattctacatcatgccttgtatttagctggagactcactcagagtgggagagcctgagagaagagctggagacaagcaaggtctgcaggggattccagggcaggccggcccatgacctggccagccctgccatgacctgctttcccacccaggtaagctgcttacacttccgaggtgaaactattagaaaattaagaaaaaaaaattagacgtgtgtaaatttaggaggcacaacatttccctggagttgaagggaactatactaagttctacagaacttgagtatttgaagatgcttaaattatcattgtgctctattcagccacaaggatcttgtgctataaatttatcgtagaatttgctgttaaaacacacccacactaaagaagccaccacattactctatttgtgacttttgttgcagaaatattactatacatttatttttcatatttcagctgtgaatttttaaaatcacattcaaaggcatgaagagttaggtagtgaattgtttactaaagtgtcattttaaaagaaattcaaaagtttgttttacaagtttaaacatttcatgtatactaatcagggtcagccttaatgaagctatggtctacttagaatcgaaacctgcatattaagctattaaatgttactcaacaaagtcactgaaaatttctagtgccataatctgatgaaaacagaaaagttatttctcctcaatagattgtcaatggttatggtaaaaaattaaccagtgaaatgtgtggttccttggcacgactgcaacacaattctgggaaaatactacaagtctcaaactttccattgtgattcactgaactaaggaagcattactcagtaaattattatgaaaatttagtaaaaagttaggtgaaactaggtcctgttatcacattaatttaaaatatcaaatcgattaaaggtttacatgtggaaaataaaaatataaaacaagacacatgaatgggtaaagatttagctaaacggtgagcaaaggcaatgaagaaaacatggaaagtaaaattagtatttgaaaactgaaaacaatctctgaataaaacaaattttttctaattaggaaatttatggttcacatgacgaatcaaaggctgaggatcggtaatgtgtaagattctcttgcatattcataagacagacatggcaatttttaaaatgacacaaacatgttagtaaacaatttgtggaagacttgtacatacaaaataagacaatgacaaaaagcacaaaaatgtccattaatttgttgaataacagagaggcaaaaaaatgtgtgattatcagtgttgctgtgagtcagtgaaaacaccagtgcggccttttgtggtatgccggggtagatcactgacgggtacaacccgagtatatgaacatgaaagggacactgtttaataaaaatgtaataaccgatacaataaaggaattccttacacagatattcattatagtattgttttagattagtaaaaaattggaagaaatctacattggaaataagaaaactcagattctgttattaaggtaaattgtgaagttatattcaaaacaatatttttaaaaagtaaacactgaaaatatgtacacaagaatatttatgcagatgtagagctatatacagcatgattctaatctatagtattttaatatatctatgtatctatatattaaaaatatcattttctcccacaaaaaataagtatgtgagatggatatgttaattatcatgacatggtcattccacaatgtgtacatgtattgaaatatctcactgtacccaaatatatatacaattgtcaattaaaaacaattttcaaaatcctattttgaaaatttttattctgacttgatcattatacaatgtatatatgtgtcaaaacatcaccccataccccataaaaatatacaattgttatgagtcgattaaaaacaaaataaactaaaatttttacaaagaaaaaattttatagtaaatgtggtaggatttattttatacctttatttctccttttagttccatctatgtcttaaattatgtatagcactcacagatgtatttatagagtgaaaaagatgttttaaaaagataatatagttttaatcataagaaattattgacatgaattttttttgtcaccacgcagggccccctggtttgggcccaaacacagctgccccactctgggctgaccacacctattggtagcagctctgcatttctctgggatggggcccaagaaacatgtgaaaggccctcttccacaacactgccaggaccctgctcacactgcctccaggctgaggggaacataaagcctgagtcaccccagaggtgtggcctgtagcccaggagtaccaagctgagatctacagccagcactaaaggaggaagaggagcccacactttcagagcactgagagggagcaagcctgcaattgtgagaaaataggcccttgttcagccccacggctcctctatctaccggccattatgcttaagcaccatctactggatcacagcccaaacttcgacaccaaaaatactctaatatacctccccatgaaaccaaggccaagaactcagctatgagtaaagaccctgcacaaagccttgggccctctgaaaacatccagaagtcaactgactgtactcaagttacaccacagtgaaggggacatgagcccacacagatgagaaggaaccagtgcaagaactctggcaactcaaaaagccagagcatcttttctccaaacaaatgcactagctcccccaactagggttcttaagtagtctaaaatggttgaaatgacagaaataggattcagaatatagataggaatgaagaccatcaagattcgggagagagttgaaacccaatccaaagaatctaaggattacaataaaataatacaggagtgatcgatgaaatggccattataagaaccaaactgatctgtgagagctggaaaacacactacaagaatttcttaatacagttacaaatattaatagcagataggactaagctgaagaaaatctcagagcttgaagatgtactctaaactcagaaaaaattaaaaattaaaaagagtgaagaaaacatctgagaaatatggaattatgtaaagagaccaaatctatgatttatatggtatctctgaaacagagcgggagaagacaagcaatttaggagacacatttcaggaaattgtccatgaaaatttccccgatgttgttagagaggccaatattcaaattgagagcactgagagagaacacatttggtctcccctgtgagccctttgtcctcttgctcatcaccaggaagggcccccctggtttaggcccatgacacagctgtaacactctggatcaatcacacctattggtagcagctctgcatttctccatattcatgtggggtaaagtgtggttggtcggaggaaggtagacactctggcaactcaaaaagccagagttcttgcactggtttgttctcatctgtgtgggctcatatccctttaactgtggtgtaatttgagtacaattaacttttttctgcaagacacaacacaagaagtccatcactaagatacatagtcatcagattctcgaagatggaaaacaagaaaaatgttaaaggcagctagagaaatggggcaggtcacctacaaaggaaaccccataagctaacagcagatcctttagcagaaactctacaaaccagaagaggttgggggcctatgttcagcattcctaaagaaaagaattttcaaccacgtatttcatatccagccaaaggaagcttcataagcaaaggaaaaataagattcttttcagacaatgctaagggagttccttacaaccagacctgccttacaagaggtcctgaaaggagtgttaaatgtggaaagaaaagaccattaccagtcactaccaaaacacacttaaatacatagaccattgacactataaagcaaccacacaaacaagcctgcaaacaaacaaaaaaacacctaggaataggatgacaggatcaaatctacacatatcaatgttaatcttgaatgtaaacaagctaactgcctcaaagggcacagagtgggaagctggataaagaagattcaaaggtatgctgtcatcaaaagacccatttaacatgcaatgacaccaataggctcaaagtaaagggatggaaaaaaatctaccaagcaaatggaaacaaagaagcaagggtttcgattctagtttcaggcaaaacagacttcaaaccagcaaaggtcacaaaagacaaagatggccataatataatgctacaggtttccattcaacaagatctaactatcctagctatctatgcatacaacacagaagcacccaggttcatgaagcaagttcttaaagacctacaaagatactcagactcccatacaataataatgggagatttcagcatcccactgacagtattgaggcaaaaagctaacaaagagacttgagacctaaactcaacacttggccaaatggacctaatagacatcttcagaactctgaaccccaaaacagaatatacattcttctcacgtgtacacagcatatactccaaaattgaccaatcggacacaaaacaatcctcagcaacttaattataccaaccatattcttggaccacagtgcaataaatagagatcaatactaagaaaatcactcaaaacaaagttatatgaaaattaaatatgctaatggtgacctttttgtagacaacaaaattaaggcagaaatcaagaaattatttgaaactaatgagaacaaaggtaaaatataccagaatctctaggatgtagctaaagaagtgttgaggagtctgcaacactaaatatccacatgaaaaagtcagaaagacctaaaattaacaacctaacatcacacacttagaactagagaaacaaaagcaaaccaactccaaaactagcaaagaactaatcaaaatcagagcttaatgggaggaaattgagatgtgaaaaaccatacgaaagatcaacgaatccaggagttggtatttgaaaaacataaagagacaaatagaccactagatagactaagaaaaaagagaagctacaaataagtacaatcaggattgtcaaagagttcattaccagcaacctgacagaaacaccaaccaaagaaaaccctcagactactatgaacagctttatgctagagaatctagaagaaatcaatgaattcctggacacatacaacctctcaacattgaatcaggatgaaacagaatccctgaacagaccattaaaaagttctgaaattaaattcacaatagaaagcctgccaactacaaaaagtccaggaccagacagattcataactaaattctgcaagaggtacaaagaagagctcatatcattcctacagaaagtattccaaataattgaggagagacccctccctaacttattctataaggccagcatcatcctgatctcaaaacctggcagagacacacacacaaaaagaaaaacttcaggccagtatctttgattaacagatgcaaaaatcttcaacaaaatacaaatagaatctaacagcacatcaaaaagtttatccaccgtgaccaaagtaggattcatccctgggatgcaaggttggttcaacatcacatcacatagaattaaaaacaaaaaccaaatgattatctcaatgattcagaaaaggcttttgataaattttaactcccatgttaaaaactctcaattaaactagtcattgaagaaatatacctcaaaataacaaatgccttctatgaaaactccacagtgatcatactgaatgtgcaaaagctggaagcatttcccttaaaaaccagcacaagaaaaggatgccctctctcaccactcctattcaacatagtattggaagttctggccagagcaatcagcaagagaaggaaataaaagacatccaaataggaagaaaaaaacctcaaactatccctgcttgcagacaacatgatactatatctagtaaaccacatggtctctgtcccaaagctccttgatctgataaacaacttcagcaaagtttcaggatataaaatcaaggtacaaaactcagtagccttcctatgcactaacattcatgctgagagccaaatcaagaatgcaatctccttcataatagccacgaaaataaaatatctaggaatacagctaactggaggtgaaagatctctacaatgaaagttacaaaacactgctcaaagaaatgagagatgaaacaaatggaaaagcattacatgctcacgaataggaagaatcaataccatgaaaatggtcatcctgcccaaggcaatttccagattcagtgctattcacatataaaactacctatggaattcttcacagaattagaaaaaaatattttaaaattcacatggaaccaaaaaagagcccaaatagccaaggcaattctaagcaaaagaacaaagctggaggcatcacactacccaactttaaatcatgcaacagagctacagtaaccaaaacagcacagtactggtacaaaaacagatatatagaccaatgggacaaagtagagagcccagaaataatgacacacacctaaaaccatctgatcttcaacaaggtgaacaaaaacaagcaatagggaaagaactccgtgttcagtaaatgttgctaaaataactgtatagccgtaatgcaaaagattgaaactggaccccttccttatactacatagaaaagtcaactcaagattgattaaacccttaactgtaaaacctaaaaccataaaacatctggaaaataacctaagaaatatcattctagacataggacccagaaaagattttacggtgaagatggcaatagcaaggtcaagcaaggtcaacaaaagtgaaaactgacaaatgggatctaattagactaaacagcttttgcacagtgggcaaaggatattaacagatacttttccaaaaatgacttacatgcaggcaacaaggatataaaaaatgctcaatatcactaaccattagagaagtccaaatgaaaaccacaatgagataccatctcacacctgtcagtgtgtctattactaaaaagtaaaaaaataacagatactggttaggttgcagagaatagggaatgcttatacactcctgttgggaatgtaaattagttcagccattgtgaaagtagtttggcaatttctgaaagaacgtagaattaccttttgacccaaaggaatataaatcattctaccatgaagtcacacacacacacatatgttcttcacagcatcgttcataatagccaagaaatggaatcaacctaaatgcacatcaatggtagactgaatcaagaaaatactgtacatatacatcatggaatacatgcagccagaaaaaacaagatcttgttttttgtggcaatgttgatggagctagaggccactatactaagtaaactaacacaaacagaaaaccaaataccacatattttcacttatgagtgggagctaaacagagtacctatggacacaaagaataacagacccccccaccgggcctacttgagggtgtagggaggaaagtgaggactgaaaacctacctatcaggaactatgcttatcacttgggtggtgaaataatcagtgacatgcaacttacctatataacaaacctgcacatgtacccctcaacctgaaataaaagttggaaaaaaaactttaaaaaagagagaacgtctcaaggacaaatgctgttagaataaaactaccaatcccgaattgtaaacccagctatactatcattcaaaagtaagggtagttagacaggagaaataagtttagatctattgtataacatgatgattacagtttatatctacgtattatatatttattttcaaattgctagattttaaatactccaccactcaaaaattataggatgtgaagtaattgatatgttgattagcttgattttgtctttccaaaatgtgtatatatgtatatacatattaaaacattgggttgtacaccatatatacaattgtcaattaaaatataaacttaaaaatttgaaagaaaatggtaataaaaaattaaaaggattaaattaacaaaagatattttcaggccttttttgaaacataagtgtttaccactcagtgaagggactcttatgtttaaagcataaatacagaagaatcaagatgttgggagaaaaaacagcaacaaagttttggaagctggaaagccaaaggaaactgtttttgactcaaaaatctcaaagcagaacactgagctggtgagtggagaagttcggaagcaagttgattcctgctggaagaactcctaatcaggtctgtctaaatattacaggtaacattgaaatgggaggcttggctaaaagtttgtataaaaactgttatacacgcactttagttagacaacccttcctccccgacctgacgcgacactaacttgggaggtggtggtgtacccaaagggctctgggattggaaaacagacattgcgtgggtgtaagtgggaagtctgcaccctacattgtgaagcacaccagcacgtttccccaacgtgggttctcagaatgctggcagcccccagaaagatttgcagaggaagcagaccataccaaagaaaatacctaggaatactgacatttgaggtttccaaaataagtcatttacatcatagtttagtgactcctactcgttaaggcttgtccttatccagagactaacattaggagagagacagggattacaaaacttgaggaaagcttctaaaataaaaggcagaaatcacacaaatcagtgaaaataagaagaaatacagtatgcagtaattagagaaactctttctataaaagataactgactaatctgctatgacagataagaacatacaaacagatattaaactagaacagggtgttttaaacagagcattggagaaatttttaagagttcttgaacatttagattatggcagtgtagactgtaaagtaggacaagacagatgcaaaagaaggtagaagaagagatccagtttgtgagtcaggaggcaaatcaagtaataaaaattccagaggaaaagaatgttttagatggaaggaaagcacatatttcagtcatgtttcagagcaaaaattctggaattgaaagacacgtttcaagattaaaaggttcatcaattgcccaacataattgttaaaaagagcccttatgaagacattatgaatgtttaacacgactgccaaaggagagcctgaagcctccaggggacgacaacacaactaaaattgagagcatggaactcccaggagaaatactgaatgttagaagacaatggaggagggacatcctcatattcatgagggaaagcttttttcaacctacacattgacacctggccagatctactgtcaaagtgggaggataaaaaaagtcattttcaaacatgcaaggcctttaaaaaatttcctcccacgtactttgtttataaacctgttgaaagacatgctccacaatggggaggttttaaagtagaagacgtggtacacagacaatcaagaatccagagggtcatggggaagaggcagcatctcaggaggagccccgtgcagcgcagcccatctctggggcaagcagcctggatggaagcggcagagcaggggctgcagaagagggagggctgtgaagacggcaccgagaattcctgagggagtcacagtttcaacaggatatttatcagaaggagattctatatacatatatatatatacacacacacatacacatatatatagagattagtcagttttctttcatgtatacatatatatgtatatatacacacacacccatatatatgtatatacaaatacatatatctcctagctactggggaggctgaggtgggaggattgctagagaccaggagctcaatctctttcttgacccagctggtcaagaatgattaccaaccctcaaaacctgtcctgtccccactcagtcaccaaagtgattgtgactctgacttctgacatggtattctatcagtgtcaatcttccatctctgctctttagacctatctgcctctcagagcatgctcacaggagactgaaccacacaacctgcttgtgccccttagagtcctcttgtagcccagcttgccctctgcacttgctcttctgcatatcactgatggcagctagttttgggaccttgttcaccaagtcaggttttgagaggtgaagtcaaattttgttcataactactctaggctcttcattaatggctgggactctggaaataagctcattctgatggaaaggctaataaggaatctgttttctttttaaaaattcttttaatcttcccatttttgtgtcttttctctttactggtatttgaaatgcacatctttgtaaccaggtcacaagaatgattttgcttggattgtttggtggcctcagacatagggttcagaagcatctttcaatgtcattatctttttatcagatcttgaattgcttatttgttgtttgtgtatgtttatgtccatgggcactaatatgggttcttctcactacaaaaatcagggtccccttcctaaaattccggctaaatactaaagggttttaaaccaaaagtaaaattctaagcctccctcaaccatctgaatagggccctcgtctcagcaaaggcattccaaagttaacctgataaactagttcaggccatgataggaaggaagagcttgacatgcctcaggataccctccctcccttttggaattactgatagaacagattctttaagacttaagtctaattaaaaaacatttacaatcttctctctgaagcctgcttgttggaggcctcatctacaagatcaagtcttggtctccacaaacccttaccataaccagacatttctttctactgataaacaactctttcagctaattgccaatcagaaaatctttgaatctgcctctgacttagaaactcctgcttccaattgttgtgtgtttccaggtcaaaccactgtacatcttatacatgttgactgatgtcttatgtctccctaaaatgcgtaacaccaagttgtccggccacctcagacccgtgtttctcaggatcttctgagggtggttccatgggccattggtcactcatttggctcagaataaatcttaaaatacagggtttgacttttcatcgacagggtatacaatttatataattttcaatgaatagtaaaaattaaactgtagtatttaggaatatttatccagtcatgcaagaagaaatccagggaataattactatgaaattcatttggcaaaataactgaccaatattcttcgctgtcaaggcccaactaaagaaatgttagaaacttaactgaaatgagtgagaattgctcagtcaagtttcattaagccaatattagagtatgtctagaaaaataagccacagacacacccatggccatttttccaaagaggtttttagaacactcagtacgtatatattttcttaaggtgggggaaggcatataggaagacgggcgggttggtggtaaggtcaatggttacgtttctgtgagacttcagttagtgcccagtaaatgtacattttacacaggataaggtgaatgtctgaagagatagaaggagccaaggaagagtcaattatgcagaagtccctgggtaggtggaggaatgatttgtctcatccggtctttcttctgctcctggaaagaagcttgtcatcaacattatcagtgtgcaattgagcagacagaagagttcaagaccagcctggccaatatggtgaaaccctgtctctactaaaaatacaaaaaattagccaggcatggtggtgggtgcctgtaatcccagctacttgagaggctgtggcaggagaatcacttgaacccaggaggggaggttacactgagctgagatcatgccattgcactccagcgtgggcagcaagagcaaaactgtttcaaaataatgtcagcattaagagaaattgagtgacggccacattggaagctcattgtgctaattttgcacatttttgcatgtctaatagttcaaatgaaagttagagacatttagaataatgcctgtttttgccctggggcatgtgcggtgatcaaacaagagcgccctggagtgctggttatgttccgtttcttgatggggtgcggggttatttcatgaatggtttcacaactgttttcttgagatgattaataatgagttttgcatggcatttctagtgttatatttcatagtataagaagagattaacgctgatttataatgtgattttcttagaagccctgctgttgcctgcgtcattaagtggtgattcaattcactccctaaaattacaaagtggctggaattaaatatccccaagcaaagacttctttcctctatgttgtagcaaattcagtaacttttcaagttttaccaaataaagtgagggatattaactataatatttaaagctattaaattctatctataattacagaaatatatatggagaaacaaactttttggcaaattatttggcaataaataatcatagattcaaggtttttatacaattcattgtattttttccaattgattctggagggattacagagtaaaaataactgctaaaatgcagaaaatgtttaataacaaaaatgatgtcaccatcagtccaaaggtaccgatattattcatttttttttttttattctcctaatgatacatgcagttttaaagaatagagaacacatggtgttgttttaggataatgtcatattactaactggccacaaggtgtcaggaggaggatgtcatggtgtcccatagtaacaatcacttgggacttcatattcatgtatagatttcttcttcctgtacagatagatcagcaagccaagagaaagtggggagatatataaccatcttagacgcaatcgcaaatgtctcagtgcagtacctgaggtagaagctattcaacgaatcaaggaactcctgatgagagctttgcccagggaacccacagaagacggcttggctagatcactcaggcagagcccccatggcctgaaggagcaacagttgtaggcttagaaaatatctgctctaagaagcctcttcctcattcttcaactatgatagactctgagcaagatagtaaactatggcacagagaggttaggtaacatgctcagggcacacagcccagaaagaaataggctaatattcagactccagggggttcaagctccaagcatatggccttatcacccttaaattgcctttgaaattggcagatggggtggaaataattaaagaacagttaaatattcatggggaaaaaaccttataaaaagctgttcaacatctgaacaatctgttgctgggcatatatgctggtatcacacagtattttagtgaaatctgtgtgcccatctcctcttggtgccaactacaactaggacactcagagcagggacattttcccacgctaaatgggaacccatcaccagagaagccaccaccaaagccaagattacagagagaatgttttaggagtagggtggaatttaacttctaaacgtaaataattaacattttgaaatgaagtgacagtgtcaccttataatgcaaaatcatgccatattatacaagaaactccacaccatgaagaattctgcctatacaacttttaattgcccaaagagacaaatttattgaaataaacagctactgaacatctattacatactgcaaattatatgccttggaaaagcataaatatgacacactttattcacaaaggaataagtttgtagtagtaacagcagttgctgctgttattttgtccttgtttttaacataattctagttaacatattgagtgcctactattttctggccaccatcccgaacacacatcatgaatcgtctgacaaatgtgctgtgctaaattcataaattcaatgcaaaggagggggagtccgaaggttgtcctacaacccagatgtctctactagcttattaacttacctcttctccaagatgattctcttctcctctcaaacttttgacgggaccaccctgatctttactcatagacgctctcattgattctaactgcaccgagaagatacaaaccatcggaagggatcttagttataacacacgctctgcctgacctcctgctattgtcactgagttggccatgctcttacaaaagttcaaactctccacttctaaactggtttctgtgctttcggccactctcaaaggccatctttctgaaactttcctccatttctcatatatcgattttctttttgtactgaattattcctttgaacttcatactcaatatcacatgacagcaccattaacatcaaacacattggtatcacgtttttctagttatactccatttcctttacaaaaaaatctaaaaattcatactcaacttaccttatccacttcctcccccttgattttaccctgaatcatctctaagcatatctccattaaaaatggtcactaaggttacaagtaacctttcatgttgctaaatacagtaaccaaatctcacttatttcaaccatagactgcacttgttgcagttgcttttactttctttaaacactttgtcttagatttcttctaacctcataaaaccctatctttctaatttttcatgtgacgccagctgcctcagatctcagtctcaagctttctcttaagaaaactctcaaaaaacctgtttttaaatgctcttcgtactctgattattaaatgtatgctttatgttcagaactctaatctgaagtacaattgactttacatatagcttcaatatctttctgtatttatgtatttatcttgagacaaggcctctctgccagtcaggctggagcacagtggtgccatcacggctcactgcagcctcaacttctcagcctcccgtgatcctcccacctcagcctcccaagtagctgggactacaggcatgtgccaccacatccaactgatatttgtgtttttggtagatggggttttgctatgttggcaggctggtctcaaactcctgagctcaagcaatccaccctccttggtctccactaaagtgctgggagtacaggtatgagctactgcacccggcctagcttaaatacctaatagatatttccaaattatcttaagtgaattcttgacttctgctaccgacaagttttccaaatatcaatattccatttttttattcacttgggcccaaaccaataagttatccttcactctacacctgttgctaacacacgccaaatccatgagccaaatcctttgtgtccacaccctacacaagccatccttgtttctcatctctgaaacctcaattgtcttcctgtatccatgtttgccctttgttctattttcctacactgtaggcatagtgatgctttaaaaacgtgtctgttatcatgtaacacccgcatggaaaactccagggacttcccaccccactcagtcagtctcaaagtgccttaagtgttgctgttgaatcacagaacttggaaaagggaagtttctggccatggatgttaacgaacctggtatcctgttaatacatcctcaaggaaagtggcagtcatgttctttgatgctaagtgttagagtctattccctgtgagtagctgtgtcatgctgaacctccacccattcatactcagttctgttcaattcaccaccatttattgtggcctagtatttgatagctgctgtctgtactcaagagggtcagagattcaacgataatattagagcttatagttacttggggttaatactaaaataaaaaacacgactaaagtgtgtgcttttatcttctttgccacttgtgtattggcattcttttactctattgctgctaatcacagaatttgactgtaaacatttgatagcttttgcaggtttctttcattgtgttgtttaaacatgaacaaatgttgtgaaggagatctagttcagagtgaaaggttgctgtgaactctaatatttggggtttttcttccctaaataaaaagactagataaattatttaacttcataataaaccatttttgatacttcactgaaagatctctgcataacagtaaaacatctttcccttgctcccgaggagcaagaatccagacagggtgaatcatcttaactgccagtagtaagtgtaggttgatagctgagcagatcatctccagggaaacagggcaaatggaggaagtccttaggaagccttatcctctgggcagtgactctctaagcatcacttgttgctactttctgagcagatgagcaacatgcaaatacctttttaaatgcccctatgacgtccttgtttctgaggctgtagatgagaggattaagcatgggcgtgacaatggtatagaaggctgacactactttgtcctgctcgggggtgtggaaggactggggcagcacgtatgtgtagaaggcagccccatagaagatgctaactacagtcaagtgggaggaacaagtggtgaaggcctttttgcgaccttcagcagagggcatgcggtggatggttaacaagatgagggagtaggaagtggagatgatagagatggggatgagcaacatgaggacacagcagatgtacatcagagtttcatacaaggacgtgtctgcacaggccagtttcagaactgctgggatctcacagaaaaaatggttgatacttcgggagccacagtaagggacattcatggtgatgggagtgagcagaaagccatcgagggagcccccaaaccaggcaccagcagccagcaaaagacacttcttgcggttcatcaggactgggtatctcagagggttacagacagccacgtagcagtcataggccatgaggcccaggaggaagaactcagaaccaatcatggtcaggtagaggaagatctggatgccacaggccacaaaggaaatgatcttctctttagaaaccatgtctgccaggagttttgggacagtggtacagatgaaaagggtgtccatgatggacagctgactgagcagaaagtacatgggggtgtggaggcgagagtccacctgaatcaagaatatcatgaccaaatttgcagtcacggcccccaagaaaacagcaaggatcactgtaaatacaatcccggcagcctcactgttcaccagaagccccaggagggtgaagtcagaggatgatgtgttcgtcattgatatggcccacgagcgtcccagggcaacgggaagacacaaggaccaggaaggaggcaagagaacacggtcaagatgggaaaggtctgcagtagaggtgacacttctgagggtaccgtcaggatgaagcttccaggctagaggctagagaagaacaggcagaccaacatgcacatcatgaagcaaaaaccatggctgcatttccctgtcagagaacagctccttctatattgcgtctatggttcatcatgctgctggaggttatggtaactgcgtgatacaattgctgtatgctacaccaagaatggggttttaaccatatctgttctgtccatgctgcatttcttgtatccagaaagttatccagcccatagtagggttaagtaaatactagttggaaaaaagggtgattcattgaccaaatggataaaggggagtgaagtaaatcactgaagaaatgaagggttaggataactattagggaacgttttattcacgaagccccatgtttctgttctatttctttttaattatttgtataagtttaaggacgacaagtgcagtgtcatgacatggatgtatcgcatagtggagtcttgtcttttagggtaaccgtaagtcaaatagcgtaggttgtgctcacattactaatttctcacccctcgctccgctttcaccccctactcttccaagccttcgatgcctattattccactgtttatgtctaaagttgggactcctcactgttctttgtgctgttttgctaacctttttgcagatctttcttcagataaattagaaggtaaaaaaaactatttgcaaaaagctcccagaattaagtttttaaaaagcagtttatgacactaagctgactccctgcattgctctccattgctactgtaggtttgggaaatgggcagggaaattaaaggaaaatgttggtaggttgaagctatgtcagcagcagacacacaggagcagggttcaccaagctacacgtctgccagcacttaccagaactgaggccagagccaaactcaggcttagaaagctacggagcagatacatggaaatgtgacagcaacaggccaccgtttaagaaggaattttatctttaacataccaggtggaagatagatttaactgttagacaagagaaagaaccatacatgtagtaagaatcgcccccctctccccgccagcacctcctccccggcatggtaggcctcagtggcttgagtctcaaacatttgtgtaaaaatgaaagtccgatcaacgggggagcccggatgctgcagggtttccccccattcacatgttgctagacacaccttggctccactatctagtgttgccagatttagcaaagatacaggattctcagctatgtttgactttcagataatcaaaaaatgttttagtgcaagttcataatgttcttaacaccaaaaaaaagggttcactgtacatctgaaattcaaatttagctggttgtcctttaccatgctgaagtcatatctggtttcacaaaggtaccagaattgttatgaccttgaaaagtgaccagtagaatcagtacaaatagagtctaaacaaaaaagttatttactaacatcaaaattaaattggcttactcccaatttccctctgattgatatattcatattactgtgaaaggggctaaggactgtggcctcctctgtcaggcctcccagaaatactccgtggtcaaaactctacttcagtgagtcttagcctcctgatccactcctgatcgtttcaattctattccatttcccaaggatagtgaacacaaatattgcctaaaaatatattctgctaattcaaagtccaaaaatataaaagaaacattctatattagactccaaaaacttcctaatagaattaacccacactaaggagaagagagcacatctctttgtcatattaaacaaattcaaacattttatccaaaatgtataaaacagtaaaaacaggccaggtgtggtggttcatgcctgtaaccccagcacttagggaggccagggcggaaggatcacttgaagccaggagtttgagatgagcctgggtaacagagctcgtctttataaaaaactagccaggcgtggtggtgcacgtcagtcgtcccagctactcaggaggtcgagttgggagaattgcttgaggctaggagtttgaggttacagagagctatgattgtgccactgcactccagcctgggtgacagagcaagaccctgtttctaaaaaagaaatgaataagtaaaacttatttattaacaattaaaaacctataatatttctcatgtccatagctagtaggtgcctggcttaatccatcatgacacattttaccctggttgttccacgaactttcccacgatctccctgctgtctcatgaatccctccaagtctagtctcagcacaaccatcaaagtcacatcgggacccgtgcatcccgccacgccactttctgcttgaaaccctgcagttgtgctttacatcatacattaaggcccatcacgttctgaacattttgtcttctgaaatgatctcccgccgactccagtctgtctgtccctgggctgcagcgacggtggcttccttgtcctctgtccccactttgcaagagccctgagcccaggccattgcctctgctgctccccttgcctggggctcctcctccaaccgtgcaaggccatccatcccctcatgtacttcagggctttgctcaaaagccacctgctcagaggtcctatgactatttttcttcacttttcttaacaccgtctgacactaccttgtgttttgtgtctcttcaagctagaaagtaagcttcatgtgaataaggatttgtgcctattttgttaactgtactctcaccatctaaagatacgactggcacattgtaaatctttgaataaatcatttttaaacacattcagctagcaaaaatgcaaattattttatgctttttaaggaatacctctagaattccttcaaaacacctcctgattttatataatgtgctgaagagaaataattttttttaatgctaggcacttgtgtttatcttcaatgcaaaatagacaaaaaaatgggatccaccaatatttgatcaaaaaaaacttcattctaggaaaaataaataacaagtttctaagatcagacagcaatacaacttctaaatcattaaggtttatatacagtacaaatttgagacaattacgctctggtttaaaatacttatagagtaattaagatgtcagcataattcacaaaaaaaggagggacttgccacttcttctgtcttctgaatctgtccttgctctgacagctcttcaactcaggtaccaattaataggttgaagataactttagcttcaagtgttattatacacccagagattgtactgcagatgttaatctagttagaattcaccttatgttaaacagataaaattgtgtatgatttattgcaaaatgtcatctgccttctatgatcagaattgtcttcaataatgccatagggcttattaatttgctacttaaattgaacgacactgtaatagacttagtgttaaatataaccacatgtgggcagaatcatcttccacctccagcaaaggtcctcatgtgctaatgtctggaaccgatgaatatgctctcttaagtggcaaaaaagactttgtgggtatgattaagaactctgagatgaggagattcttctgaattatgctgttggactcaattgcaaatgccaaggccttacatgggagagaggaggaaggagagtcagagacgtgatatgaaaacaggtcggagggactcagtcggtctccgggtttgacgatagaggggaccccaagccaaggaatgtagatggtctctagaaactggagagggctaagaaatagattatctcctaaaacctcatagaaaagtaggtagccttcccaacatcgtgatttcagtccagtgagaccggtttccaacttctgacctccaggctgtgatattatgaactttgtggtcatttggtaccacagccatagggagcttctatgctgataaatgattttcttacttagcttttaaacaaaactgagacatgttgcaataatgaattggccagcacttgtgtagtgcttcttgctgggtctcaggcaccgtggacgtgtgccaacgtttccacgtgctcttcacagcacctcgacgggtcgatcactaattatcaccatctcacagctggtaaaactgaggctcagagtcaggtgggaggagctggatccaggctcaaggactcaacttttgtttttcatgctctctgccactacccttaacttctccccaaagataatatccctttgagcatcacttccgtttacaaccagccaaagagaagttaaatgaatgcagggtaaaaggccataaacacacccaaggaaaagttgaatttctgatcacaagttgtcaacaaagcaataaagtgacaacatgaagttaataattttccagaaacacaaaattctccctaactcttgggcaattctcagtcattacacacctgcctgcaggtgtctggctttatactgaggtacataaaaaaaatctcatcaaatgtaccccaagaaaggtcttacaaatgccactcacacacgtcactgttgtgcaattgcagagggcaatgactcatctcccagcagacatcataaagccccattcaataggcatgtttcctgcacagcatcaccgctgtcaacatgaagccctgtacgtactattccctgttggggatctgagatttgaagatctctgtaatgtggcagagttcacttaaggagaaaattccaatgtttctagcataaagaaaatacaaatatatatttaaggtaatggatatctcaattacattgatctttacaaatcatatgaatgtgttatcacatgtaccct

SEQ ID NO: 747 - DNA, 105999 bp, Homo sapiens
aaaacttaaaatgttttgctacaataatcacctgaaaaaaaagtcagtcttctctacagtataatgtggatggacacaaatgagtggttttaagattatgtttccttcccttgtttttaaaaaacatttataataagtaaaattcttcaacaagagcaaaatcatatcagtttctagtatcagtgtttgccaaagactgctctttaaaataaagggatcacctcagtccaatctacttgacatgatcctaccttgtcagacaagctagtcaagatttggaaaaggcaactacatttcaatcctttgaaaatctacataatcctaagcacagacttatcaggattggtaatgggtcaagtttagggacacgttacaattacaatgtaatttttggctgtagttgatcagcaagtttacatccatatattcatccaagttgctcttcctcaaaaaaattaatatgttgacatttctacctgcaagatttgtgattcatgttttaattattacaattttcatataacatgttttagaatacctgatattgtgggtgatctcaatttcttcctgggtgatctttcctggtttaatatttgtatgattccaatgataaatctcagataatataaatagcaaaaaattaaaatactgagaaaataatatacaacttattaggggagaaagaggaagagatgctcccttagtggcacacagaaggtgggatgcctggtctgctttttctatatttttgcatatttggggttcagaaaactgaaacccatagagtcaccatatgctacatacactgaacctaaagtaataagtagttctgaaagagaacagaggagaagagggactccctacagggataaatggtccagacttaaggtatggcttatttatgctttcaacaccccagggactacaatcccagctgaccaattaaacttcgagagtttcagtggagatttaaggtcctgggattacttctggaaaaaaattaaaaagcttaccgtgcaattggcccaatactcaaaccaaaatctaatggacagaaaatatacaatttacaaacttgtgctttttttaaatgttaattaaaaatatgtttattaaacccacagatttttttagttggaaattttaaaattaaatttgattaatgaaaaaataaaatataaggaaaaatgacatttggaagcaaaatgaagaatttcagaagaaagaaaacattcaactaaatgatcttttgaacatattgaattcagtttgctagtgttgagaatctttacatccatgatcataaaataaattggcctgtaattttcttataccgtccttgtctgacattggtgttagggtaatgcatgaaaaaatgtgttggaaagtgcaccctttttaattgtttggaaaagtttgagaatagcattaatctgtctttagatatttggtagcaatcaccagtaaaagcatcaagtcctgaacttttaagtttattattattattattggtgatttaatctctgtactagttattaatttgttcaggtttattctttcttcaggacatacatgtctaagaatttatccatttcttctacgttactcaatttattgacataattggtcatgataatctcttatgaccctttgtattttggtagtattgactaatttctcctgctttacttatagttttatttgagtcatctctcttagttttcttggtttgtctacctaaaggtttgccaattttcctcacgtttttacagaaccaactcctcgtgttactgatcttttcttttgtctttcttatctgtttaattctgctctaacctttataactttcttctttcttctaacttttggcttttttcttcttttctaattcccagagtgccaagttaggttgcttatttgggatcatttctctctctgtctcagtagctatcagaactacttttgctgtaccccatgatttggtatgttatttgtccatttttgtttgtctcaggatatttttaaattgtctttatttttgggtccatttgttgtttatgagtgttgagagtggggtattataatcccctactattatcatattgctgtttatttcttttttgtgttctgctcatgtctgctccatccattttggtgttccaatgtttcctgggcctatattgaggcaccctaactaataacactttgcacatcaattcatctcatttctcacaaaagcaaacagaacaaaactgttcaaacatacataagggagtcctagttgctgatacaaacttttagatagtcttccaatctttttatcctactttaattctccaatgatataataaacatccaagacaaaaaaaatgaaaaaagcacaaatgattccttcactgaaatcaggagacaaaggcaatccatcaactataaattacacgtaaggaaggggaagaaagtcacggacactcatcagaattggtacagaaactccatattggaagcaggaagtccggcagagaagagacccagtcaaggtcactggtggtggtaatgataaaaaataccaggaaatattattccccaagaaggagagggtcctctcacaagtgtaaactgctatacccaagcctgatgaacacggagccaggtagcaatctgaggattattgaagagatagatgcagggagtatacctgggaaagaagtggtggagataacaggacaatcttgcctaaactaagggggtcaccatcccaggcataaccacgaataggaaggtggtagaaatgaacatggagaagacagcaggaatgcatacaatgaagctgtagggcttgagaaacaagaatattccccaatgcctgcaagccctatgcaatccacctggtaacaactggaaaggcaaatcaaattctgaaaaatgaaattagaaaatgcaacgtctttccaaaaatactatagaaaaaaaataaatctaccccaaaattattgccttaaatcggagctaaatactgatataaacttcaaatactctacaaccccaaatccttaataaagcagttttataaatgagaaaacattttaaaacagaaatatgacggttcagagaactgatgacccactaaaaagagacgacaatcggccaacagaaagatgtgaaatgggaatcaccctgagtcaggagagaatttaaagggagtgatggggacgaagctgaatggctgctccgtggcttgtgagtgattgtaaaataataaagatgatggagaaaatataaaagcaagtgtaaagaaatagtgataagcactagtgtaaacatattggctacaattgaatgatgaaggaaaggagaatagacatatcttctgaaatattttctgttcttccttatgctaggaaactagtagatactgtgtaaagagagggaaattaaggatattttagtcttataaaatatgttttatgcataggtatttgtacataatatacacattttgttaaatagaaaatattaaataccacacaatgaaataattttgaaataaaggcaaagagttgattttgtcttcttactgcaaagaattataagtatgtgaggtgatgcatatgttaattacctcaatttacccattccacacaatatacatattttaaaatatcacattgtacatgataaatatatacaattttatttgttcatcacaaaaatttaaaaatggcaattaaaataaaggtaataacaaagtgtgagggaatatgattaaactaatggggtatatcaataaacacaatgcatttaatacactgaataaagaaaaaaagattactattctctctgcctggtggtctcttttccgatacgttgtgacccatttcttcaactgatttaggtctctcttctctgctctcttgattatcagagaagacatctctgagcagtgaatataaaacagtaattatctcctacacaccctattttactcttctttataatgtttatcattcctgatagtttttttgcgattattatctcttctctaccatagaatgtaagatccaggagataaagcattttaccatttttatcactagtgtctttccaatgcctaaaatatagcacctattccaaaacagacgctcaaaaataagtgtttcttgagtcaatgcatttattcatttttgaggaggagagattgggttaaacaagagggttaaaaactcagaatagaatgacaaccaaacgagagcatagtcagtattaatacagaaaatatttacaagacctacttgaaagaagatatagttgtaacacattttccatgattgttcagaaatttatatttctgggtacattaacttcttaggcaactagagcttacttgtttaattctttaagcttaataaattttaaagtatggagtacaatatgccaagtgaaacaagtcaggcacagaaagaaaaatgcagcatgagctcatttatgtgtaaaataaatggaaattgagtaagataaatagggagttgaagggcagttgccagagtcagggaagtagacaaattgggataatgtaggtaaaagaagacaaaattacagttatgtaacataaagatatttagagatctaatgtacaacagaaggactatagttctattttattatacattacaaatttgctaagagaataactagattatatgtgtttttatcacaaaaaagtaaactgcagacagtgatggatgtgttaatttgctagcatgtggtaattatttcactatagatatctacatcaaaacatgttgtacatcttgagtttatacaataaaaaaaaatactcgatttaatgaccaatctggacttatttattttaatgtttatttaaaatatttcatgctgtctgtggcctggtatttgggagaaagggggataaaatacttcaatcaatcatgtcaacacaatttttgatgagaaattgaaaactgaattgttcaaattgttccagttctcaagaggaatgcttccagattttacttgtttagtatgatggtggctgtgggtgtgtcatagatggctcttatttttttgagataagttcatttggtgcccagtatattgagggtttttaacaagaaaggatgctgaatgttatgaaaaatcattttgcttctattgagatgatcatgtggtttttgtatttaattatgtttatgtggtgaatcacatttactgatttgcacttgttgaaccaaccttgcatcccagaaataaagcctacttgatcgtggtgaattcactttttgatgtgctgctggatttggtttgctggtatttcgtggaggattgtgtgtctatattcctcaggaatgttggcccgaactttacttttttttgtcgtatttgtgcctaattttggtatcagaatgatgctggcttcacagaatgacttagagagtattcccttctcaatttttaaaataatttcagaagattttgtaccaactcttatttatatgtctggtaggagttggttgttaatccatctggtccagggcttgttttggttggtaggttttttttaatcactgacttaatttcagaacccattattggtctgttcaggatttcaatttcttcctggcttaatgtcaggaggttaaataatcttgggtggagaaatagataaattccttgtttcgagggatttatatatttcttctaggttttctagtttgtctgcagagaggtgttcataatagtcccttagggttttttgtacttctatgtagttggttgtatttcaactttgtcattcctgaatttattaagcatatgaaaataataaactataaaggaataaagaaaatagatttagaagaaaagaaagtgttcaaggaaattaaaaagcatattgaatcataattttatactttaaattgttttatctgtgaatataacattttatcatatactatacatgaagataaacagatacttcgtgcagttggtaaccgaaagatagccagagtggctatgttaatgtgagacaaagtgagtttatgacaaaaatttttataagtaaaaaaaaaatcgtatactgtttgggatcatttgtgtatcttccttggagaatgtaatatagatctttagatataaaaattgtaaacatgaatgaatgtaacagagacccaaaatatatgaagccaaggtggacagaattaaaggaagaaataaacagttctgtacttatagttcaatacttaaatgtccattttcaataatgcatagtgcacttagacagaatgttaatatagtagtaagtgactagaacagcactataaaccaaatgacctaatatatatgtggagaatactgaaatagcagagtatagatgcttctcaagtactaataacacattctccaggataaattgccaaaaacaaataagactaaattttaaaagatttaattcaaagtatcttttccaatcaatgaaataaaactggaaatctgaaatagagggagaactacaaaagttacacatatgtggggattaaacaccacactgtgaagcaccggtgggtcaaaaaagaaattggaaatgaagttagaaaatatattcagatgacttaaaacataacaaaacatataggatgcagctaaagcaactcttagaaggaaaattttagctagattgcctatactcaaaaaaagaagaaacatctaaaaacaataatatatttttacaccttaaggaactagaaaaagaagagcagactcaatacaaagcaaacagaaggaaaaaaaagtattggaatagagattaataaaatgcagaatagaaaaaacaatttgactatttcgagctttcaaaagatcaacaaaatatagaaaactttaggtaaacttaccaaagagagaaagagagaagtcttacatcatgaatacataaatatgaatataacatgggtacataacaactagcctttcagaaacacaagcaattataagagaatattacaaataattgaatactaactagataccttcagtgagatgaaaaccaaatcctggaaacacagaaactaccaacacttactcaagaagaaacttaaagtagtgttaaacaactaacacactgaaaattacaaagtactgctaatagcaaataaaacataaaccgatgaaacaacatcgcatgttaatggattgggagacttgtggttaagataatacaaccaaaatatatccacaggttcaatacaatgcctataaaaattccatggctttttttttttgcaagagtagaaaacactaaaaatcatatgaaattacgagcgactgcaaaatccaaaacaaccttgaatagaaaaacaaagttggaagatttacacttcctgagtacaaaatttgccaaaaagatacactaattttaaaagcctgataacagaataaggatatatgcataaataaatagaagacaattgagaatctaatgagaaatacacgcatgtgtctatggtcaataatcatctgacaagcatgccacgtccattcaatgggaaaagaatactcactttaacaaattgtgctcagacaagaagatatccacaaacaaaagaatgaagtggcattacaaatcatacttaaactcaaattgatcagggacctaaacataagaagtaaaattataaaaatatgagaaaagataaggttaaatattcaagaccttaagtttagcattttttttagcatgataccgaaagaacgagcaataagaaaataaataattggacctcatctaacttcaaaatttttgtgcttcaaaggtctcaatcaaaaaagtgaaaagagaggagagtgggaaagctggcagaacggaattctttaacaattgtatccccatagaaacatcaattttaataactattcttacacaacataccttcacaaaagctagtaaaggcatgtgagagatcatagaacctggtgatacaattttcatcttgttataaaataataagattagaagcattgaagagggcaggaaggagagttttgattacctgcattttttatccccaacctcagacagcacagtgcagggagaaataccaaacacttggagaataaaaacggaagtaagtgtgggacttggtcttggtgcccaacactaggcccaccacagaagaactgaaaaccaggcagcccccacaaccactgactccaggccagtacacaaagaccgagcctccagatctacaccaacactaggcagaaacctgcagcccatgcaaagcagaattaatttgcagtcatcatcactgccacccacccagagtggccttaagctctggaaagtatccactggcaggcaggcctcagtgaacatgggcttcagacttgcatcagtgctgcaccagccccagtggccacaggatatcatctgggacccacaccagttccagtggccatgggattacagcactgcactgcaccagtcgtggcagtcccaggcttagggcaccacctagggctgcccccaccacagcaaactagagcttagggaccacaccagacaacctgctcagaatctctagacaggcttactattgaagaatgtttcaggataaaacaagtctgcaaagactggaataagtacctattatattagatgcatgactgcagacgcaagagaaatcaaggaagcatacatcaccaagcaaacaaatggagatgcataaactacctgacaaagcatttgaaataacagtcttagggaagctcagcaaacttcaagaaaatacacagaaactattcaaacaaacgataaaaataatatgaccacaatgataaacttagcaaatattggaataacttaaaaatcaaacaaattctaaagctgcaaaatataatgaacaaaatgtaaactgcagttgagaccatcaacagcagaatggatcaagccaatgaatctgtgaactcaaatacaggttatatgaaaatagagaagagaaaagaatgaaaaataataaaggaaacatgagatttactggacagcaacaaaacagcaaatttttgagtcattggagataagggagttgaaatgataaaggagtagaaagcttatatgaagaaataatagaaaacttttcaaacctggaaaaagatataaataaccaggtacagtgaggtaaaaagtaaccaatcagattcaatccaaacaaaactacccctaagacatattataatcaaaccaccaaaaattgaagggaagcttctctgtattggtggaaggtaggtagggcttttctagcccctacttccactctatcccctgagttccacctgcactgactcaaggaagagtaagcatctagagctagtgagaatgggaggaacttacaaagtcaagagagaagcctattgttccttgctcacccacagattacgtactattactcaaggcttgctgtatttattatagaagagaaaatcttcttgtattatatatcagctgagttattgcttatctgagaatcaccagaagtttccacccgagacaggataagagaatagaaccaacatgttgggatttccagagcaatcaagagaaaagaaaatctattgtgttattattgcccctgagaaatcacacttttgtctttcctaggaagctgatgcttacaacaatggagattagcaatacctggacagagttgagcttcaaaggatactgagaaatagctaaagcaggtaaaaagagagaagactggaactttgtctatgcttatcatctagcttcaaggagaaacacagttgagttcagccattttgaaacaatggttagaaactagataaaaagttcttaagcttttcattatttatttatttatttatttatttttgagacagagtcttgctctgtgtcccaggctgcagtgcagtggtgagatctctgctcactgcaacctccgcctcccgggctcaagtgattctcccacatcagcctcccaagtagctggggttgcaggtacctaccaccgtgcctggctaagttttctatttttagtagagaaagggcttcatgatgttggccaggctggtttcaaactcctgaccttaaatgatctgccagcctagacctctcaaagtgctgggattacaggcatgagcccccgcacccagcccttaagctttttatgagcaaattaatatttcaaattaaattgaaccaaatggttttctcatacgatggagcaacattcctcatgctggaaaatgagatgctcctgaagtctttgcatcttggtcctctaccgttgttttccacattgatatttatgtgttctgtttagagacttgatgtgttcccagaactttctgaagagccccaccacatccttgtttctcaggatgtagatgagggggtttagcatgggggtgagtacagtgcaaaatacagacacagcttgtttctgctcagggatgtgggagaaaccctgtgtcacgtatattaaacacacagttcctaagtaaagaccacggaaagatgggaggagcagttggccaaagctttgttcctactttagggggatttcatatggaggactgtaaggaagatgaggtatgagaggccacaagtccaagatgaaatggataagaagtagagagccacaggccaagatcaaatgggtaaaaagtagagagcctgcatttgaaccaggtagtctgactcagggtccacacatcatctcaatcatggatgactaccacagacagcttgttcctttctcatccccatattctggcttctctcttgccatgtacacctccccttagtctccatacctggggccacctgcccccacaatcctgttcccataatatctcaccttgaatgaagagctaagccaggaaggaagcatctgaaatagtgttgaagaaaagctgaagtgagtggagaaggacatcactttgtgtcctttactttctgttggccaatgcctgtctcccggtctagaccctaccacctacaggtgaggcctcaagcacagctcatctctggactgtctccatgtagaaccaatgtccctgctcagattagatatatgaaatcccctagttgtagatgtgggggcctatggaaatgaacctctcataaactgctgaagggtacaaattaacacagcttgagagaagtggcctggagtgagcttcacttcacactaggccaggaccacattattactcccaacaaaatagtttgtttataatccttttcgtggactccagaagaggaagatggcagataggaggcaggactaacgtgcagctcccacttggatggacagagcagcatgtggagattcacgctgtgaacttttgctccaagaactaccataggacataccaggaaagccaagagaatccaaagaccctttgaaggaggtggcggccactgtaggctccgtgccaaaaactgagtgccaaaatgtgtgaaagtgtaaaagggggatgctccacccccaaacacagatcctcactggggaacctgacggtccacatggtgggaaaaggatttaatcttacgcggagctaagaggaatttagagagccaagcaaaatattcgagtagaggaaacaacaagaagagccctgtgggaaaccatttcggactttgtcttgcaggggtcctttgggagggctgccagtggaattggggaaagactacaaggagaagcaagctttcagatgaattttgtaataatcttgactaacgtgaagcttcctggacagaacctgggggagggggcaaactgggagtgcagatacaagctcagaagctgaggcaggcagagaggcatgaaacctaaaagccctgcttgctttcttcatgaggggcttgtagcctggggcaagttctcagccctgctcaccagctgcctggaaaaaactcagtgctactgggggcacaaggtgggagtgagactggccttttgggctgcctgggagctgagtgaagcatgtaactgcccgttcccccccttctctggtgacctgcatgacccagcagaggcactcataatccccgtggaaacataactccatcagtctgaggaccacaccccaatcccacacagcagccacacagcaagccccgcccaaggagagtctcagctcagacacgcctaacactgcccccacctcttggcctttctctacccaccctgggagccaaagacaaaggacataatctcatgggagctctgaggcccggcccattgcctgagaaatctggatacttatccaggtaaccctaaggcaagctcgtatcttccctacactactgcagctgatgcaactcttgaaagaatcaactgctggctggagaccaaccagcaaacttatcaaaaatacagccaaggaccctcacagagtccacttcactcccctgctccctccaccacagcatgtgctggtatccatggctgagagacctgaagacagatcataccacaagactctttgcagacactctccggtaccagccagtaccagagcacagtagcttcgctgggtggttagatgtggaagagaaataacaatctctgcactttgtttctcaggaacccccatccctagaagaaggggtagagcaccacatcaagggagcaccccatgggacaaaagaatctcaacagcagccctttagccccagaacttccctctcacatagtctacccaaatgagaaaaatccaggaaaaccattctgaaaatatgacaaaacaagattttctgacacccccaaaagatcacactagctcaccagcaatggattcaaacaaaggagaaatttctgaattgccagaaaaagaattaagaaggtcaattattaagctactcaacaaagtaccagagaaaggtgaataccaacttaaatttaaaaatgtgttacaggacatgaatggaaaaatctccggagaaacagatagcataaataaaaaacaatcacaactgctggaaatcaagaacacactagaaaaatgcaaaatacactggaaaatctcagaaatagaatcaaacaagtagaagaaacaagttcagagcttgaagacaaggctattgaactaaccgaatccagcaaagacaattaaaaaacacacctttaactgtgttttcttatacttcgggctttttgtaggttaatgacttttcttaattcctaagtaccatctgagtaattagtcacatggttataaagaatatcaaatgtcagactaaattcttttcaagcttccctcagcagcttaaagttgaaaccttttcattccttcttctataatcttgggtatttgaaatgggtattctcccacttgaacataggcaaaatctaatttcttgtctctaccctatggaatctcatttagtaattatttctaaacttatcctgatgccatgcatcattggtttgttataaatatatctaaaggagtacacaacatttactaaagaaacacattccccgtgtgatgtgtcctgataagaaaaatgacctccaaatttacattcctgtacaggtatgatgatttcactctaccatactttattttatacccatctattgtttcttccacaaatatacataactggagtcatagccaaaacttgtattgcctgggcctatttgagcataaacagcaggtattagccctaaatagggggtcttctgccaacttgggtgtgttaggaaacatggacaatattcaaaatggcctgcaggactccagtttcaaagtgaaagataccatgcccatccaagacattgcagtttgcctttccctgatgattagtgatgttgagcactttgtcatatacgtgctagccatttgtatgtcttcttttgaaatatgtttttcgatgtcttttgcccatttttaaaatcaaattatttgtgagataattttggtactcagttacttgagttctttatatattctggatatgaaccccttgtcaaatgcattgttggcaaatcttttctcccactcgtatgttatctattcactctgtgaattgttttcgttattgtgcagaacctttcagtatgatgtaatctcattttttaattttttattttttccctgtgattttgaggttctactttaaaaattcttgcccagatcaatgtagtgatgatgcattctgcctgtgttttctaccagaagttttacagtttaagatctgatattaaagtctttaatccaatttgagtttaaaatagtgaaataagtgtctagtttcattctgtatttggatatgcattttttgcatcaccatttattgaggaagtagtgcttttcttggtgtatgttcttttcaacttggtcaaacatcagttgactataaatgagtgaatttatatctgggctctcaggggttctcttctgtttgtgtgtctgcttttatgccagtaccattctcttttgatgtttaatagcttgtagtatatcgggtagtatgatgcctacatattcattcattttgctcagaattgcattggctatttggagtcttttttgcttccatatgaactttaggattgtttttttctatctctgaagaatatcttttgtattcggatagtgattgctttaattctgtagctctcttttggtagatggacattttaatgatatcaattcttctaatccacgaacatggggaatctttccatttatttgtgatctcttcaatttctttcattagagttgtatagtttttcttgaagagatcttttactttggctaaatttattcctagttattttgtatttactttagtttttgtaaatgggattgccttatttctctttcagattgctcactgttggcctatataaatgctaattttgtatgttgattttgtatcttgcaaatttactgaattcatttatcagttctcacagtttttgctggtgtcgttaggatttttttaatatatgaccatgtcatctgtaaacagggaaaatttcagttccttctttccaatttggaggcctttgtttccttcttttacctaattgctctaagaccagacacagcttctcttttttctctcctgaattcatgggaattcaggatgttattgtttttgaatagtttccagttctatttttgtgggtgtggatgaatgatgctggaggatcttctattcatctatcttgttgctataactcctctctatgagtctttcttaactttttaaagatacagtttgctgttagagtatagaaactccaatttctgtctgttgatttcctgaaactttcctgaatttgttagggaatagtttttgttgaaggctttatgtttttttatatgtaatattactttattaacaaacagaaacatgtcacttcttcctttcctatttacatttctatttatttttcttccctaattgctttagctgggactttcagtgctatgttacataaaagtggcaagagtgaccgttctggtcttttgctggatcttagagaaaaagctttcaacatttcatcattaagtattatgtcagctgtaggcttatcatatatggcctttgttatggtgagatacattccttgtatacctaatttgttgagagttttggaattttgtcaaatgcttctctccacctaaataatcataaaattgtatcattcattctgttaatgtgctatgtgatgtttattaattggcatctgttgaagcatccttgcatccctgggatgaatcccattttatcatgatgaatgctttttgaaatgtgcttttaaattcagtttgctagcattttttgaggaattttacatccatgttcccaaatgatattgacctgtagttcctttttcattcccatgtccttctctggctttggtattaggataattctggccttgtataatgaatttggaagtattcccacttcttcaattttttggaagtgtttgagaataattggtattagttctttaaatttttgatagaattttgcaatgagtccatattgtcctgggcttttttttttttctggtgggagacttttattactacttcactgcattattcattattggtttgctaagatttactatcgtaggatttatgtatcagtcaattcatgtcttccagcttatctaatttttgacatgcaattattcattatactttcataatcttttgtatttctgtggcctcagttgtaatatttcctttgtaaatttctgatttgaaccttcttagtctagtttattttgttttttcacaaaacaactcatctgatgttttgcattgtttttatcatttttttatttctcctctaatcaatattaatgtatctactaattttgagtttagcttattcttgtttttctagttaattaaggtacaatattacctttccttatttgaagtctttcttctttattgatgtagccattcattgctataaactataaacttcctctttgaactgcttttgctgtgtcctgtaggttttggtatgttgagttttccatttttatttgtctcaaacaaccttttattttcccttttaattttttcattgacccatctattgtttaggagcatattatttaatcaccatttatttgtaaactttctgagaattcttgcattcgtttataaactgctgtgatcagaaaagatgattgatattattttgaacttcttatctttaagacttttttgtggtcaaacatgtgatctaacctagaaaatgtttcatgtgcaatcgagtataatgtgtattctgcagctactgaataaaatgttttgcatatgctttttaggtccattgccctagagtgcaacttgaagctgttatttcattgtttacctcctgtctggatagtctttccatggctgaaagaggggtgttgaagtttcttagtattattttattgctatctatccccttagatctattaatactttattgtatttaggttaatgtttcatacatagtcacaattattatatactttttgttgaattgactttttaatcattatatatgatcttctttgtctctttctacagttctggacttcagtctattttatctgatataagcatagctactcctgctcttttctggttacgacttgcatgggatatccttttcaaccacttcacttcgtctgcatatgtccttgcaggttaaagtaacctgttgtagttggcattttttatacattctgccaccagatatcttttgattggataatttaatacatttacatttaagataatttttgatacatagggacttaatgctacaattttgttagttttccagttgttttctagagactttgttcttttcttccattcttactatcttcttttaaggttaaatgatgttttttctagtggtatgcattgattccttgttttttaaaaatttttgtatgtctactacaggtttttgctttgtagttaccacgagacttaccaacatattataacaggttattttaggcagctaacaatttttagcacaataaagctctacaaaaatcatttttcatgaaattttgctacatttcctttcacaaggatgttttaaagataaccatcaaatgtgtctataattataatccagcaaattgagagttgacaaatgctctttaattcatacaaagttagagtatgcattttatattgtctgagttcaggaaaaatattaaaaactagttctctcatatttttccaaagcactacagaatctttatattatagtcataaaataattgagtgtggtgagagaaaagaagaatgtgtactgttgaaaacacctgattattcgcaagttgtacatagccaattaggaagttatagcatgcagctaccacatgtatgcttttaggtaacaggttcagcaggccccacctcaaatgccctcctatcagcctattctcgggtaaaggcatggtcgactccacttagatcaacatcatttagatcaccattctcatgtacctggtctctatgtttttggtcttgcacatctccaattgatcaccacacaaataacatttctaaaatacaaatctgatcatttcactattgtttgtaaaaccctgggccacacaagggcaagaaataagcctaacatgaaataagaaagatctactgggcattgatctctctcgcttgctcagccctgtctttgctcatgctgtgccttttcccttgcagcgtgtctcagcaagttcccctggctccaacatcacacactcatctgagggtaacttttcgtcactattcagcactgagccccggagtctcctctcagctccttgtttgaactcagatgtcacagatagaattagtgtgtccttatgagctgcacccttcacacgagtatcaaaacagcttatttattttcttacatttgtttgcataaacaactacatgtatttttcaaactccttggtaaaagccatgtgctattcaaaatttaatcttatttaactatttttaattataaaatagtacaaaatgcttgttaaataaatgaaggattgaatgttgatgccatccctctgcttgtttgtataacaagttacatgtttgaaatctcagctcaggaatcaccctgggcaggtaaccttccttaaaactccttccactcaggtgtcatattttttctgcagtcacttatgtggtcctacatcctcaatacaccacatggcagtaattatttcggagagataaatccactagacgccatcagaattggaccatgcagaaaaatgtagccctcaataaagaaggggcgatgactggattttctcggtaatgattagatataatgaaatgagcatgatttctaagatgtcacactgccaccaagcagaaaggagaatattttcaaaaagggagaaaagcctggtatttaattatttgtaaatgatttcaacttcacaaaaatcattaaaaaacaatagtacaattaatacctatataccctttacccatactcatgtgtggcagcaacattgaactcagtttgtttcattgcccctctctatctccctccctctttccctctcatcatttgaacacctcatgacctttttgtctctaaatattaagtatttcctgaggttaagaatattttttcacaaaattagagaacagttatcaacttccaaaaatgttacattagtataacacaattgtaaaagaattttggatggacaaagactataaaatagagtttccacacagtgaaagaattcctcaaaatgagatgaatatgagatgaggcatcattgtatgagagtctaaggaataacagggataaaatcctaagtatctgatgggtagagaaaaggaaaataaatctttatatccaaatttcctactttataatttcctaaaggacgaatctcacagttaacattttcttcagagcccccatgacatccttattcctaagactatagattaaagggttcagcaccggagtgaggatggtatagaagacagataccatcatgtccttctcaggggtgtggtaggagctggggagcatgtaggtgtagacggcagccccatagaagaggatgaccacagtcaggtgggaggagcaggtggcaaaggcctttttccggccctctgctgagttcatcctgtggacggtgaggaggatgagtaaataggagcttgaaatgatcgtcacagggatgaggagcatgaggacacagcataggtacatgagggtctcatagagtgaggtgtctgagcaggacaggatcgttacagcagggacttcacagaagaaatgatgaatctcccaggatctgcagaaggggaagctcatggtgatgggagtgagcatgaagccatccactgagcccaggaaccagcagcccgatgccaggaaaagacagaccctatggttcatgaggacagggtaacggagaggatggcagatggccacgtagcggtcataggccatggtggctagaaggaaaaattccgaacctgctagtgtcagatagaggaacatctgcatcccacactcaggggctgagaccttattcacacccatgacctggtccaggagcatcttgggcacagtgacagaaatgtacgccatgtccatgagagacaattgactgatgaaaaagtacatggggctgtggaggtgggcgtcacagtgtatcagaaggatcaggacagcatttccagacaacgccttcaggaaaaccacaaagatgaccacactaagtagagctggatgtttggattgtctgaagagtcccatgaggatgaaatccaaccttccagtgtggttggccatcctggtgatgttggccatgaggtttcacctaggccaccaaggagagttttggagtcagtgtaacgcgtccctttgtaatgagtgtttagtgagtactcacatttgtgtatgctcattgtgctaacctgagtcccgtgggtctggggatttgagtatataaatgacatataacaaattcacaaaacaaactaagaattcacaactataggccagaagaattggtaactgatagtaaggttgtcacggttcaaattcataaactttcctgatgataatgccatttatcaacaagtactgaaaatttgcagaacctccctcctctgctaacacaaacagtgactcattgaaagaaagataaagcaaactccttattgtagagtttttgtcatagacagctgaattgaatcaacatcgctggtttaagaaacaataggcatcttcaaaatactcagaggtatatatgatataagaaagatttagcaagtaactaaagcgtaacttggaaaaaaaattatgccagatgtttgaacctcctcctcccataggatcaggccatgctgtgaggctctgtgattgcgtggagcgagcctcacattctcatgagcagggaagggtcctcacacacagctgaccctttagacatcgagagacgtgaagtgaggagcccacacacagtagactccagctatgggtccacctttttctctgtctgccattcctttctccaatctacatcaaaaaggataaaaatcatgtttgagctcaggtgtggtgagggtaaaatgaggaaatgtaatgaaagtgcttagaatagtacagtttccgatgaataaacacatatactcttagtgtagatgttaactctttaagctaactattctgcacaacctacctaagagattgttgctactattattatataagatatattacttccattctccagattcagtacctattcatacatttaagaagctgactttcaaaataaaaatggcagaagttctgcaaaataaagcatatgacccactttaaaaaaaaacaatttggattttatatttgtgtgtttatgtgtaaatactctggttttatataaatatatataatatatttatgtaaacatacacaggtgaatatataactataacatttcttattttaaccctggttatgcagagctttttggagactcctatgtccttcctgcctagtatgtggtcctccaacctcatctccttaaagctcctctcattttaaagctcattaaatctcagcgaggaagaactagaatttggagggtcactgctgtttatcagacaaggctttagttgtttttgcaaacctcatgtgctttattacttgccacaatcaatctttcatacaaactgagaagcagggaggaaaatcaaacaacactgaggcatctgacttcaactcactgtttctccctctaccgtgacactcacagcctgtgttatactgacgatgaatcgcctctgacttcaactcactgtttccttctctatcatgatactcacagcctctgtgttatatgcagaagatgaatcaaagaaaaattgaacttgagtgcacttaaggaggtcacagtcagtctattcagggaacaactattatgtaaatgtgatttgaagttgaatttttaaatagttacaaaataaataagggcaatagacacaaaatatatctggccgttctgaaataatccataatagctgtttccacattttctctgaaagaaattaaaactttccaacttttcaacttctgacatattaaatgttaaattttgagagcccttgccaagaataaggacataataactcctctttctgggaagactttagctgtgattatgatgcagggacattttggaatgaatttacaagtttcaaatatattttgtattcttgtagtaattacaaaaagtatttaagacattcaactcaccaaaacttccaacattctgggatgcttcggtgctttaatataaatatccaacaaatctgagacacattttatgtacatatgtatatatatgaatagatgatgatgatagatagatagatagataatgtgtatcaaacactacccctactggcaaatggtggctgagatctgtgtacaatttaaaaacattccaataaactgcaaaacacacctgctgacctcgtccattatttgtggccaaagtgaagcaaggaccagaggagcgaccagcacatgtgaagacctaaaaggtgtttgctcagtaaattgagggggagcaggagggcagggagatgcggggtttcctaagaaatctctgctgctctttaggaaatggccatcactatcattaagccactatcattaagccactatcaacagctcaaccaggacacgggacagataagggaacactatccacacacagtgaactggccccctgttcattcttcttctgtacccgcttgtttgactttcatgtaaattgcttaatgcatgtttaacttggggatttattataagtataaatggagtcaaacctttatttgaagcatacagcatcccaggaattgttctaatactaatactaaaattaatactttacatttcttctttcccaagagcctatgagttacttcctattattttctctctttacatattaaaaaatgcaggttctcagggtacctgcctaatatcacacacctaacctgagatagaacgcacgtctcagcccgagagtgagagccagcgcacgtaactctgcctgattcctctcagggacaccatcctccctctgcagtctacactttggatttaggccactgtctgtgggtttcatcaaggaaacataaaatgattgagacattgtttctagtgttttgtaaccctcagaaataatcccctctcaaaagaaaatcagtcacttttcctctataaaacttcagtgacaggaaaataaatacatcattgtatgaaaatctaaaactatagaatatatattattatgtccataaataattggaaattaaaaatccatttaccattatgtcacagtaaataagtgttgtatagaagttataagaaagaataacatttgcttttctccattaaaaacagatgataaagaaaaaatgaggaaatgctgtgaagaactaatagaacgtttcagaagcagaacaagtcgagagcagtgatgacccttttgttcctgctagtacctcctgtctgtctggccgaactcaccatcagatgatgtcttgaacctcacctagatgggctggtggtgtgtggccaggttaagagcaccaacaggagtaagaaagtgacctgcctggttttaccgtgtgtactaggggaggggttgaaagctttcggttgatacatcacctctgggagttgaagaagaatgcaattaagagagctaaagaagtcagtaggtatctctcctgaacaattctggttttcttctaatagcttttacaatttttacctctgttatgaaatgcaaacttttaaccaatattagtaatagtaatctcaaatctcatcatcatcaaaatcttatttatgaaatataggagttagttcatatacagccttagccttttccacattataaaatatattccatatatatgtgtgatcttcatttaatattcaagtaaatgttgtaagatattgttatttttattctaacatttcacaggtatagaatctgaaactcagaggtcaactgatgtgtcaaagatacctccacaaatcagtaccttgattaaaactaaaattggagtcatcttcatatctccatctttctccctcttcattaggaccgattgtagtctgtttccctctcactcacttgcaatctttattgctttagtgttgcatttgatttttatctttgtttttgttttaaatactgtcattaaagtcatagaaaaatctaaaataaaactggttgaataaaaattttaaaatcgactctaatgtaataaaccagacaaaaatgatactttaaatgttatatcttccctttaaactacaaatattcattgagtgtataccctgtattaggctgttggaataaaacagggaagaagacagaagaaactgcaccgccatcttagatcttgcagccaaattcctctgaacttttctctaaagacgtgctctggaaaaatgttgatcattttcctacatcatggaggtcttttcatgaccacctttgtctagacaatgtcctgtttttaggtgcacgtttgagggctggagtctctgacccacagtgctgcagcctgcacgtggtttgtcctgacttctttgctacttcacttttcgtaaggctctgagagtgcaggcccttgtgggtggacactgcagggtgagaggaagaagtaaactacttttttccgtttctgatgggggtgtgggtcagcagctataagcaacagggaccatggggggcctcagacttcagcacctgagaggcagtttcagtcgtattggggagatgcaggcatctgggttgctgcacatcaccagggcagggttctctcagcagccctggagtgcagagttcccatcagctcagcagtgaggggcacatggggctccagtggtgaggactcttggtccttggatgacaacactcccctgcccacttctccagccttccctgtaaccctttgccacctctaaccaatcttctgtgttacatctcttcggtttgcaatatgtagtgttcgtatatgactggacagtatctactggagttaatatctatcagagtaattatatcacaattgcaatcttctcctaagagtgaatagtgacattaaaaatttcaacattataaattatgcagaaataaaactaattatacaaaaaatacactctgaatgtcagtttttccctgagacaatctaccatttgatatacggtgattcacacttcttaatatacaacattgaattacttttccaaaagcctcttcaaattttgctgcagaattaaacttcacttgcaccagctctgaattatgtgtgcttttccttcttggtcaatttcataggtgtatcattatttgtcttttttaattaatatgtttatataacttttcatgtttatccatgtaactactgcttttgtgaaacgtgtgtttttatccttttcacatttttttctattgaaatgttttctttataaatataaatgtgtttttggtatgaaaataataactggccagatgcggtggctcacacctgtaatcccagcactttgagaggccgaggtgggtggatcacctggcctcaggagttcgggaccagcctggccagcatagtgaaaccccatctctactaaaactacaaaattagctggcgtggtagcacgtgccctgtaatccaagctacttgggaggctgagacaggagactcagtcgaacctaggaggcagaagttgcagcaagccaagatcacgctattgcactccagcctgggcaaaaagagcgaaactctgtctcaaaaagaagaaaaaaaatagtaactctttgtgaatagtatcaactaaaatatttatatttcagttttcattctgatattttgtttcatcagaattttttaaagtattttgtttaatatattaactttaataatttcattaactgtctcgtgcttacaaagtctttatgcatttggggattatgtaaagcatctacctttacacttttaatgagtttcagaggttttttggtacctttgagttataatacaaaaataatttatttgggtgtgatatgcagtgaattgctaacattattgcttttaattaaagattaaattccaatgttgaatgatattttctttaatttcaaaaataattagtaactgttccaggcactatctaggtttatgatgtttgaaacaaagattcttcccacacagcatttatatactagtggtaaatacaggcaataaactaataaatatgtaatgaaatatcaagtattaataatcacagtgaataaaaaataaaggcagagagatgagataggaatgattagcgaatctatttaacacaggctagttaggagccctttatttagaaggtgaaatttcatcagatccgtaaatgaagcaatggagtcactcgtaaacaacggggcagagatgtttaagcagaggaaacagagaaagttaaaagctgtgagactgaaagtaacttgcaacgtttgaacagcagcaagaagatctgtggccccagattgaggtgagaaagttggcaaaacagaaaatggggttagaaatggagccaagaacaggtcgtataatatcatgatggtcctgggaaggaccagggacaggcagaggtgtgtttaagaaagggaagacaaaagtatacacggcactcaagagagtgcatgtgcacttagaaaaagaaaggaagtctcagccaatgtttggcccctgtcttctaagaactcttcaggaagtttaccaggcatgctcacagtctgttctgactgtagcctggcttcccctccccaccccaccccaccatacaactcccagcaacagacagcactcagagaatctccagagagtgaagggccccaaagctttgactctccttgcttcttggttaatcccactctgagatatcactggaggacggacagagaggaaagacatttggaacaggtatatgattatcactgagaaggcttgagcgagaatgcaggaaagggtttgagctagtcctgatgagacatatggtgtctgggcaaggggtgtggtggaggaggagaagttggattgccgtttatacacacaggaatattggggctgggcaggttggcatggaacgctgaaactgaaatttgggactccagttgcccagtacacatctacatgaagatgatgcaaggctagtgtatacacgaatccagagttcataagagaaggcagtcctaaaatcatggttttgagaaccagtgtgtgtggaggaaacaacgggatcgcacaaggaaggagggtcaacatcttataccagaagccagtgcaggggaggctaagtttccacattatctcttcttttccattggtctttcactgaattcctttaaaatatcttgttttattgggtgtcccctcatgataattttaaacaactagtgaaacaattcttgtcttcatgtatgttcatgttcaaaataagcaagtttttgtttttcctttcagttgatctatttggctaggttcaaaagatctaactaattgtattgattagaatacaatgaaatacatttgggaagaattgatattgttaaaatgttgcagatttttataaacaagcacaataggtctcacagagatatccaaatacttagaggtcgggtctggattttgaagtaattttaataaaattcttccacaataattgagattctgagatatttttataatttaattttttggagaatatttttcatttaaaaatacttaaaaagcattaacagtgacagaaaagctattgatatatattttttcaacattaatatttatggtggaaaccctgcttaaagttctactttttttttacattttaaatgtaaactgagaaaatatttataaaaacaaaaataacattttaagaattaaactataaatatataaaacatgtcaaacattttgtaaatgatcctgaaggcaccatcagagatataaagaaatgcaagatacatgcacagaacaaaggaagaggggccaccacctttatggactggaggtcaggatatcaagccaaagaggacctcaagtcctgaaatctaacgaaacttgccctgccaggcttcaagtttgctttggctctaagacttctatttaacttccaatttctctttttcagaataggaatgtctatcctatatgtgagtgtcactgttgcattttgacagcagataacttgctgtctggtttcacaggttttaaattaacttattgagtaaaatctaagttgaataatgtgctagagaaatattcttaatacaaagagattaaaaacattagcaagatgtttgaagaggagctcctataatcgtatcccctcaaagcagcaataatatagcagcctgtctggcacaaaagtcccttggtgggaacttctggatcttgacaggaagtgtcaaaactggtgaatcccaacactgaagagagctattttgagaaggcagggccacacccaggtggcaggctcactgactgtggtcctggctacagacacagaattaacatccctctggactcagctagtgccctgtttggcattggtcctgccacctgaaccatctgccaaggggcccaggggcactcacattgaccagtaccctcaagtaacaggcctgctaaccttagttctagctctgaaccctgaagcagtccatgacccagctccagtccccctcagccatggtctgggaatagaccttcctgcacagagacctgccaggaggcaaccctgttcatgtgcctagaggcaggctctcaaaactacgtccgactgccaatcttgaagcagctctgttacttggcacccttttccattgttcaaaagcagtcctgcccactcagtgacctcctgggtgacacattgatcgatgcccctgtaaacaagactgctgacatcagtcagctggagatcctgaatcagccctcttatccagctccagcttccattcaaccacagcttggggatatcttatatcttatatttacagggactatgcaggaggtacacccatccatgcaggacagaagacctcagactcagctgtggtccatgacacagccctgagactcagttccaggtcctctcaactgtggtctggggacaatccttcttgcccagagactttcccaccaatataatgggagtccttcaagggactcaatagaatccacacccatttctgtacctcgtaagaggcatgccatctacagaaccaaatgtgaaccctgaagcagagtgtcctagcgatagccctattgaccaaggtactagaggcagtcttctctaccaagagaccagacaggatttatactcaactcgacttctggtaacaagcttgccaactaaaaattctgctgtagactcaggagtagccacatgacatggctctaaccctgctcaactgcagtcctggaggtaattcttattagcctagagaaatgacaggagaatgtctttacctaccgaaaccagtctatgcagaccagaagagctgtttgcaacttcaaatgtgcacacatcaatgcatagctacttgagtcacaaaaaatcaggcaaatgtgacaccaaagtaataaataaataccaccaaagtaataaagcttcattaagcaaccccaaggaaatggaaatctatgaattgcctaagaattttaaaatcatattaaataggatcaaagagcttcaaaatagcagagatctaaaactaataaaaaaatgcataaacaaaatgagaaatataataaagacattgacatcataaaaggaaagaattcttgtgctgagaagatttgtagtcaaatttggaacactctagtactgtaatggaggtgtgtaaatctcgttaactttagtgtaaagcttgtaaaatattctgaatacaattatggaagtgagaaggtcaacagagtactttaataacatatttcatcatacagcgaaaggaagcaatgaacttgagtttagatcatacagttagaggaacaaaaaaaataaaatgcagaagcatctgggaactataagacaacatcaagcaaatatatatgtgtattatgacattcacagaaggagaagagagaaaaacagaaagctaaaatgacaacatttcctaaatttgtgagggatagggacatgcagattcataaagttcaaaggaacccaagcaagaacaaaccaaaacattatacctgagacatattatgatcagtttgtcaaaagtcaaagacaattctataatttggaaaaatatggatgagcccagaggacaatattttaaataaaataagcctggtataggacaaatattgcacaatttcatttatatgtgaagtgtccaatagtcaaacacatagaaacaaagaataaaatggtggttaccagagtttggagtgaggaaggaaaagagaagatgtgggtcaaaggatacaaaattttatttaagcaggagaaataagttcaggaggtttatggtacatcatgctgactacagtttcaacaattatgtacttgaaaattgctaagaaagtaggtataagagtactcagcacatgaaatgattacttgaacccaggaggcggaggttgcagtgagccgaggtcatgccactgcactccagcctgggcaacagagtaagactttgtcttaaaaaaaaaaaaaaaaaaaaactcccaagaaaagcctaggactagaagacttcatgatgaattcatccaagcacttaaagaactaacacatatcctcctctgattttttcaaaacattgaagggcaaaaacacttccaaattcatttactgaagccaacattacctttaaaccaaagccagataagaacactaactcccaaaatattataggtcaatattcctgacaaacagctttcataatttttggtaaaaattaacaaaatactaacaaaccaaagcagtgcattaaaaggatacttcaccttaatcaagtgggattattcctaggatgtataaaccaaaagtatgtcagacaggtctcaatcagattgaaagtttatttcaccaaggtaaaggacatgcttggaaaaaagaacacaattacagaaacagtctgtggtctgtgcttttctttaaagataattttgaggactttaatatttaaaggggaaagcaggctagaggggaaagagggagagtatgataatccacaggttgcaagaagaaaagaagcaaagaagcaggtaggtgaatagtcatttatgtattcctttcacactcagtagaaggatcatcgctttacgtcaggtaaggagaatgtggagttactgcctgttactctaacattttatcagtagttaactgattaggaacaaaaaacaaaaaccaaaggaaatgcagtttcttgcataactcagctttcagcttagtatcttttttccttttggcatagtaaattggggtcccaagtttttttcccacagatgcaaagatggttcaacatacaccaatcaataaatatgatatgccacattaacagaataaatgacaaaaacaattgtgcatctcaatagacatagaaaaagcattggataaaattcaacatcttttcatgataaaaactcagcagatttgttatagaaggaatgtgcctttacataataaatctcacagctaaatcatactcgatggagagaaacagattttccgctaagatcaggaagaagacaagagtgctcactctcactgcttctattcaacataataccggaaactagccagagcaattaggcaataaaaagaaagaaaaggctttcaaatcagaggaagttaaattatcttgccatctgtttgcagatgacatgattttacatataaaaaactctaaagactccaccaaaatcccatcagagttaaagaattcaagaaacttgcaggatacaaaataaacatatataaatgagttgtatttctatacaccaaaaaggaaccatccaaatatgtaattaagaaaagaataccattcccaataccatccaatagaataaaatacataggaataaatacagctgagggagtgaaagatctgttcactaaagaggagataaataagtgggaggatatctcatgttaatgggttagaataactaatattctttaaatgtccatattactccagaaaatgtctgattcagtataaccccaactaaaattccacaggcattttttacataaatagaataaaacaactctagaaattttgtgaatgcacaaaaatatcaaatagccaaagcaatattgataaaaagaacaaagctggaggcttgactccgatttcaaactatattacaaattatagaaataaagccatgcttatatggtcaattagtctttgatgagggtgccaaaaatgcagcatgaagaaaggatagtctgttcaataaatggcattgggaaaaccagatacatacatgcagaggaacgaaattggactcttatcctacactattcccccaaaaccaaatctaaatggatcgaagacttaaatggaagacctggacttgtaaaagtcctagatgatgacatagggaaacagctctttgacattgatcttggccgtgatatttttgatatgacacaaaaattaaggcaacaaaagcaaaataagcaagtaggactgcatcaacatgcaaaaacttttgcacagaaaaggaaacaataaaatgaaaaggtaatctctgcaatgggagaacatatctgcaaaccatattttggataaggagttagcatccaaaatataaaagaaactgacaaaatcattagcaaatatcaaattacccaacttaaaaatggtaaagacagtgtgaataggcatttttccaaagaggcaatacaaatagccaacaggtgaatgaaaagatgttcaacatcactaatcatcagggccacacaaatcaaaaccacaatgagatatcagctcacacctgctaggatggctattaccaggcaatacatagcaagtgctgtcaagtgtgtgtaggaaatggaacacttgtacatgtgcattgctggtagaaacgtaagttgcaacagcctgtgttgaaagctgtatgacagttctataaagattaaaaatagagctactctataattcagcaatcccactctgtacaccttcctgaggtaaataattatataaataatataatgacaacataagaacattgttaaattagtcatctgtggtgtccatttgagcagttttgcccatttatttaattacagcaatttctgaaaccaaattttacctacctctaacaaccccctcttacaagtgatatttctgcaccacttggtggaatttacttccaaattcagatctctgtacacaaactcagacaaactcctttcatgcactgcaggaataattttcagtgagaagcaaaagtgttcggtcgatgtgtcatgtaaagcaagtacttgtcatttctctcgaagatgcgataggcatgggaacacctggcttccattcattgtcggtaaatcaggcatggtcagggctgtgccaaggggaagtaaattaacagcttcacgatacagctcgagattcagcttcttgcatattaattagaacaaatgtatttctttcctaatttctcacgttccagaaatactacacccatgaattattttgttaatgaaaatgatagtgatctgatgctcatagatttacagaagttacgtttgtagcatgatatacatctggcaaactaaaggttagtgacaagtttataaccattttgctggttttcccagtttcagaagaaacatgccgagggggttaagctttcctaagtctccattatcgcacgcgactgttatgatatttattgtaaacatagtagaccattgtctggaatagactaaatcctaaagaaactaaatctggaactacttttatttacatactatgaaatagatgaacctattctttgaattttgaaatggattcatttttggtttaggtggttccaatggccaatgctaaaactactggtgtttacactacaaagttcacttcagcctttggagaaaatgcgtttctttgtacttactgagatacaatagcagaaacactgaccccagtggctgccaatgtgaaccgaggtttacaatgtattgcaaagggagggagcagccaatactcctcctctagggctctgctaggattctaagtctttacaatgagtctcttcgaggggtaaagtgtttaagaccaagtctcatactaaaatgctcaatgaacctgggatgggagataagataaaaggcactctataaggtctttcataggtcagctactgcagtgcagttaaaaacactctaaagatattaaatctaatgagataaatgggagcaataagcagtatggagggaaaacgccacgtataagaaagaaggaaaatatgagtgggctttgtgctggggacccggagacctgagggcaaaagagaggagagatagggagtaacggaattatagaaagaggaggggacaatgcttgtcctttactacttttcttggttcattcttgactgcatcatgctcctcagagccctggtgacatctttgttgcggagactgtaaatgagggggttcagcacaggagtgaagatggtgtaaaaggcagacaccatcatgtcctgctcagctgtgtggtaggaactccggagcatgtaggtgtagaaggaagcaccgaagagcagcagcactatgatcatgtgggaggagcaggtggccaaggccttcctgcggccggcggcagaattcatcctgtggatgagatgcaggatgagggtgtatgagctggagatgaccatgatgggggtgagaagcatgaggatgcagcacaggtacgtgagcatcttatagagggagacgtcagagcaggagagcttcagcagggcaggagtctcacagaaaaaactcaggattttcctagactggcaaaaggggaagctcatggtaatgggggtgagcaacaaaccatcaaccattcccaaaacccagcaggctgacaccaggagctggcacaccctctggttcatcagcagtgggtaatggagaggtctgcaaacagcagcatatcggtcataggccatggcagccaggaggaaaacctcagctccagccagggtcaggtggaagaacatctggatcccacagcctgacggggaaatggtatcatctccagtgacctggcccacaagcatcttgggcacagtcacgcataggtacatgagatccatgagcgcgagctggctgatgaagaagtacatgggggtgtggaggcggggctctgagtggatgaggaggatgaggagggcattcccagtgagggccatcaagaaaagaaggaaggtcacggtgtagaggagggcagcatgcttgctctcagcaaagagtcccgtgagggtgaaatcagtgcttgctgtttgattctgagaagtctgattccctgagcacatgactggctcacagtttccccctgaggaaaaaaaagtcattaattttaaatctttcctatgtacatggctttcctaacctttttctggtaagacatgtgctttgaattatttttctaaatattgagttaaactgacataaaatcataagttcaaatcttaggtcaagtcgcatgttggccacaagctaaagtgaactacgaaacagatctggggaggtgactattcctgagctaagtcaagagtgaagacaggtacactctatgtcttatttccccccagaattaagaacacaagtatactggccttgtgggatggttagagactgaagtagggaatgcacgttaggtctgtaacacagtgttagtgttgggttgagattttcactactttttggatacagtagctcatccaggactcagtgatggaaatcatggctgataaggttaatattaatattgttaatggtacaaatatcataactaataccatgaaataatctgaaaactggaaatctccttaaatttcttctaccattatatatctccatttaagtccactttcctcatgaaaacttttcaatttattctgctattcctcacaaggttgcattccataagtagtgctgactggggcagaggagcagagggagagtcccgcctgcctgaggagagtagcttggagtgcagaacgagtgccgagcaggagagcagcagtaggcacagtgagccctcttcccagtccccagtgaaatctaaggcatttaatttattaactgtcaggcagagaaatatttttacaagaaatcacagcaataaatgctgcagatgccctaaatatcaagtatttatttgaaatataaacaaaatatttattttcaaaatgccatatttatcccccaaaatcatgcctaaaatgtccaaaattccgtgcatggtgattgaaaaatgaagttaaagcacatgaggcagttgtgttgaatctttcataaaaccgcagccctgcaaccaagcctagggatcctcttgtcctgcatctcctttgcataacaaactaatcaccaccccctcccataaattcatagctttgctcagtgactgctttgtctgaatatttcagttttaattttccagttgaattgtttcaatcatgcttgatacaattgtctcaaagttaaaaagcccactaacttctagactaatgaagagtcaggagctccatgactgaggtttggtcatcctcagggttgctgtactgcaggttagagaaataatgctgaggaaaaaactaacagtgactgaggcacgtggaaatgcaaagtgaaatacaacgcactgttcctagggcaaaaaaaaaaaaaaaaaaaaaaaaaaaaacaacaacaaaaacaaaaccatacacacaaaacaagagaccaaaaaaaaaaaacaaaacctgggacttcaggaaacctaaagtcagaattacaaagagctagcaacaagagtcaggtatctttgttccttacttatcccctttataaagcactgaagaaacgggttatcaagacacctttccacaaagagacgaacattgcacatagagcacaaaccatttgctccacctcttctgctccatcagagaataaatctaagccacgccagctcagtgaagctgctttcaccattctaaggccaaagcaaaggggtttaaattcagaatgaaaatgagaaaattacatcatcagtttcttcacattagggaattgagatgagtgtttattgcttaattctttgcaccgttttcccttttttttttctgcttattcatcttccctgtacttggcattgtctcttccctggagcttctactttctttaagaccatctcagaatccattattttggtatttttgttttgttttgctatttgtttttgatagttatattctaactttccagttacagtccacgtggtaattaaacatgtttttcatttatgcgatgcgtctatccaaaagcaaatccatctttttcatgacattgcacatttttaaacaacttcatttttctagtttaaaattatattttcgtatcggacatttaaagtaagctctttgtaaaagcaaatctgaatttcacaaagggaggatcatggaaaaccagtgtcagaaatctgtaaactaaatataaaatcctaagacccctaatcaactgaacagacccccttctaggacaagagaatctcaggaaagctgaaaagcttaattgcaggacataacaagaagggagacacacttcattatacccctgtctgttggaatttaggcacaactgaccagcaataacattgaaatagagttcctaagactgacaaaacagactctgagtggcaataagataccaaattccaacctgactctagtatagcatcacatgacagatagcagaccctgaggaaaatcaaaatattccaccccaaagtatgtctttgacatattttgaaatggccctacaaagccatctttcgtggggaaaagttgcatctatagagactttccattaacacagcaggggctttcccagattcaggagaaaatatcggagtctgacaacatttaaggttctaaaagaaacatttaccatttattatatttgcttccaattaattgtgtaatcttagtcaagaccctaaaagctctgagtgtcacttcctcaatcaaataaaaggaggagtgttatgtacttgctatgcttctgtgactcttaagacatctatgaatctgatgaccgaatgtggtctaagatttctccatgacagggtgaccttctcccacatcgcccctctccttaaaggctcagagacttcccttgaaatattagtctcatcgaatttagattatataatttgggaatgaaaaagaatggaaaaagggagccacttttctcagtgcctgcaaggttccgagactttgctgagtctttctagcatgacaaacgtacaaatactgagtagtgtattcatccctgtgtacagtcatccctcactatctgtcctcagtaccaggacatcgtgaaaataccaaaatccatgatgctaaagaccctaatatgaaatggcagagtatttctatataacctacaccaatcttctcgtatgcttgaaatcatgtctagattacttataacaactaatgcaatatgaatgctatgtaaatagccgttatactattttttttttacgaaataatgacaaggaaaaaaagtctggaggatggaacaagatgacagaatagaagtttccactgatcatccccctgcaagaacaccaatttaaaaactacctacacaaaaaacacctttacaagaaccaaaaatcgggtgagcactcacagtacatggagttaaattcatatttctgaatgaggcattgaagaagttagaaaaacagtattgcatcactgacactaccactccttcatcccccagcagtggaggtgtggtatggagagcttctctgtgcactggggagagggagagccagcaattctaagacactgaactcagcaatgcccttgttatagcagaaagaagacccagaccaaattcagctgacacccaccatgaagggtgcatttaaatcagccattgctggaagggaattgcgaatcccagtgtttggaacttgagttacccaagcctcaccatgaagggctaaagtggctctggagccacagacaaacctgaagggcagtctaggccacaagagctgcaaatcctaatgctaatctgggcccagagccagtggactcaggggacacatgacctgttaaaacaccagccagggcagctaaactcatcccctaacctcagcctccacggcttgtggctccaaaagaggcctctttcctctgctttaggagaggagagggaagagtgaggaggactttgtcttgcatcttggataccagctcagccacatcagggttggataccagccagagtcatgagggccttgggtgagactctgagacatgctggcttcaggtgagactcagcatattaccagctatggtggctatggggcaagactccttctgcttgaggaaagtggacagaaaattaaaggagattttgtcttgcactttagtgcaactattgttaccattgttattcaacatattactggaagttctagctagagcaatcagacaagagaaacaaacatatatatatatatatatatatatatatatatatatatatatacacacacacacacacacacacacacacacacacacacacacacatgcatacggcatcaaacgtcaaagaaaagtaaaattatctttgttcacagatgataggaccttatgcttggaaaaacctaaagtctccccaaaaacctattagaactaataaacaaattcaggaaagttgcaggatacaaaatcaacatacaaaaggcagatttctataagtcaatagcaaatagattaaaacaaatttaaaaagtaatggcatttatgatagccacaaataaaattaaagaggaattaaccaaagaagtgaaagagttctataatgataactataaaacagtaataattgaagaggacactaaaaaatgaaaagatattccaggttcatgaaccaaaagaatcaatattgttaaaatatccatagtactcaaagcaatctatagattcaatgttatccttatcaaaataccaatgacatttcttacagatatagaagacactatcctatcatttgtatgaaggcacaaaacacccagaggagccaaaattattctaagcaaaaccgccaaccaaccaacccaccaaaactggaggaatcccattgcctgacttcaaattatactacagagctaccataaccaaaacagcatggtgctggcataaatgcagatacatagaccaatgaaacagaatagagaactcagaaacaaatccacacacctacagtgaactcattttctacaaaggtgcaaggaacatacaccagggaaaagatcatctcttcaataagcagcactgggaaaagtggatatctatatgaagaaaaatgaaactagtcccgtctctcgccatatacaaagatatagtcaaaatggactaaagactttaagacctcaaactatgaaactaccagaagaaaacattggagaaaatctccaggatatttgtctgggcaaatatttcttgagtaatactccataacacagacaaccaaagcaaacatggacaaatgagagcacattttgttaaaaagcttctgcacagtgaaggaaataaatcaacaaagagacatcccacaaaatggaagaaaatgttttcaaactacccacctgacaaggaattaataaccgcaatacatagggagctcaaacaaatctataggaaaaaatataataatctgatttatatactgataaaagattgaatacacatttctcaaaagacaacatacaaatcaaaaacaggcacataaaaagtgctcaacattgatcagagaaatgcagatcaaagctacaatgagataccatctcatcccaattaaaatggctcttatacaaaagacatgcaaaaataaatgctggtgaggacatggagaaaagggaaccctcataaactctgtgggaatgtgaagttgcatttaaagttgtatttaaaggtgcaacagagaacagtttggaggttcctcaaaaaactaagaatagagctaacgtattatccagcaatcccactgctgggtatatagccaaaagaaaagaaatcaatatactgaagagacatctacacttccatgtttgttgcagctctgttcacaatagctacaatttggaagcaacctatgtgttcgtcaacagatgaatgggtaaagaaaatgtggtacttatacatgatagtgtactatatagccacaaaacaatgaaatcctgtcatttgcaacaacatagatggaattggaggtcattatgctaagtcaaataagccaggcacagaaagacaaacattgcatgttctcagttatttgtggcaccttaaaatcaaaacaattggacttatggagatataaattagaaatatgcttagcagatactgggaagggtactgggggggggtgaaggggtaggtggggatggttaatggatacaacaaagttgttagaatgaataagtactagcataatagactgacattgtcaataacaatcgtacatttaaaaataactaaaaggatatagtaatattgtaacacaaaagataaatgcttgagaggatactccatttttcatcatgcatttattatacattgcattcctgtatcaaaacatctcatgtaccccgtaaatgtatacacctatgtcacaacaaaaataaaatttagaaaagtctgtaccaatgtgaccatgataagcctaattatattttcaatccatgattggttaagtccatgattggttgaatcttcagatgcagaatccaactcataagcccaactgcagaagcagatactgacaccaggagacagaatgagcatattctgtccttggctggtacccaccctatcttccaacattgcttcttccaatatctcagagtatccttaaaccacacactttcatattccttcataacttcttgtatcctgcttccttgctgtgaatttaccaaatgcatttctgtataaactctaccagtcataaacacttagataatatgacaatttctttatgaaggcgtgctctactcaatcagtgagaactctcacacctcagacataacaatccttcttttatacccttcacacaagcctcaactcactcttgtattttaattatttctaagtttcaatgaaaattccacatgaatatgtataattagaaattactttaatgagctgtataggtatgaaagttaaaaaactaaataagtgtttaaaaatcgcaggtggagggttgataatacgtaaaattgcaaaattctagatacattttaggtactgctatgaaatccttaatgagctgtacacttattttttttatggatatacttcaatagttgtacaagcttcatgtatagccacaaatataaacatattcaagaacataaaatgacaaaatggtcaacaaatttatcatcttaggtccttgagggacttttgatgagtggaccctgagtaccatctgacagatttacaatgtgaacatcacataaacaatgtttttgtgcagcttgagatgttactatggcattaccttgtgcattctgactgatccataattatatttaaaatttgcaacagtgctccctattttatgttcataacatatatcatcatctggcatgaccacatcatatgttttacctattcactgtttgggtttttgttattgcacaaggagaccaaaatatattcattttcttctctgttgctttctaacattagcactatgcctggcatatatcactttcgcaccaacataatagtaaaaattgattatttgttaaataaatgaagaagggaaaatgatggttagagagattagtgcaactcctttagagatgaatttagtaatatctcataacattgaagatgttctttcttcactacctaagacttccaaggagattatacgaggatagacactctgttacactataaagcatgaaaaaagtggtaaacctaaatattcatataaagaaaatgcacacatgaccaatattaataccaatttattgtgaacatttcaataagtaaagttgaaggaaaatatatgtggcagaatgatcagtgtgttaccatttaacaaatacatcctgctaaaatattacatttggacacatatctgcaataaaaacattaaaaattgatagggaagatacacacctactgtttaaaaaaattggtctgaggacactaagagagggaattcaggagagcacagataagactttgatgtacctgtaaaatatatacccccatttttgagtcagggtcttgctctgtcacccaggctggagtgcagtgtcacagttgtggctcactgcagcttcaatctcccaggctcaagtgatcctctcacctcagcctcctgagtagctaggactatagacacgtgccactatgcctccctaatttttttaaatttaatttttggagagatgaggtctcactatgttacccaggctggtctcaaatacttaggctcaagcaatcttcccacctcagccttccaaagtgttgggattatagggcataagccactgcccctggatgatgtacctatgatatatatatatttttttatttcaataggtttttggggaacagttggtgtttggttacattaagttctttagtggcaatttgagaatttggtgcactcatcacccaagtagtgtacactgtacccgatgtgtagtcttttatccctcacctgctcccaccctttcccccaagtccccaaagtctattgtatcattattatccctttgtatcctcatagcttagctcccaggtgtgagtgagaacaatgtttggtttttcattcctgagttgcttcacttggaataatggtctctaattacatctagtttgctgcaaatgccattatttcattccttttcatggctaagtaatattcatatatatatatatatatgcatatataggaatatatgtatatatgtgtatatatgtatatataaatatatgtatatgaatatatgtatgtgaatatatgaatatatatgaatatatgaatatatacgaatatgagaatatatgaatatatatgattttctttatccactcattgattgatgatcatttgggctgcttccatatttttgcaattgtgaagtgtggtgctgtaaacatgtgtaagtatcttttgaatacaatgacttattttcctctgggtacacaccaagtagtgggattgctggatcaaatggtagatatacttttagatctttaaggaatctccagacttttccatagtggttgtacaagtttacatttgcaccagcagtgtaaaagagttcccttttcagcacatccacaccaatgtctatttttaaaaaattttttgattatggccattcttgcaggagtgagatggtattgcattgcggttttgaatttcatttccctgataattagtgatgttgagcatttttttcatgtttgttggccatttgtatattttctcttgagaattgtctatttgtgtccttagcccactttttaatggctttgttttgttcttgctgatttgagtttcttgtagattctagatattagtcctttgttggatgtagagactgaagattttctcccactccatgggttgtctgtttactctgatgattatgtcttttgctgtgcacaagctttttagtttaattaagtcccatttatttttgtttttattgcatttgcttttgggttcttggtcatgaagtctttgcctaagccaatgtctacaagttaacattttctgacgttattttccagatttttaataatttcaggtcttaggtttaagtctttgatctatcctgagttgttttttctataaggttagagatgaggttccagtttcattctttacatgtggcttgccaattttctcagcaccatttgttgaatagggtgtcctttccccacttttatgtttttgtttgctttgttgaagatcagttggctgtagtatttggttttatttctgggttctctatactgttccattggtctatatactgatttttatgccagtaccaagctattttggtgactatggccttatagtatagtttgaagtcgagtaatgtgatgcctctggtttcgttctcttttcctagtcttgctttggctatgtgggctttttggttccatatgaattttaggattgtttaggattgtttttctgtgaagaatgatggtggtgttttgatgggaagtgcattgaatttgtccattgctttggcaatatggtcattttcaattattgattctactcacccataagcatgggatgtgtttcaatttatttgtgtcatctatgatctctttcagcagtgatttgtagttttcctcatagaggtcttttacctccttggttaggtattcctaagtattttattttgcagctattgtaaattgggttgagctcttgatttgcatctcagcttggtggctattgctgtattaacagagctactgagtcgtgtacattaattttgtattctgaaactttgctgacttcatttaccagttccaggagctttttggatgagtctttagggttttcttggtatacgatcatattatcagcaaaccgacagcataacttcctctttactgatttagatgccctttacttctttctcttgtctgattgctctggctaggacttccagaactatattgaatataagtggccaaaatgggcatccttgccttgttccagttctcagagggaatgccttcaacttttccccattcagaataatgtttgctgtggatttgtcataggtgacttttattaccttacagtgtgtcccttgtatgctgattttgctgagggttttaatcataaagggatggattttgtcaaatgctttttctgcaactattgagatacacagaattaaaaacaaaagtcacatggttatgcgatgtatcacgagttgactcatatatgttaaatcaaccctgcatccctgttacgaaacccacttgatcatgatgatttatctttttgatatgttgttggattctgttagacagtattttgttgagaatttttgcatgtatgttcatcagggatattggtctatagttttgttatgtcctttcctgggtttggtattagggtgatactggcttcatagaatgatgtaggaagttttccctctatcttgtggaatagtgtcagtaggattgatgccaattaattcagctgtgaatccatctggtcccagactttttttgctggcattttttaattaccattccaatcttgctgcttgttactggtctcttcagagtttctatttcttctttgtttaatctaggagcattgtatatttccagaaattaattcatctcctgtaggttttctactttacacgcataaagctgttcatagtagccacgaataagcttttgtatttctgtgatattggttgtcatatcacctgtttcatttctaattgagcttatttggctattctcttgattaatcttgctaacagtatcaattttacttattttttcaaagaacctacgttgtttcatatagcttttgtattttttatttcaatttcatttagttctgctctgatgtttgttatttcttttcttctgctgggtttgggtttggtttgttcttgtttctctagttccttgaggtgtgaccttagattgcctatttgtgctctttcagactttttgatgtgggcattaatagtatgaaccccatgtgattcaggaattccattactaaggatgtatccaatttaattgggcatgtcaaagagatatctgcactcccatgttcattgcaacattattcacaatagtcaagatatggaatcaacctaagtatccatcaatggatgaatagatatagaaaacaagacatatatccacagtgaaatgtaattcagcctttaaatagaagaaaatcttgttcatgtgtcaatgttctatattgtgttgtatatatcaaaacattataattgtatatataatacatatgtgtatataatgtatattatatataatacataattacaattatatgtgtaatatatatgtgttgtatatatcaaaattgctaagtgggtacattttaaatgtctcaccatgaaaattggtgataatatgttcattaggttaatttcatcattacaaataatattcgtatattaaaatatcacattctaccccataaaaatctatattttaatatttcaattaaaaatatttttaaaaataatgcaataagaacatgaaagtagaaaaatgattatagacctttggtgtggaactgaaatcagaaacacaaatattaacctatgatttctacatacatttataaataattgatggtgtctacttcattctttactcgttttctttccacattttgtagatataatttgagatttttttattctatcttcttgaaataggagattagtcaatatttaacctttcttcttaatgatctacagggataaatttttctgtaaccactgcgttagctgcatcctacacgttttatgtcatgtttatattattgttctgtcaaaggcccacctgtgtttgattttggtgagaatcccacgtgaactagaaaagaacttgacttttcttattgttgtgagcattgttccatatgtacaaagttttgttaccattaagtatgttgtataaatcttctataactttagtaatttggaggtttctgtgctctatcacatattggcatgttaacatatatactattaaattgagcaatgactgggcaaaaggaaaaatcaaaagagaattaaaatctcaagacagacaaaaaatacactatactaaaacttatgagatgcaccaaacccagtactaagagaaaagttgattgcaatgaatagctacatgaaaaaaagaattcaaattaaccaactaactttatatatcaagaaactagaaatagagagcctaagtccaaagttataatacagaagaaaacattaaagtagaaatgagactagaaaaactaaagaaaaatcagcaaatctaaattgttttttaaaaatttaaaggtgataaaccttagctagactaagaaaaagagtatcctcaactaaaatgagaaataggaggagtcattagaacaaatgcctcaaaatgaaaaggatcataaaagactattatgaaaactatgcacttataaattagataatctataagaaatcaaacttgatttatgcaacctaccaaaactaaatcaagaggaaataggaagcctgaacagaggaagaagatcaaattagtaaacaaaaacttcccaaagaaaagaccgaaccaaatggcttcgtggatgaattctaaacattcaaagaactaatagcaatccttcttaaactctttcaaaaaccaggagaatgccccaaactcattttatgaggccatcaaacacttatatcaaagccagacaaagataatcaaaagaaaataaaactacaggtcaatatcactgataaacataggtgtaaaaatcttcaacaaaatactaacaaaccaaattcaacagcccattaaaaagagaataaaccatagccaactgaaatgtatctctgggatgcaagaatgcttcaacataggcaaatcactcagtgtgatataacacattaagagaataaaaaaaaattgcagcaaaagcatttgacagttcatgtcaaaactctgaaaaacaggtatagaaggaacttatttcaacacaacatatcatatatgaaaagcccacagttaacataataaaaaatgaaaatgtttctcctatggtctggtacaaagcaaggatgttcattgtcaccacttttatttaacatggtactgaaagtcctatccaaagcaattagacaaaaaagcatcaaaattagaaaaatattaaaataatctctgtgcaggtgacatggccatatatataaaaaccctaagactacaccaaaaaactattcgaataaacaaattcagtaaagttgcagaacataaaatagcacacaaaaatcagtgacatttctgcacacaaacgatgagctatttgaaggaaaataagaaagcaatcccatttaaaatagcaaaaaataatatatttaggaatacttatccaatagggcagaagactcctacactaaaaatcataataccttagtcaaagatattgaaggagacacaaataaatggaaagacactgtattcattcatttgaataattaacaaatcttcaaatttgtagatttgaataattaacattgtttaaaatgtccttattaagcaaaacaatctataaattgcaatttctataaaatatcaccggtatttctttacagaaataaaaaaacaataagtaactacatctagaaccataaaagatctcaaatagccaaatcaaccttgaacaaaactagaggcatcacattgatttcaaaatatattacaaaggtatgggaattatcactgtaaagaactgtcataaaaaagaaaaatggacatatagactaatgaaacacaatacggagaacagaaagcaacccgagcatatttggccaactgatcaacaaagtgagaaggcaacctacagaatgggagaaaatatctgcaaaccatatatctgtaaagagggtaatatccagaacttataaggagctcaaacaactcaatagcaaaaaccaattaccttgattaaaaataagcaaagggcctgggtaggcatttctcaaaagacgacataaaaatggccaccaggtaaataaaaagagctgaacatcactaagcatcaggcaaatgcaaactaaaaccacaacgaggtatcacctcccaccggttagaatagccatcattacagatcaaacaaaagagagggaaagtggagaaaaagaaacctttgaatattgttggtgagaatgaaaattggcacagcaattataagcaaacagtacagagtttcttcaaaaagttaaaaatagtactatcatatggtctagcagtcatgcttctaggtaatggttcacccaaagaagtgaaagcgggatttcaaagaggtatcagcacaccagtgtttattgcagcattattcacaatagcaaaaatagaaaaataactgtaaatgaatgaaaatgtaatgaaaatataaatacacatacttgcacaatgaaatattctttattttttagcccaaagtaaatcctgccatttggcacaacatgaatgaacctgaactatattatgctaagtgaaaaatacacagaaagacaaataccatatattctcacttatctaaaatagtagactagctcatagaaacagtagcatgttggtcccccgtgaggagtttagggaaacgaataaagactggtcaaatgctacaaagttcagtcatgcaaaagtgaataatttctagagggctaatatacagcatggtgactatagttagcaatattgtcttgtatacttgacatctgttaagagaataaatcttgtatacttgacatttgttaagaggatatcttaagtgttctaaccacaccaaaaaaaaaataactgtgaggtgatggaaatgttaacgagcttgatggtggtcatgatttcataatgtatgaaatatatgtacataatgtatgaaataatgtcggaagacaccgacacgccgcgccgccggagccccagtgcatgctggttgcgctgaaggcgaccccgccccagaatgcacggagcctccgcccaggccccggaaggacaatgtgcccgacaactggcgatggctgtaggaagccatggtgaggcgggggatggatggaaccaccctgggcccagcagctgtgattggcaggaggagccacatctttcattcttacagcctcagtctctctgcatccttatacttaaggtgtctgtaatcataatattgtataatctgataatctcagtattttacttggaacatttagtatattacatattttattgatacataatatttctacatacttatggggcacatgtgatattttgatacatgcatgcaatgtgtaataattactgatataattggggttctatgtgagctataacttctaaccatattctatttggcccatctgtttcacgtctctttttcattctttcgttgcttcttttagaaatataaaaatctatcattttttcattttataaacttgttttggcgtttactataaacattacagcatgtactcttgatttactaaagtttaacacaaattactacctctactacatcaatattgatatatcttcaacatgatttttcatacatttaagttttgcacaaatctaaactgtatattacattaaaattattgctaagtcaatattgattatgactcatttacatattactctttggggttgatgtttgtcatttttgcttatatttctgagtttacttttgagataatttttctatggctgaagaattttatccacttttgtttgttggaaaaatttattttactatcattttttataattggagttagactcaatctacatctagttcatccctattactgagacatggtcctactggactcttgattgacaggctggtagatgtccctatgctctgtcttgaaagcatttctcccaatatcaatgtggctcattaacttgtaaactccacatctttgctcaactataaccagtgaggattagcctaaatccctacataaaacgtgacccctacacactccaagacccctctcctgctcaagattttccaacacttttcttctgataatactccatgtcttcttctcaattaccaaatttattttctgtatacaccctttaagtgctaaaaaagatgaagatttttatttgttttgctcactgatgtatcctcagtttgtagaacggggcctggcaaactataggggctcagtagttatttgttgaatgaatgaatgacttggggcctaaaggaagattatgtagtcatggaaagttatcttcgtatccttgtacttacagataaaaaaacattccgaagagagggaaagccacgtgaaaacattgggtatggaaagaactatagtgtttccaaggttggagtatggccctcccagagggagaggcaatgcagtgtggaaaaggccacagactccacaagacgtggcacatgcagtggtcaggggcagggactccggcctgcctgcctgggcttaaatccctgttgagcactttataagctgcacacccttttgttcatgttactcaaacccatgggtttcagttaaatcaactgtagaataaggctaataataggctgtgaaaataaaagtgttccatacatgtcacgcactaaaaatggtgccagatcataataatcacacaagacgttataattattatgttatttgttaaatacaaatacaaccatgcacatacgtaaaactgtgatttgaaattatattctaagtatgtgtcaccattggcttgaacagggagaagtgtgcgaaacttccatatttctctggttaagtctatgaataaaccaattatactccaaacatgttgtagcccatgtctactggatagcccatgtctctgctctaattttgggaggtttgacttcttatatgctcacagaaaataagaatttgattgagaacacattctagaaattctgatggaagaaaaatctcaactgtacatttagcatctctgaggtcttgaatgtgtttatctccaaatgcctatggatgaatgaacccccttgtccctgaggatcccctgcttggggcaagtcaggggaagcctcaaaggctgttttgtcatttgtgaaatgtgggtgaccttagcctcagccacagagggtgaaggtcgaatgaggtggtgaacgaaaagcgtttagcacagagtggatgctgaggaacactctgaatatggtgttatttcatactcatcaatgggcccatgatagcaaaacaaattttctctgtggtggaaggtgctcaagggtcataaacacatttattttcatatttctccactgtaatctaaaaaaaggaccattggccccgaaggactggactagagatcaatgctacgagggaagggggggataagtgaacatcatctcaagtgtgattataggagggaagaacactgggctgaatccccctgaaggacaactcagggagtcagacactaccacaatatgctgattgtttggtggaaggacacctaaagtgaagagagactctaagaagagaggaccaacttaagttctttcacactttaatatggaggtttctgcacgctcagcatttttttcaaagcccttgtgacatccttattcctgaaactgtaaatgataggattcaagacaggtgtaaggatagtgtagaaaaaggatgacatcatatctttctcaggagtttggtaggagctggggagcatgtagttgtaaatagcagctccatagaagaggctgaccactgtaatgtgggaggagcaggtggtgaaggcctttttccgaccctcaactgagttcatcttatggatggtgaggatgatatagtagtaagacactgaaatgaccgtcacaggtatcaggagcatgatgacacagcacaagtacatgaaaatcttgtaaagtgaggtgtctgagcaagagagcttcaaaacagcagggacctcacagaagaagtgctgaatctcatgggatctgcagaaggggaagctcatggcgatgggagtgagcatgaagccatccactgagcccacaaaccagcagcctgatgccaggaggagacataccctatggctcatgagcacagagtaacggagaggatggcagatagccacatagcggtcataggccatggcggctagaaggcagcactctgcacctcccaactgcaggtagaagtacatctgggtgccacacccaaggaccgagatggtcttgtctttggccagctggttcaccagcattttggggacagtgacagaaatatatgtcaagtctatgagtgagagctggtttataaagaagtacatgggagtatgcagagaggagtcaatgtggatcagaagtatcaatgtaatattccaagacacagccatcaaaaatatactgaagataagcaagcagaggcggccagggtgtgagatctggctgaagattcccaacaggaaaaagtcaccacccagggtctggttggccagccgcatgctgtatgatcggctgaagtggctttacctggaggacaaaagtaaactttatttataatcatgtgtgtaccacgtaaaagtatgtttgcttcactttaccttttaaaaatcaatgtgaaaatcagagtgtatttccaacatgaactgtgaatttgcactaaaaagagacagcacattagattgtgaatctgattccccatctagaatgggaatgaaatatttatattctcaatgaagaggtccatacaactgaaattaaattatttcctatagattatatagtcactaatagttatttttacttatatatgttcacattttgtgtgtgttagtatcttatagttgcatgttcctgtattgcccaaatcccattcccatgggattttacagagctaataaccaatatagatatttctatatatttgaccctcaagagtcatgtctgcaaaaaaggattagtaatacttgtgtttcttaaatctcgttacaaatctacgaacatacaatttttcaatacttaaaagcaatatattaagccaccagtaattgtaaacattttaaacataaaattccaaacccttatataacgttacaaatttagtcaaatttctttaaatgtattaaagacactagtacaacttgtaaatttctctaaaatgatttacttttacacatatgtgatttataaaatgtatttttatacttccacttaacctattacaaagacattaatcttgtgagttatttattcatattttcataatttccatcaagatgttctaatccgttgtgtttctgccaatctttcaagatatcaaaaaaaaattatggctatctcagatcaatgatgctttaggaatcagcattatcatccaatcagtttattctgaggtgattggtctgaacctcacttggaatttcttgatgtgaaccttctttataaaattaaagtaaaatgtaattggattttacaagcccacatcttttcttccaatctccccattttgcctgtagaattttggtgagagaaagtttgcctcaatttatacttatcttatcgtgacatccaacatatttattgtatgcaggtaggtcatcctaaggtttcttctcccagtggttcaagcatgggggtctctgaagttgcaattttttttaaagactactcaagtgcactagtgagaagggaggaaaatgtagaacaaggaattctatctgtaactggctgtgaacaatcaattgagataactatcttcagatcatccaagttccaatttcttctcagagcatctagtcaattaatcaccttgtaataggctgtaggactcttcttctacctggctattttggggggtcagtggtgctggtcagccctttcccgttgatagcactatctttctcttgttcagaattctgtgatttacatatggatgctcattattattattctctacttaaagaaaatgcatatcctttataaaatgaatagttttagatatcattaatgttcaatatattaataacgtgtcaaatgtttatttaaatcagacacatattcatcctttttatattgcagcttttcttatgtaaccttttacattgtaatgtacactttatattttttatcattaacttaaaatttataaataagaattattgcaattggtcatattatttccttttttatttcaaatatcttgccctggccaagactaaactcgtgggttttcattttgttttagaaatacttagcaaaggacacagaaagcataagagtaaagtaatgccagtttttaacaaattgctttcttatgttaagagacttaaaaccaaaggggacttaatgtattttcagtaaataaacatgtcattggccataacaaatggtagattttagtcaattaataaattactagactaataaactatattttcctggagcagaaagtaattttctaagtataaaggcaaaataaataattcccaataaacttcaaaaattcagtggaattatttagtagattccaaaagacaatgaagcaacatcatctagaaaaatttgaaaaaaaaattatggtccaagaatgaagcatatatccagcagtgaaacagcatagaggccctgtctctcagatatccaagaactcagaaagcagagaatcaggtaaaccgtttcagaaattcactatcagccctgctccagccactgtcagtcaatgtctgtcccgtcaaataaaacaactgcaaaatgtgagagtcatggtacgcctggaccaaaggcgaaacctgagacaaataaaacacacatgtgccaaattgaatgatcatcgtccatctgtatcacataatgtctcaaagaaaaatcaggaagtaggcgcaaaaggggtaaggaaaagtagacttaacggaatttccacaatttataggagataagcattttcacttgctgcccagcttctcagtgaaataagtgtatttaatgtccgctcccaaaaatggagtccatttagggacagtgtccaggataagactggtgcctgtcagagctaattaactctaggtctatgtaaggaggccccttcccaagttgaacaggtggtttacaatgagtataattatgcaaatcagcagtgagatggacatgagctagtcagggtgagcatatctcaggtttattcaggagaacaaaagtgagagtggatattgcatttcttggccatgtagttcaagctaccgttcttccacagacactgaaacaaggggactgagtccataaggctgcagaacaaaactccccttaaccaaatcaattaatttatccacttctaggaaacaaatgacaccagcacagacggccacgcaaggcaaaagaacagcaattaggttcattcaaaagcaataaaatattttaaagatgaactgctatttccaaaatgaaacctttatgacaaagcaagcaaaccagttgtgacaggcttcacagtagtaacatctgcactgtaggaaggagagcacccctccttcttgagtgggtatttatactccaaagtgatgtgtcatgcttcacccaggaagtagaattatgttgctcaccatgaggctgaaacctctatcaaccatctcccactcatccacatcttcctgttttggagtctgggagatcagttatttaaaaacaaggggaaaaaaggaggaaaggaagggagggaggaagaagagaggaaaagaaaactaatattcaacattgctccgattttcagaggaaaaaatgtttataatttaagtcagatttgcctggaaaaatataccaccaggaggaaaaggctcaagatctgaaatcagttatttttttagtttagttctcttcttttccgaggtacgttgcaagtcacctaaaacttttgagtatcttttttttccatttatacctgtaggggtacacactacttatttctacagcctaattaataggattgcagagagtttcagatataatatgcacagcaagtactttctaaattatagctttgtattaggttaaatatgcttatgagttattttatgtgatctataatataacaatgttagtataattttaccaattatatttgctgtattaaatatatattaactgttacattggtgattaatatcaattgataatataattctataatacatatattattaaaagttaataacaataaattattcctttcttactggaacaaaggaagaaatgtaataccctgaggaattttatttccaataagatacttccagtatagtcgtcccgatgaatgacagccttgtcattttcgttgtgatcaatctgctctgtgatcagtgaaacaccagcctgcttttctgcgaaagggtttcagatgatgaaacacttatgaacttgatgactctccctgaagagcagctgatgctgccgagtctaacacgtgcggtcctgggacgacaaacttgaagaatgatgctgtccacagggacccctcacagggctgtggtggcctccatgggagcagtcctgggggagtctctctggcctttgttgaatggtagggcctgattctatagacttttccaattgcctaactcctctaaccctccaaatgaaaacaagcatctactaatggcaaacagacttcaccagactgtttccttgaagacaacttcgctcacaggtcaaaccattgcatcatcttgccatgagggaaaagagtgaaacgaacctgaattagacaattgataacacatttaatagagtatattcttccatttatttattggttttcttagtaataactgtagaaaattttaaaactaagtattattataaaaaggagaaataacaacacatactataaaaagccaaagataactagagtttgaatttttcttgcttttaggcaggcattttcatgtgattttctttatagaattttgtatccatttgtctttgaaaatatgacattttaaaccaaagtgtttgcatttgagtgtccataaaatgtaaaacttatttgttatttctaatttcttatttatctcaaacaattgtgcataggaaactttttaattatgaaaatggacattcgtgattgatatcgctttgttaaatgtataaacccttttaactgaaattttcatcagaagatagggttattgctgaaaatttgaaaagcattgaataatgtaaataatacaaaataacattttttacttttaacccttagaagcaccaatttaggaataatgtaacatttccctccaggatgtgtttggagacaactgatatatccaaaaatttggtttttgcatttcaaacagaagattatagaatggcctttacactgtagcatatgactttgaaataattaatgtagaacattggctgagtaaacacattatatgacctccctgtgtcttaagtcttcagggtgtttttcacgttttgtaacatgagtgatatttcaataaacagttctctgttcaatgtgtttattttggtggaattacaaatttgaaattccaggtgtgatggtcagaggatctatacctcttagaacattccactaaatgactttccaaaatgtaaccactattaaaagttttatagttatggccgggagcggtagctcacgcctgtaatcccagcactttgggaggccaaggcgggtggatcacgaggtcaggagatcgagaccatcctgggtaacacagtgaaacaccgtctctactaaaaatattaaaaaattaaaaattagctgggcgtagtggcgggcgcctgtaatcccaactactcaggaggctgaggcaggagaatggtgtgaacctgggaggcgaggcctgcagtgagccgagatggcaccactgcactccagcctgggcgacagagcgagactctgtctggaaaagaaaaaaaattatagttatttatggtcccaaaacaacacattcgttataaaaaatttacaaatacaaacttcaaggaaggaataatctacagaaattgaatgtgccattgaatattctagtgttttatactaaaaagtgtatcaaacgtactttaccatgtgagtgttattaacatcagtccacctccaaaaagtgtgtgcatgtcacatgaggatacgttccaagcacacggaaagtgttcagtgattgatccaatcagtagtcatgcagagtaggtgctaataaacactaccccgagtgaggatgcagacacggagacgcaaagggcataggggaatttccccaagtcagacagatgagtaacagggcagctggactcaagacagactgataagtaacaggacagctggactcaagaacgtgcttctagaaccacaatgctgcactaactcctaattgcaattcctggtaacagctgaaggatcttctgattatattgtagtccgtatttagtagactttttagaaaataaacagacaaaaaatgcaaaagtcattagcgtacagctcaagtagtctttggaaactgaactcaccacagcctgcccacagatgcacaatcagaagtgagttagcccccacgtagacccccagcctgcatcccaataccctccccaaagaaactgtgactctgccttcctataaagtagttttgcctggatttgaaatttatgtaaatagagtcacaaaacatgcactctttcatgcctaccttcttttactaaacattatgtaagattcaagcacatttacaggtagttatgttggtggttttttcattcttactctgtattgtatgctctaagaacaaagaacaatttgtttattttgttgttcatggcaacttgttttctatctatggctattataaataataccctgtgatcatttttaatttgaaattcacaacttaagaagagataatcagcacacctttacatccactaataacacacagattgcatagtacaagctaaaaggataacgcaaaaaaacaataccacagctaaactgaccattttgacttttattaattggagaaatttattgtaaatcatttaagttttataaaactatatacttttaaaaatatatattaaccactacaaaaaatttattcagtaaaatatttcacctacattttaaaacatgtattttggtaaacacatgtttgcatttctgttgcatatataaccaggagtgggatatctgggtcatagatgggcacatattcagctctatcagatactatcaaactgttttccagaggttttatcaatttatagtctcattagcagttattttaatcatcataaccacactgacagatgtgctatttcattgtggttttaaagtgtcattttttgacaactagccaagttgaaaaccttttcatacatttattggaatgtacattttgtacatttattggaataatttattggaatcatggctatcatatttgtaaattcccattctagtcttttgccatttttaagtggattttctgcttctttattgatttgtaggaatttcttctatgtgttctatatgaatccttcatacatatatctatttataaatatttccttgttttctatgggttgcttttttacaatattaattttttaaaataaattttaatttaatgaagtccaacttactatgttttcctttagtgttagcacttttgttttctgtttaagaaatacttgcttacctcatcattataatgtgttgttctatattttcttctaagagattattttaccttttatatttcaatctatacagcccatctgaaatatattttcttatcctgtagtgtagggatcaatattcattttttccatgtggattgtgcagtggagtcagaactattaaaagcatcctgcatttcccactctgagtggttgccctggtcataaatccaatgtacatgtaggtgttgatccatttctaggctttattttctgttccatctgttcatttgacaatttgcacagataccatgccgtataaattggtatagttttaaagtaaagcacatggaaattggctgccaccagcaaggaatggtggtatctgtgagaggagttgacatttgaagagtaactcccagggctttgtttgagagtgctaatttagaagagtacaaagaatggctggaaataatgtgttaatatccaccactgggagcactaacttggctgactcttccattttcaatgctaaaatttactgaaacctccaaggaaaactcatacttcacattttgaagaataaatgcctcagatggaagagagtgatattgattcaagaacctggaaaacaaaaacttataagaggcatgaagactattaatataatggaagtctttgttatgaagataaagttgtcttggaaaatcacatgaaacaataaaaagtgttattaatatggaaattaaaatgtgctgtgtgaaggagtcagtggatgaatttgaaggtttggattctccggaatttgaaaatttattcatggtcttgaactttagggtttcacttttaatgacctgtgcaaggctgagtgtagagttagtgcagcaccagttgtattcaattgttcacataaaggaatgaatgttctaaaagcagtgacaacccagtagcaatgaatgagcacacggagtgcctagatcttggtttctaaatgctaatggtagtttgtatttctgtgggatcagtggtgatatcccgtttatcatttttcattgtgtctatttgactcttctctcttctttattagtctagctagtggtccatctattttgttaatcttttaaaaaaaaaacccagttcctggattcattgattttctgaagggattttcgtgtttctatttcattcagtcttgctctcatcttagtcatttcttgtcttctgctagcttttgagtttgctcttgctcctctagttctattaattgtgatgttagggtgtcaattttagatctttccagctttctgttatgggcctttagtgttataaatttccctcttaacagtgcttgagctgtgtgtcctagagattctggtatgttgtgttttgtgctcatttggtttcagataaattatttctgccttaattttgttactcagtcattcaagaacaggttgttcagtttccatgtagttgtgcggttttgagtgagtttcttaatcctgagttctaatttgatagtactgcgatttgagagacggttacggtttccattcttttggaattgctggggagtgttttacatccagttatgtggccaattttagcatacatgctatgtggcactgagaatgtatgttctgttcatttggggtggagagtcctgtaggtgtctgttcagtccgcttggtccagcctctcttaccactcctattcaacatagtattggatgttctggccagagcaatcacgcaagagaaataaaggtattcaaataggaagagagaaagtcaaattttctgtttgcagaggacatgattgtatatttagaaaaccccatcgactcacccccagaactcaagctgataagcaacttcagcaaagtctcaggatacaaaatcaatgtgcaaaaatcacaagcaatcctgtacaccaacaatagacaagccaagaacaaaatcatgagtgaaccccattcacaattgctacaaagaataaaatacctagcaatacaatttacaagggatatgaagggcctcttcaaggagaactacaaaccactacttaaggaaataagagacaacacaaacaaatggaaaaacattccatgctcatggataggaacaattaatatcgtgaaaatggccatactgcccaaagtaattttagatccaatgcaattcccatcaagctactaatgactttcttcacagaattaggaaactatttgaaatttcatatagaaccaaaaaagagccagtagagccaaaacaatcctaagcaaaaagaagctgggggcatcacactacctaaattcaaactatactacaaggctacagtgaccaaaacagcatggtacctgtaccaaaaacagatatatagaccaatggaacagaacagagacctcagcaataacaccacatatctactaccatctgttctttgataaacctgatacaaacaagcaatgggacaaggattccctatttagtaagtggtgctgggaaaactggctagccatatgcagaaaactgaaactggacccattccttacacattatacaaaaattaactcaagatacatttaaatctttaacttaaaacccaaaaccataaaaaccctagaagaaaacctagtaataccattcaggacacagggatggacaaggacttcatgactaaaacaccaaaagcaattgcaacaaagccaaaatcaacaaatgggatttaattaaactaaagagcttctgcacagcaaaagaaactatcaccagagtgaacaagagacctacagaatgggggaaaatttttgcaagctacccatctgacaaaggtcttgtatccagaatctacaagaaagttaaacagatttacaagaaaaaacaatcccatcaaaaagtgggtgaagggtatgaacagacacttctcaaaagacatttatgtggctattaaacatggaaaaaagctcatcactggtcattagagaaatgcaaatcaaaaccacgatgagataccatctcacgccagttggaatggtgattattaaaaagtcaggaaacaacagatgctggcaaggctgtggaaaaatagaaatgcttttacactgttggtggaagtgtaaattagttcagtcattgtggaagatagtgtggaattcctcaaggatctagaaccagaaataccatttgacccagcaatctaattgctaggtatatacccaaaggattagaaatcattctactataaagacacattcacacatatgtttattgcagcactatttacaacagcaaagacttgggaccaaccaaaatgcccatcaatgatggattggataaagaaaatgtggcacatacacaccctggaatactatgcagccatgagttcatgtccttcgcagggacatggatgaagctggaagccatcattctcagcaaactaacacagaaacagaaaaccaaacaccgcatgttctcacccgtaagtgggagttgaacagtgagaacacatggacacagtgaggggagcatcacacactggggcctgttgggtggtggtgggggaaggggagggagagcattaggaaaaatacctaatgcatgtggggcttgaaacctggatgatgggttaatgggtgcagcaaatcaccatggcacattatacctatattatacctgtgtaacaaacctgcacattctacacatgtatcccagaacttaaagtaaaatttaaaaaagctctagagtctttgtgtggtgttaaaccatatctctaaacaaaatgatactaaacaaaatttaaaaatactaatatgtgtgatttgttgtttgcaactttctctcgtgttcatactcccaacgtgggtaaattcaggttgctaatatgatgtcactgaccacacagttgggaaaggatatgaataatcatatctcaccagctagtgcaagctggccccagcacaacactgcagaaatgttagaacagagactacttccaggaggagaaaataaggagggttaacaggacaaaataataggaataaatttctgaggtgagaaatgacacctgtctcaaatccaaaaggtatggtatagatactaaactgggtaaatgaacccaacatttttattttattattattactttatatttttgagacagtcttgctctgtcacttaggctggagtgcagtcgcacgatctcactgcaacctctgcctcctgggtttaagcgattatccttcctcagcctctgaagtagctggcattacaggctgtgccaccacgtccagctaatttttgtattttagtagaaacttggtttcaccatgttggccaggctgttcttgaattcctgacctcaagcgatccaccccgccttggcctcccaaaatgctgggattacaggtgtgagccactgtgcctgaccaacagtagctgtttttttctgcttctctctttcctcccaccctccatcctctagtgggatccagtgtctgttgttcccctttgtgtcctcatcatttagctcccacttacaagtgagaacatgcaatatttggttttctgttcctgtgttagtttgctaagaatgatagcctccaacttcgtccatgtttctgcaaacaacatgatctcattcttttcatgactgcatagtatcgcatgatatatatgtatcacattttctttatccagtctaccattgatgggcgtttaggtcgactctatgtctttgctattatgaacagtgctgttatgaacacatgcaagtatgtgtccttatgatagaacaatttatgttcttttgggtatataccaagtaatgagactgctgagtcgaatgctagttctgtctttatatctttgaggaattgccatagtgttattcacaatgattgaactaatttacactcccaccaccagtgcatatgttcccttttctctgcaatctcatcaacatgttattttttgactttttgataatagtcacgctgacaggtgtaagatggcttcccaatgtgggtttgattttcatttctctaatgatcacagatgttgagatttttctcatatgcttcttggccacaagaatatcttcttttgaaaagtgtctgtacatgtcctttgcctactttttaatttttttcttgtaaatttaagtttcctatagatactggacattagacctttgtcagatgcatagtttgtaaatattttctcccattctgtaagttgtctgtttattctgttgatagtttcttttgctgtgcagaagctccttagttagattccatttgtcagtttttgcttttggcatcttcatcatgaaatctttgcccattcttatatgctgaaaggtattgcctgggttgtcttctggggtttctagaggtttggattttgcatttaagtctttaattcatcttgagttgatttttgtaaatggtgtgaggaagtggtccagttctaatcttttgcatatgagtagccagttttcccagtaccatttattaaatagggagtcctctccccattgcttatgttttaagctttgtcaaagatcagatggttgttggtttgtggccttgcttccgagttctctattctgttgctctatgtgtctgttttttggacaagtgccatgctgtttggttactgtataatcttgatgtggtcccaaaatgggaggaagtgcaatatgctccacctggagagggagatggagaatgccaaagatttctggagaggtggactaaggcagaccctagagggcttggtagggacgataatcatttctaccacacagtgttgttaaaagattcagatgcaaaatctcccataaatcatagcaggaactacacaatccataaaaagcaacctagtaagatttcagtgagtaggctactaattaatcagtatgtttcccctaagccagcaaaaaccaattctaaaacagagtgagaagaaacctactccagaaagcgagcatagaaatacaggtctagaattaaaggttcacaacatgtgcaatatctgtggtgaagcatcatcacactcttcaaattggacaaagacagctggatggaagtctctacatggtacacaggtagatttcacttaaaatagtacaaaaatcccaatatgacctttatcaagctttgttgatttattattcttgttatgctggttctattgttcatacctcccaattctgtgagctgctgtacgaaaaataaagcgtctccgtgctaaaagaaaaaagccaaagaacaaggcggcctccacacttctaccatctaaatctcctcacgtgcacctcatcaatagaacctaaattactggtgaatctcagataccatggagtttgtatacatagattttagttttccagctttaccagtcaaaagacatatgaagaagttgggatgaaaacaagcaagccaactacagtatcctcggcttctgcaacacacatttaggttttgcctttacttcaataccctttctctttcaataggtctgtccgttcaatttatgcaaattatgcaatttcaatttatggaaattagaaatggttggtctcttttctgacaccttatttttgctatgcttccttttttaactttttatttctccccatgtatagttaattatgtgtttgtgtttgagagctcggtttttaaaattaaaattttttactttttcattttattcattttttccaacctcagaagagcacattgttcttttagatctttggattactcttatatttcaaataatatgctcaaatgtctagtttttccacaatctaattactatttaagtacatttacacatttgccactctctccaccatgcactcaattttagtttttcagttacattattcctcttaaaaccttttagcatatccctatactttaatcatataattatatccgtattaactgattcatcaagtataaattgtaaagaggttggtctgccaaggaaggtatggattttgtgaagatataaaagaaaataaaagacatgtaaatactggtagaaggagacatctttattagtcatttccacatccatctccccagtttctagatttttttatattgttatcacagtctatattgtctcagtttgttacatttctattttagtcataccttcatttacttattcatatagagtcattttctcatgtgtttttattaaatgcttttacatattatcaggaacctttccattatagtttctccaggcatcctttggtgggttaaggtttgtcctcaacctgttttattgtgatgtatatatgtggctattctacttttcctttctcttaaatcttaaagaatggctttgttttttaaaagatattccactaaaatattgttaagtattgctctattttttatcatttaatataaataaaattcaaagaccggcctaataccactatattgtgatattttgcctagatttcctagtaattctaacttagacacacacagtaccatatttttgtgggacatatctggatatagaaaatactatatcacattttgaaaaagtatctgcatgtacattttcattctaatcatttacatgtatttttcaaccacaatatttatgtttgaccctttttgttggtttccaaatccactgacactttttaacctctctctttattttcctcaggatttttaagcctctttttctggtccttcattatttttaagctgtttctcttcatttgttaacatatttttattttacttttatcttctatttattctctaacatctgtcacctcagtattgatttctgtttttgctttataccgattcctttgaccctcatgtagcatttgaattctattacaaagaaatatcagatttcatttcaactttatttcaagggaaccaacttttcataattttggtagatattatgttgtatgttttctattttgctttagctttctttttacttttgatatatgatgttgcctaaaacgaaatatttaagtaaatgtatttccattcctagctacctatgtgttttaggcagatatgagttttgaaatgtatttgaaaccttttggatcctttatatatgctacatagctttcataggacaccaagcgacgcaatgttttacagccttgtcttgtatattctgtcctatccattgttacatgtctgagaccaaatttggctgtttttatcatttctcttaaacatcagaacctcatctccatcatttttctgtaaaccttgctttgaattcttcagtctctcctatctttagttatctaataacacatgcaatttaattcagactgataaaggatattgtcttaaatctttctgcctctcttttgtccttactgtgcccccagtgaccagcataggaatgggcacaaagcaggcacctgactgtggagtgaataaaccaatgcctggcaacatttagaatttataatcggcaaatccactacttaattatattgagaggattaatttaaaacaatcaacttgaaaacagttaaaatggtagctcagttcatttactgaaaacaaaggaagcattttaaacaattctcttggtcttcgtaacctttcgggactagccccctaattacctgcaagaatagaagagcccagggacctcctgagaagcccagtttcctccgtgttccttatgctttttcccttcgtggaaaaaagtgattgcacctttctttccatttcctaattctacatcatgccttgtatttagctggagactcactcagagtgggagagcctgagagaagagctggagacaagcaaggtctgcaggggattccagggcaggccggcccatgacctggccagccctgccatgacctgctttcccacccaggtaagctgcttacacttccgaggtgaaactattagaaaattaagaaaaaaaaattagacgtgtgtaaatttaggaggcacaacatttccctggagttgaagggaactatactaagttctacagaacttgagtatttgaagatgcttaaattatcattgtgctctattcagccacaaggatcttgtgctataaatttatcgtagaatttgctgttaaaacacacccacactaaagaagccaccacattactctatttgtgacttttgttgcagaaatattactatacatttatttttcatatttcagctgtgaatttttaaaatcacattcaaaggcatgaagagttaggtagtgaattgtttactaaagtgtcattttaaaagaaattcaaaagtttgttttacaagtttaaacatttcatgtatactaatcagggtcagccttaatgaagctatggtctacttagaatcgaaacctgcatattaagctattaaatgttactcaacaaagtcactgaaaatttctagtgccataatctgatgaaaacagaaaagttatttctcctcaatagattgtcaatggttatggtaaaaaattaaccagtgaaatgtgtggttccttggcacgactgcaacacaattctgggaaaatactacaagtctcaaactttccattgtgattcactgaactaaggaagcattactcagtaaattattatgaaaatttagtaaaaagttaggtgaaactaggtcctgttatcacattaatttaaaatatcaaatcgattaaaggtttacatgtggaaaataaaaatataaaacaagacacatgaatgggtaaagatttagctaaacggtgagcaaaggcaatgaagaaaacatggaaagtaaaattagtatttgaaaactgaaaacaatctctgaataaaacaaattttttctaattaggaaatttatggttcacatgacgaatcaaaggctgaggatcggtaatgtgtaagattctcttgcatattcataagacagacatggcaatttttaaaatgacacaaacatgttagtaaacaatttgtggaagacttgtacatacaaaataagacaatgacaaaaagcacaaaaatgtccattaatttgttgaataacagagaggcaaaaaaatgtgtgattatcagtgttgctgtgagtcagtgaaaacaccagtgcggccttttgtggtatgccggggtagatcactgacgggtacaacccgagtatatgaacatgaaagggacactgtttaataaaaatgtaataaccgatacaataaaggaattccttacacagatattcattatagtattgttttagattagtaaaaaattggaagaaatctacattggaaataagaaaactcagattctgttattaaggtaaattgtgaagttatattcaaaacaatatttttaaaaagtaaacactgaaaatatgtacacaagaatatttatgcagatgtagagctatatacagcatgattctaatctatagtattttaatatatctatgtatctatatattaaaaatatcattttctcccacaaaaaataagtatgtgagatggatatgttaattatcatgacatggtcattccacaatgtgtacatgtattgaaatatctcactgtacccaaatatatatacaattgtcaattaaaaacaattttcaaaatcctattttgaaaatttttattctgacttgatcattatacaatgtatatatgtgtcaaaacatcaccccataccccataaaaatatacaattgttatgagtcgattaaaaacaaaataaactaaaatttttacaaagaaaaaattttatagtaaatgtggtaggatttattttatacctttatttctccttttagttccatctatgtcttaaattatgtatagcactcacagatgtatttatagagtgaaaaagatgttttaaaaagataatatagttttaatcataagaaattattgacatgaattttttttgtcaccacgcagggccccctggtttgggcccaaacacagctgccccactctgggctgaccacacctattggtagcagctctgcatttctctgggatggggcccaagaaacatgtgaaaggccctcttccacaacactgccaggaccctgctcacactgcctccaggctgaggggaacataaagcctgagtcaccccagaggtgtggcctgtagcccaggagtaccaagctgagatctacagccagcactaaaggaggaagaggagcccacactttcagagcactgagagggagcaagcctgcaattgtgagaaaataggcccttgttcagccccacggctcctctatctaccggccattatgcttaagcaccatctactggatcacagcccaaacttcgacaccaaaaatactctaatatacctccccatgaaaccaaggccaagaactcagctatgagtaaagaccctgcacaaagccttgggccctctgaaaacatccagaagtcaactgactgtactcaagttacaccacagtgaaggggacatgagcccacacagatgagaaggaaccagtgcaagaactctggcaactcaaaaagccagagcatcttttctccaaacaaatgcactagctcccccaactagggttcttaagtagtctaaaatggttgaaatgacagaaataggattcagaatatagataggaatgaagaccatcaagattcgggagagagttgaaacccaatccaaagaatctaaggattacaataaaataatacaggagtgatcgatgaaatggccattataagaaccaaactgatctgtgagagctggaaaacacactacaagaatttcttaatacagttacaaatattaatagcagataggactaagctgaagaaaatctcagagcttgaagatgtactctaaactcagaaaaaattaaaaattaaaaagagtgaagaaaacatctgagaaatatggaattatgtaaagagaccaaatctatgatttatatggtatctctgaaacagagcgggagaagacaagcaatttaggagacacatttcaggaaattgtccatgaaaatttccccgatgttgttagagaggccaatattcaaattgagagcactgagagagaacacatttggtctcccctgtgagccctttgtcctcttgctcatcaccaggaagggcccccctggtttaggcccatgacacagctgtaacactctggatcaatcacacctattggtagcagctctgcatttctccatattcatgtggggtaaagtgtggttggtcggaggaaggtagacactctggcaactcaaaaagccagagttcttgcactggtttgttctcatctgtgtgggctcatatccctttaactgtggtgtaatttgagtacaattaacttttttctgcaagacacaacacaagaagtccatcactaagatacatagtcatcagattctcgaagatggaaaacaagaaaaatgttaaaggcagctagagaaatggggcaggtcacctacaaaggaaaccccataagctaacagcagatcctttagcagaaactctacaaaccagaagaggttgggggcctatgttcagcattcctaaagaaaagaattttcaaccacgtatttcatatccagccaaaggaagcttcataagcaaaggaaaaataagattcttttcagacaatgctaagggagttccttacaaccagacctgccttacaagaggtcctgaaaggagtgttaaatgtggaaagaaaagaccattaccagtcactaccaaaacacacttaaatacatagaccattgacactataaagcaaccacacaaacaagcctgcaaacaaacaaaaaaacacctaggaataggatgacaggatcaaatctacacatatcaatgttaatcttgaatgtaaacaagctaactgcctcaaagggcacagagtgggaagctggataaagaagattcaaaggtatgctgtcatcaaaagacccatttaacatgcaatgacaccaataggctcaaagtaaagggatggaaaaaaatctaccaagcaaatggaaacaaagaagcaagggtttcgattctagtttcaggcaaaacagacttcaaaccagcaaaggtcacaaaagacaaagatggccataatataatgctacaggtttccattcaacaagatctaactatcctagctatctatgcatacaacacagaagcacccaggttcatgaagcaagttcttaaagacctacaaagatactcagactcccatacaataataatgggagatttcagcatcccactgacagtattgaggcaaaaagctaacaaagagacttgagacctaaactcaacacttggccaaatggacctaatagacatcttcagaactctgaaccccaaaacagaatatacattcttctcacgtgtacacagcatatactccaaaattgaccaatcggacacaaaacaatcctcagcaacttaattataccaaccatattcttggaccacagtgcaataaatagagatcaatactaagaaaatcactcaaaacaaagttatatgaaaattaaatatgctaatggtgacctttttgtagacaacaaaattaaggcagaaatcaagaaattatttgaaactaatgagaacaaaggtaaaatataccagaatctctaggatgtagctaaagaagtgttgaggagtctgcaacactaaatatccacatgaaaaagtcagaaagacctaaaattaacaacctaacatcacacacttagaactagagaaacaaaagcaaaccaactccaaaactagcaaagaactaatcaaaatcagagcttaatgggaggaaattgagatgtgaaaaaccatacgaaagatcaacgaatccaggagttggtatttgaaaaacataaagagacaaatagaccactagatagactaagaaaaaagagaagctacaaataagtacaatcaggattgtcaaagagttcattaccagcaacctgacagaaacaccaaccaaagaaaaccctcagactactatgaacagctttatgctagagaatctagaagaaatcaatgaattcctggacacatacaacctctcaacattgaatcaggatgaaacagaatccctgaacagaccattaaaaagttctgaaattaaattcacaatagaaagcctgccaactacaaaaagtccaggaccagacagattcataactaaattctgcaagaggtacaaagaagagctcatatcattcctacagaaagtattccaaataattgaggagagacccctccctaacttattctataaggccagcatcatcctgatctcaaaacctggcagagacacacacacaaaaagaaaaacttcaggccagtatctttgattaacagatgcaaaaatcttcaacaaaatacaaatagaatctaacagcacatcaaaaagtttatccaccgtgaccaaagtaggattcatccctgggatgcaaggttggttcaacatcacatcacatagaattaaaaacaaaaaccaaatgattatctcaatgattcagaaaaggcttttgataaattttaactcccatgttaaaaactctcaattaaactagtcattgaagaaatatacctcaaaataacaaatgccttctatgaaaactccacagtgatcatactgaatgtgcaaaagctggaagcatttcccttaaaaaccagcacaagaaaaggatgccctctctcaccactcctattcaacatagtattggaagttctggccagagcaatcagcaagagaaggaaataaaagacatccaaataggaagaaaaaaacctcaaactatccctgcttgcagacaacatgatactatatctagtaaaccacatggtctctgtcccaaagctccttgatctgataaacaacttcagcaaagtttcaggatataaaatcaaggtacaaaactcagtagccttcctatgcactaacattcatgctgagagccaaatcaagaatgcaatctccttcataatagccacgaaaataaaatatctaggaatacagctaactggaggtgaaagatctctacaatgaaagttacaaaacactgctcaaagaaatgagagatgaaacaaatggaaaagcattacatgctcacgaataggaagaatcaataccatgaaaatggtcatcctgcccaaggcaatttccagattcagtgctattcacatataaaactacctatggaattcttcacagaattagaaaaaaatattttaaaattcacatggaaccaaaaaagagcccaaatagccaaggcaattctaagcaaaagaacaaagctggaggcatcacactacccaactttaaatcatgcaacagagctacagtaaccaaaacagcacagtactggtacaaaaacagatatatagaccaatgggacaaagtagagagcccagaaataatgacacacacctaaaaccatctgatcttcaacaaggtgaacaaaaacaagcaatagggaaagaactccgtgttcagtaaatgttgctaaaataactgtatagccgtaatgcaaaagattgaaactggaccccttccttatactacatagaaaagtcaactcaagattgattaaacccttaactgtaaaacctaaaaccataaaacatctggaaaataacctaagaaatatcattctagacataggacccagaaaagattttacggtgaagatggcaatagcaaggtcaagcaaggtcaacaaaagtgaaaactgacaaatgggatctaattagactaaacagcttttgcacagtgggcaaaggatattaacagatacttttccaaaaatgacttacatgcaggcaacaaggatataaaaaatgctcaatatcactaaccattagagaagtccaaatgaaaaccacaatgagataccatctcacacctgtcagtgtgtctattactaaaaagtaaaaaaataacagatactggttaggttgcagagaatagggaatgcttatacactcctgttgggaatgtaaattagttcagccattgtgaaagtagtttggcaatttctgaaagaacgtagaattaccttttgacccaaaggaatataaatcattctaccatgaagtcacacacacacacatatgttcttcacagcatcgttcataatagccaagaaatggaatcaacctaaatgcacatcaatggtagactgaatcaagaaaatactgtacatatacatcatggaatacatgcagccagaaaaaacaagatcttgttttttgtggcaatgttgatggagctagaggccactatactaagtaaactaacacaaacagaaaaccaaataccacatattttcacttatgagtgggagctaaacagagtacctatggacacaaagaataacagacccccccaccgggcctacttgagggtgtagggaggaaagtgaggactgaaaacctacctatcaggaactatgcttatcacttgggtggtgaaataatcagtgacatgcaacttacctatataacaaacctgcacatgtacccctcaacctgaaataaaagttggaaaaaaaactttaaaaaagagagaacgtctcaaggacaaatgctgttagaataaaactaccaatcccgaattgtaaacccagctatactatcattcaaaagtaagggtagttagacaggagaaataagtttagatctattgtataacatgatgattacagtttatatctacgtattatatatttattttcaaattgctagattttaaatactccaccactcaaaaattataggatgtgaagtaattgatatgttgattagcttgattttgtctttccaaaatgtgtatatatgtatatacatattaaaacattgggttgtacaccatatatacaattgtcaattaaaatataaacttaaaaatttgaaagaaaatggtaataaaaaattaaaaggattaaattaacaaaagatattttcaggccttttttgaaacataagtgtttaccactcagtgaagggactcttatgtttaaagcataaatacagaagaatcaagatgttgggagaaaaaacagcaacaaagttttggaagctggaaagccaaaggaaactgtttttgactcaaaaatctcaaagcagaacactgagctggtgagtggagaagttcggaagcaagttgattcctgctggaagaactcctaatcaggtctgtctaaatattacaggtaacattgaaatgggaggcttggctaaaagtttgtataaaaactgttatacacgcactttagttagacaacccttcctccccgacctgacgcgacactaacttgggaggtggtggtgtacccaaagggctctgggattggaaaacagacattgcgtgggtgtaagtgggaagtctgcaccctacattgtgaagcacaccagcacgtttccccaacgtgggttctcagaatgctggcagcccccagaaagatttgcagaggaagcagaccataccaaagaaaatacctaggaatactgacatttgaggtttccaaaataagtcatttacatcatagtttagtgactcctactcgttaaggcttgtccttatccagagactaacattaggagagagacagggattacaaaacttgaggaaagcttctaaaataaaaggcagaaatcacacaaatcagtgaaaataagaagaaatacagtatgcagtaattagagaaactctttctataaaagataactgactaatctgctatgacagataagaacatacaaacagatattaaactagaacagggtgttttaaacagagcattggagaaatttttaagagttcttgaacatttagattatggcagtgtagactgtaaagtaggacaagacagatgcaaaagaaggtagaagaagagatccagtttgtgagtcaggaggcaaatcaagtaataaaaattccagaggaaaagaatgttttagatggaaggaaagcacatatttcagtcatgtttcagagcaaaaattctggaattgaaagacacgtttcaagattaaaaggttcatcaattgcccaacataattgttaaaaagagcccttatgaagacattatgaatgtttaacacgactgccaaaggagagcctgaagcctccaggggacgacaacacaactaaaattgagagcatggaactcccaggagaaatactgaatgttagaagacaatggaggagggacatcctcatattcatgagggaaagcttttttcaacctacacattgacacctggccagatctactgtcaaagtgggaggataaaaaaagtcattttcaaacatgcaaggcctttaaaaaatttcctcccacgtactttgtttataaacctgttgaaagacatgctccacaatggggaggttttaaagtagaagacgtggtacacagacaatcaagaatccagagggtcatggggaagaggcagcatctcaggaggagccccgtgcagcgcagcccatctctggggcaagcagcctggatggaagcggcagagcaggggctgcagaagagggagggctgtgaagacggcaccgagaattcctgagggagtcacagtttcaacaggatatttatcagaaggagattctatatacatatatatatatacacacacacatacacatatatatagagattagtcagttttctttcatgtatacatatatatgtatatatacacacacacccatatatatgtatatacaaatacatatatctcctagctactggggaggctgaggtgggaggattgctagagaccaggagctcaatctctttcttgacccagctggtcaagaatgattaccaaccctcaaaacctgtcctgtccccactcagtcaccaaagtgattgtgactctgacttctgacatggtattctatcagtgtcaatcttccatctctgctctttagacctatctgcctctcagagcatgctcacaggagactgaaccacacaacctgcttgtgccccttagagtcctcttgtagcccagcttgccctctgcacttgctcttctgcatatcactgatggcagctagttttgggaccttgttcaccaagtcaggttttgagaggtgaagtcaaattttgttcataactactctaggctcttcattaatggctgggactctggaaataagctcattctgatggaaaggctaataaggaatctgttttctttttaaaaattcttttaatcttcccatttttgtgtcttttctctttactggtatttgaaatgcacatctttgtaaccaggtcacaagaatgattttgcttggattgtttggtggcctcagacatagggttcagaagcatctttcaatgtcattatctttttatcagatcttgaattgcttatttgttgtttgtgtatgtttatgtccatgggcactaatatgggttcttctcactacaaaaatcagggtccccttcctaaaattccggctaaatactaaagggttttaaaccaaaagtaaaattctaagcctccctcaaccatctgaatagggccctcgtctcagcaaaggcattccaaagttaacctgataaactagttcaggccatgataggaaggaagagcttgacatgcctcaggataccctccctcccttttggaattactgatagaacagattctttaagacttaagtctaattaaaaaacatttacaatcttctctctgaagcctgcttgttggaggcctcatctacaagatcaagtcttggtctccacaaacccttaccataaccagacatttctttctactgataaacaactctttcagctaattgccaatcagaaaatctttgaatctgcctctgacttagaaactcctgcttccaattgttgtgtgtttccaggtcaaaccactgtacatcttatacatgttgactgatgtcttatgtctccctaaaatgcgtaacaccaagttgtccggccacctcagacccgtgtttctcaggatcttctgagggtggttccatgggccattggtcactcatttggctcagaataaatcttaaaatacagggtttgacttttcatcgacagggtatacaatttatataattttcaatgaatagtaaaaattaaactgtagtatttaggaatatttatccagtcatgcaagaagaaatccagggaataattactatgaaattcatttggcaaaataactgaccaatattcttcgctgtcaaggcccaactaaagaaatgttagaaacttaactgaaatgagtgagaattgctcagtcaagtttcattaagccaatattagagtatgtctagaaaaataagccacagacacacccatggccatttttccaaagaggtttttagaacactcagtacgtatatattttcttaaggtgggggaaggcatataggaagacgggcgggttggtggtaaggtcaatggttacgtttctgtgagacttcagttagtgcccagtaaatgtacattttacacaggataaggtgaatgtctgaagagatagaaggagccaaggaagagtcaattatgcagaagtccctgggtaggtggaggaatgatttgtctcatccggtctttcttctgctcctggaaagaagcttgtcatcaacattatcagtgtgcaattgagcagacagaagagttcaagaccagcctggccaatatggtgaaaccctgtctctactaaaaatacaaaaaattagccaggcatggtggtgggtgcctgtaatcccagctacttgagaggctgtggcaggagaatcacttgaacccaggaggggaggttacactgagctgagatcatgccattgcactccagcgtgggcagcaagagcaaaactgtttcaaaataatgtcagcattaagagaaattgagtgacggccacattggaagctcattgtgctaattttgcacatttttgcatgtctaatagttcaaatgaaagttagagacatttagaataatgcctgtttttgccctggggcatgtgcggtgatcaaacaagagcgccctggagtgctggttatgttccgtttcttgatggggtgcggggttatttcatgaatggtttcacaactgttttcttgagatgattaataatgagttttgcatggcatttctagtgttatatttcatagtataagaagagattaacgctgatttataatgtgattttcttagaagccctgctgttgcctgcgtcattaagtggtgattcaattcactccctaaaattacaaagtggctggaattaaatatccccaagcaaagacttctttcctctatgttgtagcaaattcagtaacttttcaagttttaccaaataaagtgagggatattaactataatatttaaagctattaaattctatctataattacagaaatatatatggagaaacaaactttttggcaaattatttggcaataaataatcatagattcaaggtttttatacaattcattgtattttttccaattgattctggagggattacagagtaaaaataactgctaaaatgcagaaaatgtttaataacaaaaatgatgtcaccatcagtccaaaggtaccgatattattcatttttttttttttattctcctaatgatacatgcagttttaaagaatagagaacacatggtgttgttttaggataatgtcatattactaactggccacaaggtgtcaggaggaggatgtcatggtgtcccatagtaacaatcacttgggacttcatattcatgtatagatttcttcttcctgtacagatagatcagcaagccaagagaaagtggggagatatataaccatcttagacgcaatcgcaaatgtctcagtgcagtacctgaggtagaagctattcaacgaatcaaggaactcctgatgagagctttgcccagggaacccacagaagacggcttggctagatcactcaggcagagcccccatggcctgaaggagcaacagttgtaggcttagaaaatatctgctctaagaagcctcttcctcattcttcaactatgatagactctgagcaagatagtaaactatggcacagagaggttaggtaacatgctcagggcacacagcccagaaagaaataggctaatattcagactccagggggttcaagctccaagcatatggccttatcacccttaaattgcctttgaaattggcagatggggtggaaataattaaagaacagttaaatattcatggggaaaaaaccttataaaaagctgttcaacatctgaacaatctgttgctgggcatatatgctggtatcacacagtattttagtgaaatctgtgtgcccatctcctcttggtgccaactacaactaggacactcagagcagggacattttcccacgctaaatgggaacccatcaccagagaagccaccaccaaagccaagattacagagagaatgttttaggagtagggtggaatttaacttctaaacgtaaataattaacattttgaaatgaagtgacagtgtcaccttataatgcaaaatcatgccatattatacaagaaactccacaccatgaagaattctgcctatacaacttttaattgcccaaagagacaaatttattgaaataaacagctactgaacatctattacatactgcaaattatatgccttggaaaagcataaatatgacacactttattcacaaaggaataagtttgtagtagtaacagcagttgctgctgttattttgtccttgtttttaacataattctagttaacatattgagtgcctactattttctggccaccatcccgaacacacatcatgaatcgtctgacaaatgtgctgtgctaaattcataaattcaatgcaaaggagggggagtccgaaggttgtcctacaacccagatgtctctactagcttattaacttacctcttctccaagatgattctcttctcctctcaaacttttgacgggaccaccctgatctttactcatagacgctctcattgattctaactgcaccgagaagatacaaaccatcggaagggatcttagttataacacacgctctgcctgacctcctgctattgtcactgagttggccatgctcttacaaaagttcaaactctccacttctaaactggtttctgtgctttcggccactctcaaaggccatctttctgaaactttcctccatttctcatatatcgattttctttttgtactgaattattcctttgaacttcatactcaatatcacatgacagcaccattaacatcaaacacattggtatcacgtttttctagttatactccatttcctttacaaaaaaatctaaaaattcatactcaacttaccttatccacttcctcccccttgattttaccctgaatcatctctaagcatatctccattaaaaatggtcactaaggttacaagtaacctttcatgttgctaaatacagtaaccaaatctcacttatttcaaccatagactgcacttgttgcagttgcttttactttctttaaacactttgtcttagatttcttctaacctcataaaaccctatctttctaatttttcatgtgacgccagctgcctcagatctcagtctcaagctttctcttaagaaaactctcaaaaaacctgtttttaaatgctcttcgtactctgattattaaatgtatgctttatgttcagaactctaatctgaagtacaattgactttacatatagcttcaatatctttctgtatttatgtatttatcttgagacaaggcctctctgccagtcaggctggagcacagtggtgccatcacggctcactgcagcctcaacttctcagcctcccgtgatcctcccacctcagcctcccaagtagctgggactacaggcatgtgccaccacatccaactgatatttgtgtttttggtagatggggttttgctatgttggcaggctggtctcaaactcctgagctcaagcaatccaccctccttggtctccactaaagtgctgggagtacaggtatgagctactgcacccggcctagcttaaatacctaatagatatttccaaattatcttaagtgaattcttgacttctgctaccgacaagttttccaaatatcaatattccatttttttattcacttgggcccaaaccaataagttatccttcactctacacctgttgctaacacacgccaaatccatgagccaaatcctttgtgtccacaccctacacaagccatccttgtttctcatctctgaaacctcaattgtcttcctgtatccatgtttgccctttgttctattttcctacactgtaggcatagtgatgctttaaaaacgtgtctgttatcatgtaacacccgcatggaaaactccagggacttcccaccccactcagtcagtctcaaagtgccttaagtgttgctgttgaatcacagaacttggaaaagggaagtttctggccatggatgttaacgaacctggtatcctgttaatacatcctcaaggaaagtggcagtcatgttctttgatgctaagtgttagagtctattccctgtgagtagctgtgtcatgctgaacctccacccattcatactcagttctgttcaattcaccaccatttattgtggcctagtatttgatagctgctgtctgtactcaagagggtcagagattcaacgataatattagagcttatagttacttggggttaatactaaaataaaaaacacgactaaagtgtgtgcttttatcttctttgccacttgtgtattggcattcttttactctattgctgctaatcacagaatttgactgtaaacatttgatagcttttgcaggtttctttcattgtgttgtttaaacatgaacaaatgttgtgaaggagatctagttcagagtgaaaggttgctgtgaactctaatatttggggtttttcttccctaaataaaaagactagataaattatttaacttcataataaaccatttttgatacttcactgaaagatctctgcataacagtaaaacatctttcccttgctcccgaggagcaagaatccagacagggtgaatcatcttaactgccagtagtaagtgtaggttgatagctgagcagatcatctccagggaaacagggcaaatggaggaagtccttaggaagccttatcctctgggcagtgactctctaagcatcacttgttgctactttctgagcagatgagcaacatgcaaatacctttttaaatgcccctatgacgtccttgtttctgaggctgtagatgagaggattaagcatgggcgtgacaatggtatagaaggctgacactactttgtcctgctcgggggtgtggaaggactggggcagcacgtatgtgtagaaggcagccccatagaagatgctaactacagtcaagtgggaggaacaagtggtgaaggcctttttgcgaccttcagcagagggcatgcggtggatggttaacaagatgagggagtaggaagtggagatgatagagatggggatgagcaacatgaggacacagcagatgtacatcagagtttcatacaaggacgtgtctgcacaggccagtttcagaactgctgggatctcacagaaaaaatggttgatacttcgggagccacagtaagggacattcatggtgatgggagtgagcagaaagccatcgagggagcccccaaaccaggcaccagcagccagcaaaagacacttcttgcggttcatcaggactgggtatctcagagggttacagacagccacgtagcagtcataggccatgaggcccaggaggaagaactcagaaccaatcatggtcaggtagaggaagatctggatgccacaggccacaaaggaaatgatcttctctttagaaaccatgtctgccaggagttttgggacagtggtacagatgaaaagggtgtccatgatggacagctgactgagcagaaagtacatgggggtgtggaggcgagagtccacctgaatcaagaatatcatgaccaaatttgcagtcacggcccccaagaaaacagcaaggatcactgtaaatacaatcccggcagcctcactgttcaccagaagccccaggagggtgaagtcagaggatgatgtgttcgtcattgatatggcccacgagcgtcccagggcaacgggaagacacaaggaccaggaaggaggcaagagaacacggtcaagatgggaaaggtctgcagtagaggtgacacttctgagggtaccgtcaggatgaagcttccaggctagaggctagagaagaacaggcagaccaacatgcacatcatgaagcaaaaaccatggctgcatttccctgtcagagaacagctccttctatattgcgtctatggttcatcatgctgctggaggttatggtaactgcgtgatacaattgctgtatgctacaccaagaatggggttttaaccatatctgttctgtccatgctgcatttcttgtatccagaaagttatccagcccatagtagggttaagtaaatactagttggaaaaaagggtgattcattgaccaaatggataaaggggagtgaagtaaatcactgaagaaatgaagggttaggataactattagggaacgttttattcacgaagccccatgtttctgttctatttctttttaattatttgtataagtttaaggacgacaagtgcagtgtcatgacatggatgtatcgcatagtggagtcttgtcttttagggtaaccgtaagtcaaatagcgtaggttgtgctcacattactaatttctcacccctcgctccgctttcaccccctactcttccaagccttcgatgcctattattccactgtttatgtctaaagttgggactcctcactgttctttgtgctgttttgctaacctttttgcagatctttcttcagataaattagaaggtaaaaaaaactatttgcaaaaagctcccagaattaagtttttaaaaagcagtttatgacactaagctgactccctgcattgctctccattgctactgtaggtttgggaaatgggcagggaaattaaaggaaaatgttggtaggttgaagctatgtcagcagcagacacacaggagcagggttcaccaagctacacgtctgccagcacttaccagaactgaggccagagccaaactcaggcttagaaagctacggagcagatacatggaaatgtgacagcaacaggccaccgtttaagaaggaattttatctttaacataccaggtggaagatagatttaactgttagacaagagaaagaaccatacatgtagtaagaatcgcccccctctccccgccagcacctcctccccggcatggtaggcctcagtggcttgagtctcaaacatttgtgtaaaaatgaaagtccgatcaacgggggagcccggatgctgcagggtttccccccattcacatgttgctagacacaccttggctccactatctagtgttgccagatttagcaaagatacaggattctcagctatgtttgactttcagataatcaaaaaatgttttagtgcaagttcataatgttcttaacaccaaaaaaaagggttcactgtacatctgaaattcaaatttagctggttgtcctttaccatgctgaagtcatatctggtttcacaaaggtaccagaattgttatgaccttgaaaagtgaccagtagaatcagtacaaatagagtctaaacaaaaaagttatttactaacatcaaaattaaattggcttactcccaatttccctctgattgatatattcatattactgtgaaaggggctaaggactgtggcctcctctgtcaggcctcccagaaatactccgtggtcaaaactctacttcagtgagtcttagcctcctgatccactcctgatcgtttcaattctattccatttcccaaggatagtgaacacaaatattgcctaaaaatatattctgctaattcaaagtccaaaaatataaaagaaacattctatattagactccaaaaacttcctaatagaattaacccacactaaggagaagagagcacatctctttgtcatattaaacaaattcaaacattttatccaaaatgtataaaacagtaaaaacaggccaggtgtggtggttcatgcctgtaaccccagcacttagggaggccagggcggaaggatcacttgaagccaggagtttgagatgagcctgggtaacagagctcgtctttataaaaaactagccaggcgtggtggtgcacgtcagtcgtcccagctactcaggaggtcgagttgggagaattgcttgaggctaggagtttgaggttacagagagctatgattgtgccactgcactccagcctgggtgacagagcaagaccctgtttctaaaaaagaaatgaataagtaaaacttatttattaacaattaaaaacctataatatttctcatgtccatagctagtaggtgcctggcttaatccatcatgacacattttaccctggttgttccacgaactttcccacgatctccctgctgtctcatgaatccctccaagtctagtctcagcacaaccatcaaagtcacatcgggacccgtgcatcccgccacgccactttctgcttgaaaccctgcagttgtgctttacatcatacattaaggcccatcacgttctgaacattttgtcttctgaaatgatctcccgccgactccagtctgtctgtccctgggctgcagcgacggtggcttccttgtcctctgtccccactttgcaagagccctgagcccaggccattgcctctgctgctccccttgcctggggctcctcctccaaccgtgcaaggccatccatcccctcatgtacttcagggctttgctcaaaagccacctgctcagaggtcctatgactatttttcttcacttttcttaacaccgtctgacactaccttgtgttttgtgtctcttcaagctagaaagtaagcttcatgtgaataaggatttgtgcctattttgttaactgtactctcaccatctaaagatacgactggcacattgtaaatctttgaataaatcatttttaaacacattcagctagcaaaaatgcaaattattttatgctttttaaggaatacctctagaattccttcaaaacacctcctgattttatataatgtgctgaagagaaataattttttttaatgctaggcacttgtgtttatcttcaatgcaaaatagacaaaaaaatgggatccaccaatatttgatcaaaaaaaacttcattctaggaaaaataaataacaagtttctaagatcagacagcaatacaacttctaaatcattaaggtttatatacagtacaaatttgagacaattacgctctggtttaaaatacttatagagtaattaagatgtcagcataattcacaaaaaaaggagggacttgccacttcttctgtcttctgaatctgtccttgctctgacagctcttcaactcaggtaccaattaataggttgaagataactttagcttcaagtgttattatacacccagagattgtactgcagatgttaatctagttagaattcaccttatgttaaacagataaaattgtgtatgatttattgcaaaatgtcatctgccttctatgatcagaattgtcttcaataatgccatagggcttattaatttgctacttaaattgaacgacactgtaatagacttagtgttaaatataaccacatgtgggcagaatcatcttccacctccagcaaaggtcctcatgtgctaatgtctggaaccgatgaatatgctctcttaagtggcaaaaaagactttgtgggtatgattaagaactctgagatgaggagattcttctgaattatgctgttggactcaattgcaaatgccaaggccttacatgggagagaggaggaaggagagtcagagacgtgatatgaaaacaggtcggagggactcagtcggtctccgggtttgacgatagaggggaccccaagccaaggaatgtagatggtctctagaaactggagagggctaagaaatagattatctcctaaaacctcatagaaaagtaggtagccttcccaacatcgtgatttcagtccagtgagaccggtttccaacttctgacctccaggctgtgatattatgaactttgtggtcatttggtaccacagccatagggagcttctatgctgataaatgattttcttacttagcttttaaacaaaactgagacatgttgcaataatgaattggccagcacttgtgtagtgcttcttgctgggtctcaggcaccgtggacgtgtgccaacgtttccacgtgctcttcacagcacctcgacgggtcgatcactaattatcaccatctcacagctggtaaaactgaggctcagagtcaggtgggaggagctggatccaggctcaaggactcaacttttgtttttcatgctctctgccactacccttaacttctccccaaagataatatccctttgagcatcacttccgtttacaaccagccaaagagaagttaaatgaatgcagggtaaaaggccataaacacacccaaggaaaagttgaatttctgatcacaagttgtcaacaaagcaataaagtgacaacatgaagttaataattttccagaaacacaaaattctccctaactcttgggcaattctcagtcattacacacctgcctgcaggtgtctggctttatactgaggtacataaaaaaaatctcatcaaatgtaccccaagaaaggtcttacaaatgccactcacacacgtcactgttgtgcaattgcagagggcaatgactcatctcccagcagacatcataaagccccattcaataggcatgtttcctgcacagcatcaccgctgtcaacatgaagccctgtacgtactattccctgttggggatctgagatttgaagatctctgtaatgtggcagagttcacttaaggagaaaattccaatgtttctagcataaagaaaatacaaatatatatttaaggtaatggatatctcaattacattgatctttacaaatcatatgaatgtgttatcacatgtaccctaagaaaaagaaaaacagaatgacccttgaagaatcttaaaattacatgaaaaacaaattcatttcaaaagaaaaattacagaagtgtgaactgagtttaaatccttgtggaatcaattgaaatggtactagtgatcctatcaatgatttatgaaacaatgagttaaattatgataatttttttcaacataattgtcctcgtatcctatattttcctaggtactgaagacctctaatggacagatttttttaaaagataatttgaagggccaactgtgtagtcagactttatattcttatggtgatgtttacttttgttgtaacacactagatcactttcttagaagttccctaaagttgggggtttgggggaactaagttacaggagagtctccctgctgtggattggggacagttgagggaccatttctgaaatgattattcacaacttgagccagatcagattatctagacttcgttattgaactaaacatctttggaaaattaacgctgtttttggcctcttgccaatcaagcggtcttttcaggcctctcttaggtggagtcatgaaaacaactcatccctccctcttaatacatgtctatcactgcacagttagggtcacattcttcttactcttgcaaggcgatgaaatgcaatgacatgcacatctactcagctgggccttggattgccagaggcagagggcttgaacttaagtttattcttacctagagcatgatcccacgaagcttccttaataggatagcaatgtagaagggccacagtgcagaaatagagtttcagtcaatcttattcaacttgaacttctacatgagagctgggttgtatcaacatcgaggataaaggggggaatctcaaactgctggtgggaattacaatgggttttctgtcttgttttctggtttgagagcgtgcactgagtcaatgccaggagtttaaaaaatacgtacaagcttccgctcctagggaagtgtagtatggaaataatcagatgagtgggcaatttattaaaaaagtccattccggtgttatttgcaataagaaagtggaagtaacctaagcgtctgctaactggacatgtactaaataatttaggttttagtacataatagaattctaagtgaccactggaatgtgaggtgatctatgttcatcttcatcctatagcaggttcattgtattcttaagtgaaaaggtggcatattttcaacctatataatcatctccttacaactgtattctctatctttgaaatgaaatcccttaatacatacacagcatgtattataatcttgttcttagaaataatcaaaaaaggtaaagatttttacaatctttcaaattacacaaagccattatttgcaagcatccctgccttgggccaaaattatattatcctttctccctttcaagtagtttccccagtttatacagggagacagaaaagcagttctcttcattaaaacttcagctattcagaagctgaggcccaaagatatggttttaactatgttcaaacatgttttctgattttaatttttccaagtttatagaatacttcattaacatcactggtcatttcaattaaacactttggaaatccagggaaagaacaattttgacaacatcaactgacatatgtaatcctaaactttgcatttaaattttcagtcatgaaagagttttctgcttccacccttgagaaatgcccctaatgggacttacctcctgtttgcttcaaagaaggactatatgaagaatctagcaaaagccaatgactttttcacataagctccaattttaaaatagttaatagaaatcacttatcagtgaagctggaaataatttaagtagttttttggtgtttttttttttgcttctagcatcacccttgacatgcagttctatgtgagcctataaaagtctaactttgttaatcttcagtttccacgtcgtctcttcaaacccgagatgccaaggaaactttcttttaaagatttttagaaggtactaagccttctaaagtgaaagttttcattcgtttattacactagtatttattaagggcaaattctatgttaggaaaagttttaagtgcttgcgatgcctaacaattcttgtttttaggtatgtgatgatttaacaaaaccaaataagcttaaagtgctcataaaaaatacaatgtgaaacaaccagagttgaagctacaggtatttatttaccattttatattcttagctagttgtataaaccaaaggaatgtagtcaaagcaaaccaagtattttcctggcctttattacctgggatttagaaggaagcacacagtgaaatgctgctaagtgtgtgacatggtcacgggagtcacccaggtttaagaaatccatcctcagtacaatcccagctgaaaaagaagcttaaaaatgcatctggtttttatcatttgtgtgtgaatcagcctgttgttttaactaaataacctatcgatgccataaagttgtctatgaatacaattgctttatgtatggaacttctttgtagagtcaggacctgacgtttcagtcattttgttttcacagaattgtcagaattcttagcagaacttcacttcatttaaagtcagttgtccaacttgacagggatgttctgtcactttttcagatttttaatttttgtggatacagaggtctgcgtttttcctttatgctaaataattatctaattatcttcagtttctctgatcattcctttttgcctgatatcttcctgagcattgaataaagcagttaataaggtatgtaataagtagactttatgctttcttctattacaattttatattgcatatagatgtttattgtataaaacaagtctgtagaagcaagttaattttatatccatatcccttacctgcagaaagaccccacagggaatctgattacccctcaatgtgggtcatcaggtccttggctagaccagcctaactagcatccaacagcaaatgaacatggcttttatcagcatgttgctctgaagggacctttgtccccaggtcattattagggttaacaagctggcagatacacattgtgccatgtgcttctcccctttgttttgtttttgagacagtcttgctctgttgccaaggctggagtgcagtggcacaatcttgactcactgtaacctccactctgagttcaagcgattctcctgcctcacctaccaagtagctgggattacaggcatgtgccaccacgcccagttaattttttgtatttttagtagagacagggtttcgccatgttggccaggctggtctcgaactcctggcctcaagtgatccaactgcctcggcctcccaaagtgctgagattacaggcgtgagccaccatgcccagccacttctctcatttgtaaattgtttatcagtatcatggcttggcacaaaacaccagaccagaggttagaagacgtggttctgaagccccatctgcctcttgctggaatggggcaataatttgctgtgaacatcagcttcttcatctcccatggggctaattctttctctaaatactttataagaatttgtgaagatcagaatcaaaatcaggtaatgtagttaaatgttttcaaaactagggacagtcttctattttttcctcattacctggattagtgcatgccatgtttcaggtatacaactgataatttagtaacttaaatatgatgtgtattactcaatattaaaatttatatattattttaataaagaagcaaatctggtgaccacaaattaccttatgtaagaatttggtgagatgactggggaaaaatccttggtcactcccttttacagtgggactagttttatgtgtgaagggagtggatacacaccatgtgtaaaatgagattaaaatttttttttaagttgtattaaagtagagcctaacagaaaagcacacacatcaacagtggaaagattgataaatcaccaggaaaagaacacgttgatgtaaccaccatgaaatttgttgaatagactcaaacattgaataagtcacctccttccatgccccgatcactaatgtccatgatatccctagaaacttgtcaaaatgcatttcgcttattgcttcaggtatactcttgaaatgtctgtcaatgttagagttaaatattctagttaaatatgcaaagaattaatcttggaaacataagaataaaagtcctaatttttaatacatagcaactgaggaaatgggaaagaaaacacatatcccaggatagagcacaaatgcaatgtgaactgaaggagttttgtagagggaagatcgagaaggtgctagctaaggcaggagaatggagaatatggagggcattagtgcagagacacaaaagaataaaatgtgaatggagctgaattgaaataacaccgaggatatttcataaatgaatcctggtctgtttcttcacttaatccctccaggacattcttccatctcttttccatgtgtttgatttcagggtaaagatcaaattattaggaaccttctgaatgaaaagccacctaggggttagcatattgaagggaatattctttatctacgtcagcaacaatggaggaaacatttttccttctatctgtgttgacactagaacaacataaggctgagtaacctttgcttagtctttgtcaactatgtaaccgctctgtccaatgttttctaagcctcgtatcaacaaagaaaataaacaccaggtccgtcaatattttttatgtctcatatttcaggaccttacacacaggagaaactaaagttacatgaatcgtggggtcagtgtagtctttgcttagttaatattccaccaaagttacacatctatcaaagcaccacacctaactccaactaattacaaaaatacttgtcttcagcatatcaatgaagatgttgagaataagaaaattgagcaacttattccacgggaactaagttagctaataaaatgtcttggtttattcattctacatttatctattaacaatttgagcataaatggcagttttgtaggtttttggccatgtaacaatcttaatggcagagtcaattttcaatcaatgaatcaatatttccaggaatatattggactccatgtgaataaaggcagggcaagtatttaatttcagaggtaagtgataacattcataaaatgtaactaagaacatggaaccaaaaatagtatcaccttcctaaatgttttctaataaaattgctacacatttagcactagaaaatattttacttgtattgaatgtttgaaattaagtcatcaaggaggtggcaaatgctccttccaatttccattcaaaagttggtcagcaatacagacagacaggcaggactcatgatcacaggttaacaatagagacaggcaggactcaatcacgtgttagcaatacagacaggcaggacccatgatcacacgttagcaatacagacaggcaggacccatgatcacacgttagcaatacagacaggcaggactcatggtcacacgttagcaatacagacaggcaggactcatggtcacacattagcaatatagacaggaaggactcacgatcacacgttagcaatacagacacagaaggactcatcacacgttagcaatacagacaggcaggactcatgatcacacgtcagcaatacaggcaggcaggactcatgatcacacgttagcaatacagacaggaaggactcatggtcacatgttaacatgggcacttccaagagctgcttggcgtgccatgaatggtttgtagggctacttgactgagaatgccctctggaaatgtttgtgaatccagttgaacaaagttgactaatgcggagatgctcaccaacttcgctactgttcctaagtaatccttgcaacaggatgattttgcctgttaattttgaattgctgaaagtgacactgaacattcttcagaaccaataccatattttctgtaatagctgcgttattggccgcagcaccgcagatgtttgcactagtccctgctagtccttcctgatcagtcaccacccctgatgctctgggagtccccgctaatccttcccgatcacagtcaccactctgatactctgggagtccctgctagcccttcctgatcacagtcgccaccctgatgctctgggaggaaccacatctccctagtactttcctcagagctgcagccacatctttattcctcaagctgtagatgagtgggttgagcatgggggtgaggatggtgtagaaggcagacaccactttatctttctctggagtgtggtaggagtggggcagcacgttggtgtagaaggctgccccgtagaaaacgctcaccaccataatgtgggaggaacacgtagcaaaggctttgcgccggccctcagcagagttcatcctgtggacagtcaggaggatgtgcgtgtaggacacagagatgacagatagagggataagcagcatcagcacgcagcaggcatacatcagggtctcatagagtgacgtgtctgtgcaagacaacttcagcacggctgggatctcacagaaaaagtgattgatctctcgggatctacagaaggggaaactcatagtgacaggagtcagcatgaacccatccaaggaaccaccaacccaggagccgaccaccatgaataagcaaaccctgcggttcatgaggagagggtaccgtagagggttgcacacagccacatagcggtcataggccatgagacccagcaggaagaattcccctccaatcagggtcaggtagaagatttgaactgcacagcccaggaaggaaatggtcttgtccttggacaggaggtcctggagcatcttggggacagtgatacagatgtagatggtatccatgatggagagctggctgagcaagaagtacatgggtgtgtggaggcgggagtccatgtggatgagcagaatcatgaccaagttggctgttatagccaccacaaagatggagaagactactgcaaagagaagcccggggaaggcaggatgggtgatgaggcctgtgaggacgaagttagtggagttctggagaagaccctccatgcccatggtccatgacaagctccttgggctgtaaaggcagaaatctggcagcttatttaacgacctgatatgtaggaagagcccaccaggaatagtatgtcagaagcagcgtgagatcaagaaaagatcacctacttcaggatcatttgaaatcctgggtttcagtattaatgatctgtatgatattggacagaaaattaatctctcaactcaatttcatcatctgtgaaaggtcatcatagttctgtactctacaggctggatgtgagatgtaaatgtaattcatacagtacctggtttagaatctgatttttactttgaactatcttctgaatacatttcataatcttatcacttttagattgaaagttttctgagggtggttactgtgccttatttcccatttcgcctagcgaaatgatttgaatttaaattgctctctgcatctccatcgagatgattgtactagagtcatccacagacgtctatttgtgacttaaattgatagaaaacatctagataactgacttttttggctgctgttgttactgaacagctttatgaaagtcaggaacatcaaagcagtacagatgacctcatttggggtcaggagccacactgtcttgtggttagacttttgtcctgcaaaaggagttcatcttttaggcatggactgctgtgagaacttgtgtctatttgttctcacagaataatttggggatcataaatctggcaggacaaccaccacaaactgcttcagaacagggctttagtttcgttatcctggtggtctttccagttgacaatgaattctgctaaaatttagatgctgcatcatagaattcaatcatgacctcatcttaaaatattgtttagccaaaatgttagagtttctctgacagagtggcatcctgaacctgtcctaatattatatcatcctagtaatccactgctacttgggttttttcctcaagtttatttctctaccattttactgatccttcatgtttataagtaaaaataactacagtcgggtgcagtggctcccacccgtgatcctagcactttgggtggccgaggcaggcagatcacttgaggtcaggactttgagaccagcctggccaacatggtgaaacctcatctctactaaaaatacaaagattaatcgggcatggtggcaggtgcctgtacaatcccagctactcaggaggctgaggaaggagaatcgcttgaacttgagaggcggaggttgcagtgagctgagatcgtgccattgcactccagcctgggggacaagagtaagactttgtctcaaaaaacaaaacaagaaaacaaaaactatagatggtaaagaaatttctgaactcagacgcgacacagcagtatcaaacattccttgaatcaatggaatgaattctcatgcttttttgagtaatatgaatgtgtgtcccttttatatgttcaggaatactgagggatgaatttttctttattagattatggtgtatttcttctcattttagtgacaggattactgaagaaacttgttttctgtcaaacgttttggccaccaatactacaaatgtatctgaatcttttggttctagaatagtcaaaatttacagtccctgaagcatcaaggaataaactctccttatgttgaagcaaaaacaatagcaacagtagagttttccttcttagtgctcagagatggagatatgagtaataggcctaaaagatgaataaacatccaaagggagaaagaaaaaaaagcaatttttgtgttggtctgtgctgaaacttcagtttgtcacaccttggttgaggagaaaaaaatacatgagcatcaaatattaactcctgtcaagcgtgataaaagtcagctacttttgccttctctaacaggtgaaagattttcttgtgatagccacagcttcgaatcatgggtcaagagactatttaaatatacaattccatttgcagtggcttttgcaatagcttgttggaaattaaaaatattaatctcgcagacagtaagtttgtcttgacccacatctattgtttcagttaaatgcattatggatattatacattaattactatagtgttaggttagctgacaatcatccttttaaaaatatactttgaggaactgaaataggcaagaatgagacaaatgaaaatgacctaagaaaataaccaattacttttgaatcagaacatgaaccagagcattttgtttcatgtaaataatcagactccacaaggtattcaaagaggaggtaaaacactattgcctcaaatgtctatgataaaaggataagaacgttttcaacccctagatcttatcttactgtaggatcccagaagaggagagtaaaaaagctgaaacaggagaaagatatgattttagccacctcatttttatacaaccgagaccgtgttaaaaaaaaaaaaaaaaaggttccttgtgagtgtgagcgttgtgcgtacatgtgtgtgtagtgtgttcatatgtgagtgtgtgagcatggtatgtgtggtgtgtgcatctgtgagtgggtggggatatgtgtagggaaaaggccctgctaaagagcagaactacactgcttggcacaaacgagcaattcacccatttcaatgaagccaatatttagaaccaaatgtgacatgttcaaatgcatgcctaatgttattccataggctactgggcattgcaagtagacagggaaaatatctgcattatggacaaaacatgtcatcagttacttctgtttacatcggttccgagcatctacattttaacattagagttgatgctatttagcattacgacgtgtggtttgacttattcacacatacaagatcctagattccattccccatcagctcatctttccctcactatcatcattctccactctaagacacttaggttccccttcatcaactagtctttccaaaaaaaaaaaaaaaaaaagaaaaagaaaaagaaaaagcttttatttgcgtgatcaaagcttcaggctcttcaaggcggcgaatgatttctccccagtgcagattagaacataacccagaacccctgacccccaggaccagttataacatcacccagtgttgcaacataatcatctggcaggaatgggagggtgggaagatcaagccgagaggtggaggacaccaagcacaggagctccacatctgttatctgcacacttggggctgatggatgagggatgagtgagctcgccaagaggcatttattctacctgtggtctgccacatggagaagagggaaaggagaatctctgcagggtgccaggtgatcaaagctgtatgtttcaggacaacagccctggagttgttctgggagaagccatagaaatcaagaacaattggtgactcaccgaaaattgaagagatctccaagagaagtcacaggttcttctaccagggagaagagcttagagcaattcattctgacacccctttctgggaattcagcatgactagagctatgagaagtatctgccagtgtcctttctgtggcaataaagctgctaaccagaactgatcttctccacttgacacaacgtacctgtaaagcttgaaagggaagggttttccattccatccttagagacagaatgcctgaagcacaaacacattccgtgttcaaaacactcacctagcactgggtgagctatgaagattgatagaactgacaatattcttaaggggcacatagttaagtttgattaatgtatcatatcaaaaatcctcatagaagcagatcattttaagtctaaagtggggatttctaaaaatgaaaatatattggggactttttaaaggtgtttagccacaaataacagctaatgccattgtgctttgctcagctgtcaaattgctctggggatgacacgcatagttacttctccagacctcagtgttctttcagtaaaagaatggcatgtcaccaacatgttactaatcctaagtgccacatagctctaagagtcatcgattatttgttcctgaatgagaaaaagggggccaaggatagtatattgggatctttctgctttgattaaagcttatgagagaagataatggtgtggaaggcactaagagacggaggaagagaaacaggaagtttggtattccccaaaccataaaccaatagggctttacgtgtgccaggtactttagaagttttacatacatgaagtcatagcaaaccagaagatgctatgcatcagtttgagtagtggacaaaggtacagtttccccttatcagtgggagacagttttcaagacccccactggatatctggaactgcagacagtactgagccctatatatataccatattttatcccatgcatacatacctatgatcaagttgaatttataagttaggcacagtaagagattaacaataataaaatagaatacctaagacaatatactgtggctataactttttcagtttgatgtgacagcaaaacttgcataattttttccttcatgatttcaaagataaagtttttcttaatatagatcttggcaaagtcagcttatgagggtttctctctccttaagtcaagaactttcacctttttagttaaagcaagcaccttacagcctctctttggcacatctaaatcgccagcttcactaactccatctctttggggccattaagaaaaactgagttacttgaacacaagcactgagtccgccacagtcgatttgataacctagacagctactgaatgactcggggtagcatagacagtgtgaatcaactacacagagggatgatatttccaccacactactcaaaatggtgggcaatttaaaatttgagatttttcatttaatattttttacacatggtagatagcaacctggcggattgcaggttaactaaaactatggaaatgaaagtgttaaagagaggaataccatgtcagaattctttacctcaaaggttcaaccctagggctagagactgaaaggatcttaaagcatgaaacttttgaagagcatctaagtgatcactgctttgaaaatagtggatcacaagaaccaggagaagacaggagtcagttcagttaaacagtgcaatagtagagagggaaaccggtctgattccgaaactcgagactgaaggagagaggacatgatcagagacaatgtaaataatgtcaaaaggctcgaaaatgggaattagcaggcactaggggtggaagagagaggggagagtccagtctaactacagctgaagagcccgtggagagctgaggtgtgtggggtggagtgcggctggaaagtgaaggcagagagaccagaactcagcgtcgagaaataaggtgcaaatgggagttgtttcagtcagaaagttacatgctgaaataaggtacttatgaaagatccacctggcagttttagtcttgaaagcaagattaatattaattgctactcataagtgttcatagccacagtgggctttggccaggaactccttttcttcttctacctacacaagctactcctgtactccgtctgcttttatgaatgaatgcatttggaccttgcttcctacattaatcagattttatccccttctctccacagcaacgtagtatccaatgatgtgaatttctcttttcccttaccttatctccagttctaattacatactgccttagttaccacccccctttatctgcctatttaaatggtaactgttttcattcgtggaaaagtagtctactttccctcccatcccaactgacaatttggaaattttcagtgtggaaagtta

SEQ ID NO: 748 - DNA, 4423 bp, Homo sapiens
tataggcgataaaattgaagcgtcatgaaatttgagaattcccatagagatgtgatcctgggattgtgcatcaccaggtcctgacctccaaactgctgtactgataaacccacctgatacagctgtgggctaagagaaggggcaagaagcaaaagcacatttcctgagcatctgttggtgagagcctgtgtcaggtgttgggtagactgaggccccagccccacacttgaggaagatgaagatcagaacaattcattaccaacaggccaatgtaacatgtaacatgacacagtacaggaatgggggatggggccctatgtcccccacaccttgaccatctcttcctcaccttaaacaaaatttctcgaccctctttgctgggagaaggagctaagaaacagtattcccacttctcatctcttcttcccagcaaaacttcctcggagatgactacctccacttcctcacctcctgttcctgtgagcccagtggttcaagcgtttggactctagagtccaagtgcctagtgggagccgcctccgttaccttcagcaaggctgagtaccccccattgtgccttattttcttaccgtggaaaggaaatcatagtgtttatctgtcctataacattgttgtagagattaattaggggcgttcctggtacgtgaaatgcactggatgagtacaagttactacaacgagggtgggagggagggagctcttcggcttctgtcttcttctccttagaagtaccattggctctaaccttcctggtctctcttcccgcctgccgcatcttctaggtgattttgcaaggagaaacgcacgtgcatggcatagcccttcttttctagggctcttctgtaccaggagcctcacaggtcctgcctgccagtgactgggtagggaagtccagcactgtgtgtcatctcagaaagcccttcattaggactataatactgtattatagactgaaaatttgctgagagtagattttaggcggtttcacaacaaaaaaggggggaggtaactgcaaaatgataggccaatttgatacctatttcattatgtgcatcaaaataccatgttgttcacctcctatacatacaatttaaaaaatttaaaaagcccactcacccaaaaacatatgctatgcattttcatagcagcttttctagtaataaaatattatgacacccatctgccaagtcagggaaggcaatctcaaactcctggacagcacccatccaaaggcacagtgagtgctcagcacatagcggccccagatggcccctcagatggcgtccacagccaccagggtcactgctctgattgcgtgcctccaattcttggccttcaccctgccccttgaccccaaggtttctggtcttcctccctgccagcaccttcttcttcccttggctgacctcttctcaacaaaactccaaatactggtacactccaagtgcagctcaggctaaacaaagccttttgctcttcttcaaagctcctggagttcacatccctatccaatctcccacctgtgagttcaagtgccctcaaacccctcccatcccccagccagtcaagccctgacttggaagtcaccttttatctaggttttaatttcagagaaacaacggataattcataatgtaagtacatcctaaacactgcagcagacaaaaatactgcctatctgaaatttcagtgggttcactgtattgataaatctggcatcactacttgtgtcccttctctacattcatgctcacatccagacacatctaagatcccaaccctctggcactctcatctcttagctcagacagagcccactccaccccgcaggcccctttctaccaaaccctctcctggcacccatcacctcacacagcatggccccatgaggcaccaactcctcccctgcttctctacacttgccctgtacatgaccaccctggccatggggccttccacccccgcaagagcatgcatagcgcagctcactcaatctggtccttcacctcccttccctgaccacaccatctaaaaagcctgccgcctaaccctgctcttcccttgcccaacccttgcctcatctttgccccttttctcttcctccagcaaggacagtagatgttaactgttacataaactactttatttaaataaaaccaggaaagaccctttcccccttacacaccagcacatgcacacacgcacacccacaccctccctccctttcggctgtctgcccatggccacctcaaaccccgaggttctcattgtgaccaacctccctcaacctgtagacccccgtgcagagtccagttgcccacgcatcccggttgctggcagaacatgggcctagaaaagagcactccatcttcctggggtgggtcaaaaggaaggactggttctcccaaggcacccagatctggtgtggcttccctacaaactgggagcactgccaggcagctggagctgctccctgcggagggcagaacttttcaccccaagccaacccctccctgtaacaaaggaagtaagagggttggcagccaagcttcagtgtgccccgagggatcctgcagtaggtattttcagtttggggaagagcaagggagagcaattgagcaccaaattccctaaccccgtcctgcaggagggtgctgagtcagttcagcatcctctacccagaaaaagtaaacacaactgtgcagcaagagtgagggtgggaatgacaggggcctaagccttcaggacctcatgacttcacccccaacatgggccctcttagggacccactagcaccttggcaatgttgaggacccagcccagcggaaacaccatacccacaggagccagtctggagttggtgatgctccctatgttgacagtggggttgggtttctctccctgacaccagcttcctgcaggccctgtaagttctgctttggggcacacatcgcagagtgcctcaggtcatgaaagggaatgctgaagggaaaggtggtgtcttccggaggcacacagtacatcttacaggttacacacgggcaggctggagcaggacggggggcagggctcagcagcatacctagggtaccctccagagttgccttgggaaggggggcggggctggaaaccaacgggaggggtgactgtccatcccctccgacgggagtactcaggcccagcacccattttctctgatgagcttcccagtgccttctagaccaagttccctgagggaaaaagccaaacagatggaaagagagggagcagaaagggaaagcaaagggtcaatgccctgcagatcgtgatgagctggcaggcagaggcagacagagcgccgagggcgagccttctgaatgggtaaggcaaagagagccgcctgctgaggggaagggggaggctgtgagaacgccagggcaggcacagaggactcgaacacagctggcctctcccagggaagcactggagaaggggaccttcgggaagacgaggccccagaggagagggcgtgagaagactgtgggccccaaccggcccgtggtggcagattcaagccaggaaccctggcccctcggctacaggctgacgctgcgctggtgccgacccccacgggctccgccgtcgctgccccggcgccctccactccgcgttcccagctcttggccgtccagactgacgtggtccgagaggcctcgcaagtgctccacggagtcgcacttctgcaggtctgaagccaccgtgcgcaggctcagcagactcagggtatcggtgtcgggggcggggccgggccccaggctgctgccctcctccagccccgcaccctcggccccctcaatcccgctgtctccgtcctccatgtcctcgggtcctgcctcggcccccacgggggaggagcgccgagggcccagggggtggggaggcagacccccgcggcgccgtgcgtgaatctgctcgctgatctgctccaggttacgaagggccacggagtagcgcgtcttggcctgagctacctgctgctccagttctgtcaccttggccttgtgctcctgcagagggcagagcagagcaaggcgacccatggggcacgtctccaccttcctcagcactctgcactgaggtctgagggcctgctctcccagaatacctggacagctggctcagcatccaccacagacccacaacagccttccctgctccactctcagcacccaccacagacccacaacacccttccctgctccacttgctctgcgttgttcctccccagcaatcctgctcctgacctgagccccaccttccagagccttcctctcaggccttcctctccaccagctcctgcttcctcatcctctccccactgttccctttcacccaatggctggttcttcttccccatcccaga

SEQ ID NO: 749 - DNA, 2323 bp, Homo sapiens
atctttgccccttttctcttcctccagcaaggacagtagatgttaactgttacataaactactttatttaaataaaaccaggaaagaccctttcccccttacacaccagcacatgcacacacgcacacccacaccctccctccctttcggctgtctgcccatggccacctcaaaccccgaggttctcattgtgaccaacctccctcaacctgtagacccccgtgcagagtccagttgcccacgcatcccggttgctggcagaacatgggcctagaaaagagcactccatcttcctggggtgggtcaaaaggaaggactggttctcccaaggcacccagatctggtgtggcttccctacaaactgggagcactgccaggcagctggagctgctccctgcggagggcagaacttttcaccccaagccaacccctccctgtaacaaaggaagtaagagggttggcagccaagcttcagtgtgccccgagggatcctgcagtaggtattttcagtttggggaagagcaagggagagcaattgagcaccaaattccctaaccccgtcctgcaggagggtgctgagtcagttcagcatcctctacccagaaaaagtaaacacaactgtgcagcaagagtgagggtgggaatgacaggggcctaagccttcaggacctcatgacttcacccccaacatgggccctcttagggacccactagcaccttggcaatgttgaggacccagcccagcggaaacaccatacccacaggagccagtctggagttggtgatgctccctatgttgacagtggggttgggtttctctccctgacaccagcttcctgcaggccctgtaagttctgctttggggcacacatcgcagagtgcctcaggtcatgaaagggaatgctgaagggaaaggtggtgtcttccggaggcacacagtacatcttacaggttacacacgggcaggctggagcaggacggggggcagggctcagcagcatacctagggtaccctccagagttgccttgggaaggggggcggggctggaaaccaacgggaggggtgactgtccatcccctccgacgggagtactcaggcccagcacccattttctctgatgagcttcccagtgccttctagaccaagttccctgagggaaaaagccaaacagatggaaagagagggagcagaaagggaaagcaaagggtcaatgccctgcagatcgtgatgagctggcaggcagaggcagacagagcgccgagggcgagccttctgaatgggtaaggcaaagagagccgcctgctgaggggaagggggaggctgtgagaacgccagggcaggcacagaggactcgaacacagctggcctctcccagggaagcactggagaaggggaccttcgggaagacgaggccccagaggagagggcgtgagaagactgtgggccccaaccggcccgtggtggcagattcaagccaggaaccctggcccctcggctacaggctgacgctgcgctggtgccgacccccacgggctccgccgtcgctgccccggcgccctccactccgcgttcccagctcttggccgtccagactgacgtggtccgagaggcctcgcaagtgctccacggagtcgcacttctgcaggtctgaagccaccgtgcgcaggctcagcagactcagggtatcggtgtcgggggcggggccgggccccaggctgctgccctcctccagccccgcaccctcggccccctcaatcccgctgtctccgtcctccatgtcctcgggtcctgcctcggcccccacgggggaggagcgccgagggcccagggggtggggaggcagacccccgcggcgccgtgcgtgaatctgctcgctgatctgctccaggttacgaagggccacggagtagcgcgtcttggcctgagctacctgctgctccagttctgtcaccttggccttgtgctcctgcagagggcagagcagagcaaggcgacccatggggcacgtctccaccttcctcagcactctgcactgaggtctgagggcctgctctcccagaatacctggacagctggctcagcatccaccacagacccacaacagccttccctgctccactctcagcacccaccacagacccacaacacccttccctgctccacttgctctgcgttgttcctccccagcaatcctgctcctgacctgagccccaccttccagagccttcctctcaggccttcctctccaccagctcctgcttcctcatcctctccccactgttccctttcacccaatggctggttcttcttccccatcccaga

SEQ ID NO: 750 - DNA, 35258 bp, Homo sapiens
gagatggacctccatgggttatgtgagccacagacttaccaacaggccagaggtgcttcagtagctcctctgtctctgtctggacctgccctctggggttgggttttatggttttctcaagtagcaaaaggtagcaatccctccattttatttttattttttaaaacagtctcaccctgtcacccaggctggaatgcagtggcacaatcacaactcactgcaacctctacctcccaggctcaagcaatcctcccacctcagcctcggctgggactacaggtgtgccgtaccatgcccagctaattttatttttttaatagtctctccattttagaaaacaaatttgacctgtttcctgccatctgtctatcccatattcatgggacctaggattcattcattcactgaatgaatattttttcagcatcccttggtgctattcttcttggtacttgggatacatcagtaaataaaacaaagattcttccagcagagatgaccataagctcaatatatcaatacattatagagtgctctagaaggtaataagtactaaggaaaaataaataggatagagttgagagaatgtggagagacagttacagtatttttatagggtggtcagggtagctgtcatgagagagtgagacttaaaccaaaccttggaggtgggaatgttagccaagctgatatctgggagaagaacataccaggcagagggattagctagaactaaggtctcaagaaaggagtgtgtctagcataggtaatgagtagtagggaagccaccggagtgaaaagaacacaggaagtttcactcatgtctgtatgaagagaccaccaaacaggctttgtgtgagcaacaaggctgtttatttcacctgggtgcaggcgggctgagtccgaaaagagtcagcgaagggagataggggtggggccattttataggatttggttaggtagtggaaaattacagtcaaagggggttgttctctggctggcaggggtgggggtcacagtgctcagttggggagcttttgagccaggatgagccaggagaaggaattttacaaggtaatgtcatcagctaaggcaggaacaggccattttcacttcttttgtcattcttcagttacttcaggccatctggatttatacgtacaggtttgggcccagaggcctgacaggaagggcagtaggagaggtggtcgtagatgatgggccagagggcgcagggcctagcaggccatggaaaggactctaggttttacgctaggtaaaatgaggaggcactgcagggctttgagcagcagagtaacacagtctaacttactttttttttttaatggatcctaccagctgctaagttaagaataatttccagtgagggcttttgtagtaaattagagatgatgctggtttgtcaatctccccttccagcagaggaatgtgtgggtaagagagtcacaatgtttctgaacaaagccatagctcctaagtggtgaagctgggcctagagcccctgtttcctgacagctggcctggcggtgggctctgtacagcattgattcccagccagcagcacaccctgaaaagtcacatagcagtgggagtgcagatgcttagactctccccatcagaaccactcagttggaatcttcagggttggggccaggtcagcagcagccgcagaagatactctggtcttcctgcttcagcagacaaaggtttctaagcccaaacgtgaggcatgaggataaatgaaattgtaaatggaagcagaaaaatgtccaggtctgagttcctctgctgtgttttagtcagtttcagtgcagtattttagctctaaacaatgctttttaggtctgagggaactgctgaaggaaaggagacatttagatctgaaatccaatttttaccattttttgatacgtaggctttttttttttttttttttttttgagatggagtctcgctctgttgccaggctagaatgcatggcacaatctcaactcactgcaacctctgcctcctgagttcaagcgattcttctgcctgagcctcccaagtagctgggattacaagtgcccaccagtacacctagctaatttttgcgtttttaggagagacagcgtttcaccatgttggtcaggctagtcttgaactcctgacctcaagtgatgtgcccacctcggcctccaaaaatgctgggattacaggagtgagccaccatgcctggccaatcagtgggctttttaagaatgttcccgggctgggtgtggtggctcacgcctgtaatcccagcactttggaaggccgagacaagcagatcacctgaggtcgggaggtcgagaccagcctgatcaacagatcaacatggagaaaccttgtctctactaaaaatacaaaattagccaggcatggtggtgcatgcctgtaatcccagctactcgggaggctaaggcaggagaatcgcttgaacctgggaggcagaggttgtgggagccgagatcgtgccattgcactccagcctgagcaacaagagcgaaactccgtctcaaaaaaagaatgttcctgagaatggatgaacactaagttcaggtcctctgttaataatgttgttaccatactgtttttctcatatttatttttagattgaaagaaatcaagggaagggatgatattatgcaagtatatatgatcattaaataggcaatacctgaaggtacagaggtatacatgaaggtcagcatcaatggtgttctcagctacccatgttgaggcaagtataataacgacgaacatttgttaatacctacttgggccaggtgttgtgcctagtactttgcacatgtgatcttaagtaatgctcacagcaactctgtgaggtgggtagtgggataaaatgttaagtgttgacaaaatctgtctcataaggccaggcgcagtggctcatgcctgtaatcccagcgctttgggaggctgaggtgggcagatcacttgaggtcaggacttcaaaaccagcttggccaacatggtgaaaccctgtctctactcaaaatacaaaaattagctgggcgtggtggcacgtgcctatagtcccagctatttgggaggctgaggcaggaaaatcccttgaacccaggagacagaggttgcagtgaaccgagatcacgccactgccctgcactccagcctgggcgacagagcaagactccatctcaaaaaaaaaaaaaaaaaaaaatctgtctcttggagttgttgtaatgattagtgacttaactctacccagtgtggcactagcgctggatttccaagaccacctgcaggttcaatgattcctgagagactcaagggactctacgtatagttatacttaacagttctgatttagtacaacagaagcaaaatcagcaaagggaagaattacatgggacaaattccacaggaaaccaggtggtgatgtccaagaggcctctcccagtggaatcacacagaacacacttcattcttccactgccaaattgtgcaatacgtataaaatgtcaccaatcagggaagctcattagaggtacccagtactcaaggtttttaccatgacatgctggtcatgtaggcaccctctgcctagcacataccaaaactctggaatcacagagggaaagctggtgttctgcataaagtatcttttttgtgtttgtttttttgaaaaaaaaaaaatttttttgtagagacaggatctcaccatgttgcccaggctggtcttgaactcctagactcaagtgatccatccgcctgtaatcccaaagtgttggattgtgagccctgggcccagccagcaaaaactatcttgtttgcatgagcagttgaggaacaatgttagggaatgatgggaaccatctcaaaatccaagttctcagctgtcagccatggcctgatctaagaattttctaaggctcaggctctaaggagtctcaggcctgctgtgttaacttttttctgcacagcactcaaagtttatgtcctttttgattttgagagatgggaagactgagtttcacagaggttgggtgaccttctcaaggacacacagctaccaggtagccaggccaagatctggaattcaggtatcatggaagaccctgagaaaaatctctgtggagccagaagaccttctgcagttcagcactgtccagaactttctgcagtgacagaagtggtctagatattggaaatgcaccatccagtacagcagccactaagcacacgtgactactgagcactggaaatgtggctagtaccactaaggagctgaatttatatttgtttttcatctttaactcatttaaatagctacatgcagctggttgccaccatactgggcagtacagttctatactataatgtaatggatttttcttcaactgggaagcaggtgggataaatagaccttggttcttgttctgtactaaggaatgcactggtctatgtgttcctctcactgggtgtccttgtgtatgtgcaacaggggaaaataacatgtcatgtctgcaagttccctgaaaaaaaggccctttccattcagggattttgcaagcttggtttcattgttattaaagaaaggagcttgcctgactaaacatagagcattaaagctgtccctgtaggggattctgaggcccttcctggtgaagctcccctgccagactcaggctgcctcctcttggggtctgacccgcacagctggctctcaggcctctgtgttatcgtgagatggggtgtccccccaagtcaggatgaccttctacccacgtgcgtcttctctgtcttaggatgaggtgctcacgatcagccagacaaccagaagcccaaagaaggggagaggagactttaagaacccgtagggctagttagagcaccgagcctctcacttctgtcttcatcctgacaccaggagatgatgtgggcccaggggttgggtctgctgcaggccaaggagagctgacgggtcaggatgatgaagaggctggagagctagcacgggggttatgcacatcagctctggagcaaataacctcagttggtatcctggttcccatgccttaggaaagttactaaaggtcactgagccttagttcctcatctgtaagatgggaagaagattattaggaaaattaagtggaagcaataataatatcagctgttgcctctggggctgtgcttgcctgcgagccacaccaggctgcagatgacaggaaacacagtgagagctggagttgctgctgactgggtgcccctccattccagcaattccctttctgtttgatgtccgtgaacatcacccacattgccatccaggccttgagagaggagtgtctctccaggtgagtccccaaacaccagctggttagagtgacccagcaaagccttgttcgtccccactctggcttaattttccccagctctactccacctgctggctcctggagggcctggacaaagtccccatgcaccggtctccccaggacatcccttctcccacccctggccttagatgtcaggctcctggggaatggtgggggcatcctgggtttgggctggctcccctggggaaatggggaaggaaggcgggagggaacctaggtctcagccttcatccaccgctgagcaggtcaccttgcctttttcctgcagagagtgtaatcggcagcagaaggtcatccccgtggtgaacagcttctatgccgccacattcctccacctcgcacatgtctggaggacacagcggaagaccatctcagactcgggctttgtcctcaaaggtgtgctctttcttctggggaggcctaggctgaatgcacagtgtcccaggtccagagagcccaaggtggttgctagactggttttggctgcagttcttccccatccacactttctcaaattccagcttaccaaaatctccatcacccaccccctggagtctgctagttctcctttctctgccctgactgtcgcccttttctggtcttatacttatgacaagcatatattctgatcaaaaattgggagccagggtccaatagttggactattcaaagttgcaattgtgcagacaaggtagagtgtgtggtccctgtggctgtagctggctccctagcctacctctctggtgatctctccatctgaggctccttcactttctctccatgggataggggttgggggtactccctagagctgctaggcttgaggccttgactgttgtgtcacccagagccccctcaagccttctgctccccaattctctctgttgcagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgagatgaatggaggcttaaaggctgagctgcaggggctttcagggggtcagtggagccatgtcaggagcctggccaggccgcaccccttgctgtctcagcagatgggatataggaagctcctgggcttagctgtgggaagccaagtaccctcaccggcatgggacatgaggggcagctagacttcacccccttcccgcagacctgcctccagagcaaggagaattctgccttaatctgttgggctccagtctccgggttgaattccagtgtatcccactgggagtgaatggatcatgaggtgggatggccccatctggatgttctgcagatccccacatgggaggagattcccaagtagaggcagccagaattctgactccctggcagcagcagggctttcaggcaccagtgtctgtgttgttagaactcagaggaagaggcaggggcagcagccgacagggggcagcatgacccaagcaaggggcctgaggcctcagtgggggtagggcaaggaggtacctcacaggtgggtgtgaggccccctctggagtttctggccattcacttacccactctcttctccccctgacccccgctccattgtttatgatggaaaaacggacatttggctaggtgtctctcacggctgctccatcctagcccccacaagctggggcttcctcctgtagatgctgtgcatgccccatgatgagtttctggcctaattgagggaaggaggaaattcataccagcagttttcaaataaaagaattgttctaattaagcgtctcaggtgtttttttccaagacaagtcttgcaccatcctgtggtcctgtcattccggaacctggttagagccaggcacacctaagggtgaaggcataggtgggttccagcctggtcatgggctccaggagacagaaggttgcctgtgctgcagccaaaccttgctgaattcataggatgtccatcctctgctatacttacaagcccagagactccttgcaagctctagccagtggacgaggtagcccagctcttgttaagattgactggtataaggcatccacaccacgtttttcctgcatttgcttctggcgaaggccagcactgttggttccttcccaaaagagcctccagactgggcgcagtggctcacgcctgtaatcccagcactttgggaggccgaggcgggtggatcacgaggtcaggagatcgagaccatcctggctaacacagtgaaaccccgtctctactgaaaatgcaaaaaattagccgggcgtggtggcggatgcctgtagtcccagctactcaagaggctgaggcaggaaaatggtgtgaacccgggaggcggagtttgcagtgagtcgagactgtgccattgcactccggcctgggcagcagagcgagactccgtctcaaaaaaaaaaaaaaaaaagagcctccaggccagggtacctgagctggggagtggggggcaggtgagagccccactatgctaccttctgtcctccggaccccctcaagtggaatgctatggaagaccactatctggccctgcaggcctctttaagtctgacccactgcagggggaaacatcacagaggtagggaagagaggtggccacccaggcgtggaggggaactcctgactgctgtcagcaggatgcctcaagggtggggctggtaacaaaccccatagtttgccttgtgttgtctgcctgacctgaactaaccccttcattcacaatacttcctccagtctggtcctcagctaaccaacagagatagcagggagattgctgggcatggcatggcaggagttgaattgcaggggagaaaagctgcagctcggcctccactttggagtatcaggttgggtgattcttccctctgcagggtcctttctgcccaccatccacctgtttagtgccccccagatgacagagtactcacagcttcagaccctggaacattagcaataatgtagtctggcaattttaaatttacagttctgttaatgaactggttgtgaggggtacctgaaccctctgaaagcagatgcaaaaatctttttttttttttgaaatgggatctcactctgtcacccaggctggagtgcagtggcgcgatctcggctcactgcaatctccacctcccgggctcaagccatcctcccacttcagcctcctgagtagctgggactacaggtttgtgccaccatgcccagctaagttttgtatttttggtagagatggggtttcaccatggtccccaggctggtctcaaaccccagagcttaaggagtccgcctgcctctgcctcccaaaatgctgggattataggcatgagccaccgtgcccagccacaaaaatcttaatctgtgtatatttatagggaaaggggctaggcctttcataggagacttaaaatactccccgtctctacaaaggttgtcagaaccactaatgtagtgcaacctttattctctcccctttaaaaaaccatccctggcacctgctctttgtgtaggctgtcaagtagggctaagaagtctatggagaagacatggaggcagatccacagaggagctcatttcttttttatttttattttttgagtcggagtctctgtcacccaggctggagtgcagtggtgcaatctcggctcactgcaacctctacctcccgggtttaagcgattctcctgcctcagcctcccaagtagctgagattacaggcatgcgcaaccatgcccggctaattttttgtatttttagtagagaaagggtttccatgttggccagactggtctcaaactcctgatcacaaatgatccgcccgtcttgccctcccaaagtgctggggttataggcgtgaaccaccgcacccggctggggtatctatggtatggttcttggcacaaatcagcaagttcaacttgccaattgatcagaatttttgttttgggatgaaagaatccaatttctggagctcagaagccacatagtccagaggacctgggggtgaggatgagtcagggtggttgcagccttgccaggcctcacggcctctggtccaagctgacacaggctcactcacaccctgctcttggcccctgggcatgccttctcagatgggacctcttcttggctactgcattctccctgctatttagctctctagcctctgacatcccaccaccacttcattacccaagagaatgaactaaggtctagcaaaggaaagtaacttgcctaggatcacagaggcagggtaagaaccagactgaagactgtccatgctagcctggtgcttttcgcacagccctgcagtggccctgggctcaccagccaaacatgctgggcaatgtgcctacgaagtaataagccaggcttggtacaattgtgaaaggctgtcctctcttgctcagtgggcatatgtcacttgaagctgcctggcagtgctttattagggcatccgaagaaatactgccttaaatggaactgcatcccaagcccattgccacaaccttctccctgttgggaatgtgagactgaactgaacacccggatgcaactgatcctgaggcctggcactgtgccacctccctattgggttcatggcagtccctgcaagcctggctgggactcctctgtcatgcaaagcagctctggcccctccaaggctgtccaattgtcatctgtgtgctactccacccccagcatggggatgaacccaggtgaataggtgggtgacagtgagaatcagcccagggcaggtggtgcaggaaaagagctgggaaagcacttgtctcctttattgaacatctgcagggggcacctctgcactgaccaggcagccagagaagcaagcaggcaggtggtggggggcaggggagcatggggcaggaagacgcccaccctcatttccagtccttgaaaaattgcttgaagatgggactctcatggccctgaggcagaatctccacctgcagggacagcgggggagaagtctggttcacaaagttgccacctctgcctctgcccaggaggacaggagggggccagagccagggaggagggtgtgggcgcctggcctgaatccatgtgcagtccaggctgggaaagctcccctggatgagccatgagatgagaaccaagatttcagggacacagacagaggcaacagactgcttcaagggcgtgggtgcacagtttaataaatgccaccaacggtagctgagccctgtcagctccccacgggatgacttgtggacactgtgctgcggcaggaggggtggcaccagccagggacaacggcccagaggaggagtacccagttctctgggcacccaggagagtgctgcccaacatcctctttgaaaataataagtattttgacattttgaaggattgagatgggctttcccactggatgggtctaagagggaggcctggttgttcctgacagtgcccaaggctctcctgcccttcctggccaatttgaggggtcaggggccacaggaagagccctaggaagagggctgtggttgtgcgcatctcctcacctgagtgttcggggcgtactgcatgcgcgagatgaagccctcggccacctgcagggctgcctgccgctccttctcattcgcttttcgccctagatcataggaaggagatttttaaaaagagcagggaccctctttagctgccatcccatttttcttgaggaaatttaagggagtccacagaagagccagcaatttttacaataaatggaccaggggtcccaagaatgccgaggggctctttggagatgtggagtcagtcccttaagaattttcccaaaccggcagcaccaaggtagatgaaaacccctcgtctgcccgggtctgatcatgcaaaactctgctctgacctgggcccctggaatatttcagggaggggaacaggtgttcaccctagcatcagactgtgaggccgcaggtctccttttcctctaggacccctcacctcttgaattcatcaagccttttctgaaaaactaaataagacaaagggtacaatttattatagaggtgatttactcccataatgccagcagggctacactggcctaacagttatgctaactaagcacttacaaaaatgaagaccccacgtaatccagtcatttctgctagcagtcctgagaactcaaactgctcattccaggcttttttatttttattttttctgagacgcagtctcgttctgtcgcccgggctggagtgcagcggcaccaacacggctcactacagcctcaacctcccaggctcaagcaatctgcccacctcagcctctcgtgtagctgggaccacaggtgcacgccaccacactcagctaattttggggggttttttttttgtagagaagtgatatttcgccatgttgcccaggctgccagacatttttccaaggaaatgataccgaaacgatgccgtgatgtggttggctctctaggcaggctataaaatgccatgaactacaatgtatctgaaattaatatgctggattccttcctctgtcaactgaccagctgcccccctacccatgagatccttctcttcctggcctcccaagtttcctgtttttcctctgatttctctttccatagttgttgggttccttgctccggtttatacatgcttctgtgggcctctgtgaacccccctctgcttggcattggttccatgggatatgtgccctctggcaggagagaaaaggcagccctgcagcacacgcctctcgctttccactcttttgctgctcccagctcctccctttcacttctatccctgctgagtttcagaagcaatactatgaaatgcctggtagcagctatctgtagatacccacctacttgtctgccttcctgaccaggctaggggctggcattttctccaccttggttgaccccacaactgggtgttgagcaaatgctattgctgaaaattctcagaccccaggcagagactgagaacaagtttgtttcattttcagtcaaaccaagcagaacaggctctgcccaacagtgtttctatttccagaagatagaatcttttggaaaaacaagttctacaggttcaccactcactgcataaaatgatgtttaatttgtctaaaattcatttctgtcaaaccttgagacagaatcccaggatcaggggtcccagaagccccaaaggtctagagctgggctagggcagtggttctcaaagtgtgatccctggaaccagcagcacagacataacccataaccttgttagagatgcatgttctgccccactccagacctagtgaatcagaatctatgggggtggagcccagccatctaaacaggccgtggggtgattctgaggcttgctgtagtttcagagccattgtctagaatttaggaggtgggaacagcaaagagaaaatggcgaggcagtggctcacatctgtaatcccagcactttgggaggccgaggccggtgcatcacttgaggtcagaagttcgagaccagcctggtagtgaaaccccatctctactaaaaatacaaaaattagccaggtgtggtggcacgcacctgtactcccagctactcgggaggctaaggcaggagaattgcttgaacccaggaggcagaggttgcagtgagccaagatcgtgccactgcactccagcctgggtaacagagcaagattccttctcaaaaagaaagaaagaaagaaagaaagaaaatagcaaggcctatgccatggctcacgcctgtaatcccagcactttgggaggccaaggtgaagatcactggaggctgagagtttgataccatcctgggcaacatagaaagaacccatctctatcttttaaaaaaaatttttaaagagagaaaatggtcagccagaagcatgcaggcttcctgaggctgtcttttacaagcagctagacaggctgagtcctgcaaagggaagcctgcccgggtcagagcagctacaggcatctcaggctgttacagaggagccacgtacccttccagatatagatcttgccacagagcccgttgtccagcacaaagcagtcatcagatatcagcagttcaagggcaaatgggctggagtcagccaccttggtcaggttcatctgtccagtggcatcagagacctggggaggagggacagtgcctgatctcaccccccacacaccagccctcacctcagcctgaggagggggaggctggtcctccctaggtccctcccactgtgcctcgctgcccactgcccaggtcccaggagcagacaagagagtgaagacctgaaaagcaaattccaggcagccccactccctctcatcaccccaatccctgcagcacaggggccccgaacccatttggaaattaggtggattccaaattacaaagaaatgcacagaattcaagaaagaaaagctcagcattggcttcaagccttcaccaagcataggctggaagtgaggtgcactcatctcctcaggagggcctgccttccgcccactccccatccttgtctcactcccagccctgtataactccccacctcccacctcggttccagccccaccttccccctgccttctcccctccaccctgcttgcatgcagctgtgctgtgcaggctcccaccctccctgctgccgggtcccagggcaggcttggggggcccaccttatacagagctgcggcctgggcatttgccttgtcagctgtgaggtcttcctcagggttgccctccttcagagcaggcttggggcccaggacctgcaggggccagggcaggccaggtttatagggacccctgccctggaacttcccagcccatcatgcccagggccactgcttctggtggggcaaactgcgccctgcactagggcacccagcagaggtgaggtgagtgagggctgagtccagcccaccccaccagccaggctgctcagcctcgaggacgagcatctacccagaggggcaccctgtgagctggccacagccctaggcagtacaccagatggcccctgccaccctccaccggccactctcagccctcagctcatcaccacctctcttggccactttcaagcagaggctcccagccacccactccaatgtcccccaacctggatcatctcagcaggctcctccccatcagtgacaatctccacctgggccttgccctgtcgctcactgtcccggatggccagggccaggtccctcgccttgttgcgttccaggatgttggactttccaccacaccaggcgaagatgttctgcaaggaagcaggaaagtccgggtcagagccagatgcctgtgtcctgctccccagctcagagaagggcgcacagctctccctctctcctctctgaactgtccctgaggcaggacaaccaggaaggcagagcacagcacagagggctctctgaaaatgcccacgaccacccactgcaactgtttctctgcccacctgccatctgtcttcctttctttttttcgagacagggtctcactctgtcatccaggctggagtgcaaagacgtgatcatggctcactgcagccttgacgtcatgggctcaagcaatcgttgcaccttagcttctaagcagctgagactataagcacttgccaccatgcctggctaatttcttaattttttgtagaaatggggtcccactatgttgcccaggctggttacaaaccgctgggctcaagcctctttctttttcttttttttttttttttttgagatggagtttcgctcttgttgcccaggctggagtgcaatggtacaatctcagctcaccgcaacctccacctcctgggttcaagagatcctcctgcatcagcctgccgagtagctgggattacaggcatgtgccaccaggcccggctaattttatatttttagtagagatggggtttctccatgttggtcaggctggtctcgaactcccgacctcaggtgatctgcccacctcggcctcccaaagtgctgggattacaggcgtgagcagccacgcccagcacctctttatttttcttcccatcacatatctcctatgtttaaacgtctcttaaccacctatctccacctactagaaagtgagcttcattaggacatgaaggttttgtttggctttgctcaccactgtgggcccactgctaaaacagagcccggcatggatttaggcgcaaaataaatattgactgactgagtgaaggactggatgggtgaatggctgaatggctccttgagcgcagcatctcacacttctacccaccgccctgccaggcagagcccctgtcacctctccttttctggtaatggcgaggtctgttcacctgtccccttccttgtctcagcacgtgtagtcctcaccaagagctcctggattgatctccctgccccaaatcttcagcgccacaagacgcagcccatactcctcagccagccaatctcctcatgacctagggctcaccttccaccttgcttaggaatttccctccccctgctcctgtcccccagcccgggtcccagtctcactagacccctggtgtgtgcatgtctgcacccttccccaccttggtggctcagctcaccttctccctttgcctggagtggcatctcccctcctataggtctagtccaatgtcaccttcctgggacaactggcttcggctcaggctagagggcccctccctgccccaagacccccccagcacatggcagctgtcccccttaaagccctcatcacatcctgcctcaggttatggcaagtgactggcccatcttggctgcctccccagagcgagcttttatggtccctgtgctggctcagagagagcatcatagattcactgaacgaagagataaatgactgaattaatgaatggtctggcaggcagtgaactcagaggcttccaagaggagggaaaaagctccagagcatcagaggcaatgtctagatggcagaaggaggctggcatcagtccttacaaatatagggacattctccaatggtcagagtgatctcacttggaatgggtttacggcttctcagcttctctccctctttcctggcctcctgcccctccgtccttataaaggatggtgccaatacggagtgctcagtctggccagcctacccacctggcccaggtccaggatgaagcagtccccagtgttgaagctgtcccagttcagtgcccgctcggtggcacggatgttcttcttccccttcacctggtagagtttcttgatggcagctggggctcctgtggaggtcttgtgaaatgctgactccacaccaccttcctgcagcccagacggcccatctgagtggactgacaggagacccagagccctctgcaccccatcccactggaagacgggcagaaaggtggggacccggctccaaaggcacccgggtcttctgcagggtgagaaccagccagaagcagggctggctctgagggaagctgcagggtgggggtgcctagaggtgggctctgacctggtacttgaggccccgtgggaagtagctcatgaagaggtcagactcattgccctgcacctcgcggtgctgcacaggccgctctcccagcagcgtgttgaggtgcacagccagcacggcacaggccccctgctcatcccgggatgactgctggcctgggacaagtgggagagggcagggcaaggcccttgtgatccataccagccccctccctccccttcctgggcccaaccttcccccatccagatccccttacctatccacaggtgcagatgggaaacctcttctgggccattgtgcagcactaggtaggagtcccccgagaagaagacgccctggttctcttgcgccacaggcaccggcttcagcttctccacccgccacacatgcaggcctggatcctgcactgagcctgggaatggagagccactgcgagaagagagagggttgacagcagcctggacccacttgcccaagcacagccctgggcaggcctggcgactgcagtctggggatgaggagagcagtggggaggggcagcccttggaggtaaagaaggggaagttgtgaaaggagatggggcatgcagcttacctctggggaatggctgtgtacatgctgtcttcagatctggaaagaaagaagaagccattattattacaaatgccacaaaaaggacctctcacgtggggctggagaggccctttccagtggccaagtactttcatattcatcaactactccacctctaggagccctagttccattatgcagacaaagaaaatgagtctcagaaatgagtccaaggccacacagctagtgagtggttcatggaaataaggtctctgacccctgggccagggtcttccgtctgctgagatctcacagaaattaaaataaaagcagaaattaacagaaaacagaaacaagagagaagagcaatgaattttttttttgagactgagtctcactctgttgcccaggctggagtgcagtggtgcgatctcgcctcactgcaacctccgcctcccgggttcaagtaatcctccggtctcagccacccaagcagctgggattacaggcaacaccatcacacctggctaatttttgtatttttagtagagatggggttttgccatgttgcccaggctggtgttgaactcctaacctcaagtgatttgcccatctcagcctcccaaagtgccgagagtataggcatgagccaccatgcctggcctcaagttggcttttttttttttggagacagagtctcactctgtcactcaggctggagtgcagtggcgtgatctcagctcactgcgacctctgcctcatgagttcaagtgattcttgtgcctcagcttcccaagtagctgggattacaggcccacaccaccacgcctggctaatttttgtatttttagtagagacagggtttcaccatgttggccaggctggtcttaaactcctgacctcaggtgattcacgcgcctcagcctcccaaagtgttggtattacaggcgtgagccaccgtgcctggcaagttgtttttttaaaccgataaaattgataaatctttagacaaactgattaacagaaagagaaaacacaaatatcaatacagaaatgagagatgtgagatcaccatagattttacagatattaaaaggataaagggaatattataaaaactttatgccaatatattcaaccacttatataaaatgggcaaattccttcaaagacacaaattatgaaagctcattcaagaagacacagattatctgaacagtggccatatctattaaagaaaataaatttgtagtaaaaaactcgttcccccgccaaaaaacccaagcccagatggcttccctggtaatttctaccaaaaatttaaaaaggacataataccaattgtacacaaaatcttcaaaaaaagagatgacagaacacttctcaattcatcctatgctgccaacattctcctgataacaaaaccagataaatatattatgcaaaaagaaaattacagatcagtatctctcatgaacatacacatacaaaaattaacacaatttggctggacacggtggctcacgcctgtaatcccagcactttgggaggccaaggtgggtggatcatgaggtcaggagttcgagaccagcctggccaacatggtgaaaccctatctctactaaaaatacaaaaatttgctgggtgtggtggcacgtgcctatagtcccagctactcaggaggctgaggcgggaaaattgcttgaacccaagaggcagaggctgcagtgagctaagcccatgccattgtactccagcctgggtgacagagtgagactccatctcaaaaaaaaaaaaaaaaaaaaaaaattaacaaaattttagcaaatgaaatcaaataatatataaaaaataaaccatgatgaccaaatgaggtttatcccaggaatgcaaggttggtttaatatctgaaaatcagggtgatgatagctaataataatgcagtgtatatttcaagatagccagaagagaggatttgaatgttatcatcacaaagaaatgataaatgtttaaagtgatggatatgctaattaccttgatttgatcattatacaatatatacacatacattgcatatgtacaatgaaacatcacactgctcctgctaagtatgtgcaattattatctgtcaattataaatttaaaataaataaataaagccgctcacaacgcaaaaaaaaaaaaaacaggccaaaatttgaaaatcaatgctatacaccctattaacaaacatgtatgtgtaatcacctcaatagatgcagaaacagcatttagcaaaattctacattcattcctagtttaaaattttttcaagcctgggcaatataaggagaccacaaccctacaaaaattttaaaaatcagccaaggccaggtgcagtggctcacacctgtaattccagcactttgggaggccgaggtgggtggatcacgaggtcaggagttcgagaccagcctggccaacatggtgaaaccctgtctctactaaaatacaaaaattagctgggcatggtggcatgcgtctgtaatcccagctacttgggaggctgaggcaggagaattgcttgaacccaggaggcagaggttgcagtgagctgagattgtgccactgcactccagcctgggtgacagagcaagactctgtctcaaaaaaataaaataaaataaaataaataaaaatcagccaaatgtggtagtgcaagcctgtaattccagatcccagctactcaggaggctgaggagtgagtatcgcttgagcccaggagatagaggctgcagtaagccaagatcatgccactgaactgcaacctggatgacagagtaaaaccccctctcaaaaaaaaaaaaaaaattttttttttacccacaaactaggaatagaaagaaatttccttaacctgttaaaaaggcatctattaaaatacaacaaacaaacaaaaacccttcacctaacattatatttaatggctgctctaattctaaactccctccctgagaaatttcacccactcccaggcatcagctatcaattctgtatgcccagcttccctcaaatgccagaatgatgaacactttttctggacaaaagtcattcaagggaaaaaatgctaaacgcaagtattttttaaaaagatattatctttttaaaaaattcagaaaatgcaacagctacggctccactcactgtcgctttcataggttcccatcactagaggatttctttttttggctcaaaatgcagagatcacagagccagcatgcacttcgtacataatacaattcatgctgtgcatccatttggacagagtttgtgtaagatgagccccagtggcacagggtaagggcttggggaattggagggtaaaaatgcaagctggcaccattaggagattcttgggggctggggcagcaggatcaggaagtgcaatatttcgcaggggccagggaagtcaggggtagggggaaggcagatgacagagcagaaggtattaagtctgagtaggaaacaaagagggacaggtcaagggcagtgataatggatgtgaaatgctgtgtgaattatgactttccttttcctttcccaacctacaaaatagtggaaggcatattttggcaccacgattccggaagaggacatgcagagagcagaggtttgcggagggaaactttaacgtttctccatcccacagaggatcacatgctgtgcccacatcccctgcaacaggcagcccagcctgtgactcaggcctgagctggtgaagtggctgccccaagctcaagccatcagggagcgctcaagaatgagacacggagtgcgccaattgtcacctttactatttttcattctgtgtttaactcaaaatcaggcagcctacatgccagagagccacatcagggtttggatgaaaggggtttggcaggccgggtgcggtggctcacgcctgtaatcctagcactttgggaggccgtggtgagcagttcacttgaggtcaggagttcgaaaccagcctggccaacatggtgaaaccccgtctctactaaaagcacaaaaattatccggaaatcacttgaacctgggaggcggaggttgcagtgagccaagatccatgccactgcactccagcctgggcaatggagtgagactcggtttcaaaaaaaaaaaaagaaaagaaaggagtttggctgctcattagaatgaccttgggaccttattaaaatgtcggtactgacaaagattctttgcttggccaaactttaactaggcttctgaaccaccccgtaggcccatctgtgtgcttgtaaaatccggttttagcaaaagaaccctgctaaggccatttacctagaaccccctacccttgatatctggtcgatctgataatcgtggatatctgattgggttcctcaacaccctgcccccgccgccccagtgatgtctgatcactctggcctgtattcagcaagaatcctgttaggggccgggcacagtggctcatgcctgtaatcccagcactttgggaggccaaggcgggcagatcacctgaggtcgggagttcgagaccagcctgaccaacatggagaaaccccatctctactaaaaatacaaaattagctgggcttcgtggctcatgcctgtaatcccagctattcgggaggctgaggcaggagaatcacttgaacccggaaggcagaggttgcagtgagctgagatcatgccattgcactccaacctgggcaacaagagcgaaactccgtctcaaaaaaaaaaaggaatcctgttagctcagtctagccagaatctctttacccttgatgtttcctcttagtaattttcttttttttttttttgagacagagtttcactctgctgcccaggctggagcgcagtggcacagtctcagctcattgcaacctctgcctcctgagttgaagcaattctcctgcctcagcctcctgtgtagtgggattagaggcgtgcaccaccacatctggctaattttttgtacttttagtagaggtgaggtttcaccatgtcagtcaggctggtcttgaactcctgacctccagtgattgcccaccttggcttcccaaagtgctaggattacaggcgtgaggcactgcgcctgggccatattttttttctttaacagtgcccaagcccctggtctggggattctgattccacaggtctggaatggggcttgatcacccatattttgaacatatgttcaaagtgatggtagtagtgccagtgaattctgtccagaacagtgtcaaatgctcacctgcacattagaatcatttgggggcttttgaaaaaccccagtgccagccaggcatggtggctcatgcctgtaatcccagcacactgggagactgaggtaggtggaatgcttgagcttaggagttcaagaccagcctgggcaacatggtgaaatcctgtctctacaaaatatacaaaaattagctgggcgtggtggcgcacacctgtcatcctagctacttgggaggctgcagcacaagaattgcttgaacctgggaggtggaggttgcagtaagccgagatcacaccactgcactccagcctgggtgacagagtgagactctgtctcaaaaaaaaaaaaaaaaaaaagtaatttacagaaaaataagaaagaaaaaccccagtgactagcttccatattggactcattaaaaccagactctctaggtggagcctggatgtcagtgtttgagaagctccagatgactctaatgcttggtcagggttgaaactcctgctgcctcattagatctctgtcccgagaccttttgttccagtctctcctggggaagggtccaccctgacctctggcctttcattctttcccctatcccagccctctgtccaagcccacagctccttgagcttcctcagtgtccatgttcacccttacatccattaaagccccctcatcctaggctgggcacagtggctcatgcctgtaatcccagaactttggaaggctgaggcgggtggatcacttgagattaggagttcaagaccagcctggccaacatggtgaaactccatctctgctaaaaatacaaaattagccaggcatggtggtgcgtgcctgtagtcccagctacttaggaggctgaggcaggagaattgctggaacccgggaggcagaggttgcagtgagccgagatggcactactgcactctagcctgggcaacagaggaagaatctgtcacacacacacacacacacacacacacacacacacacacacaagcccccttatccttccaggcccgtatcaagccccagctgtccaaggaaacttccaggacattaagtggcctccgccttctctgggagttctcccagccctctcccctgggagcacatactttagcctgttttatagcataaactggctgcttcacatctcaactggagcaaggacacacctgatgcctctgttcctcaagcagcccagcaaagagtctattccattccactcaacgtctgtgctgggggcttggcactgggggtgacatgcacagagacaaagaatagcccatgttttatggtttagctgcagggtgcagtgaacaagggagccaccatacccagtgaaaccgcagacgaacttcctctaagtggggaatgtcacagaatcacagatgtcagcattagaaagtgctaaagttgaagaggggagctggggccgggggggaggaataaaacaaaaaaaagaaagcgctaaagttcttatctagtcctgctctgcctgcaccgccctacacatacccatacacgcatagtgcagaaatctcttctatagcatcccttaccatcctcttcttgaaggcttccagtgatgggaaactcaccaccttaccaaacagcctcttctacacctcttaaagcctttacttttccccactctgccatagtgtggtgagttatggacccgcctacctccactactacactgtagggtcctttagggcaggaagtgtattttgcctctggatctagctggaacctcatgcaggtgctcaaagaatgcatttgattaactggacctgctgggctctgattattagactggggtggcacctaagggatagcccaggatttcaaaaggctgggacaggctggagcagccccaggaggcagagagcaggggctaggggtcccagactgccatggggctgggggaggggaggacgcaagtcctgctggctgtcccatggtcctgacttaggctgtctttgaggacacactgggggacctcggagaggaggtcaccgttacacacacctttaaggaaagacttgacagccatcagagggacaaaaatcctgccggggtccagtggtacctttgccttcctcagaccctgattccactgacccccaataggtctcttcccttcacagtccctgcttgcccctaggtgtgaaatgaaacagcacctccacttctcctggtggaggtaggtgcccaccctcgaaaccaaactgaatctcccagcctgggacatggcattctcagaatctaggtccagaggcctcatttggggattccaaatggtttttcccctgataccaaataggtctcctacccttccccagggtcaaccacttcctccctccccacctcctacctcagacagtccacctagaccctcagccaaggtcttccagagtttgcaaaataatcaaatgtgccacttgcatttgaattcaaatggctaggactgccctgccccctccccaagccactcccacccaaatagcatcacaccacagtcctgtcttggggacaggcagcttctaatctgatttcacctccagtctggctgagggccttcaggagcagtgtggtggcctccgtcaggaggtctggcacagctgggacaagccctgacccaagagttcctccatgtgcagcatgggcacagcccacccatcctcccgggcagcttcacagctgccatcagatcaggtgcctggagcctggcataaggctggcaggacagcaggctgggggaactccaccctggcacaatgtggtatccagaaatgtgggtctctgttcccaggccaccacagccagccctcgcctgcccacccaggagggtaccagccagccgcgctggcagccaccctgccaccttcacctttcaacactcctactttcctttcttcctcctacctctgcttcgtaggttcgtcttccttccagcctgccccacccggcttctcacttccctcttacttctctggctgccccaaccaccagccccacccaccagccccacccctgggctccttccccagccggtgtggaggcgatgtcccccgacagggaggggcaggcagtgctgggaggccagcaggcctgaagcagaagagcagtcactggggtgggcagtgggtatgccaggccgtctcctcagaggggcacacagggaggctggaggtccacacagccccaccacagtggcctcagcccgctgcaggtcacagccaaggcaaatcagggagggcatctctgagtctgagaccagcaaggaaagccatgttctccattcagggcctggggcaggcgcggcacagcccccaccgctgctgggttagtcacattttctgggcagggtcactggcttcacattactttttcctcctccctcagtttgtctttctccttgccctgaatgcaagtatttgattttttttaagatcagttttttggttttttttgtttttttttttttcctgagacagggttcactgtcacgcaagctggagtgccgtggcattatcaccgctaaccgcagccttgaactcctgggctcaagcgatcctcctgcctcagcctcctgagcagctgacaccacaggcctgcaccaacatgcccgactaatttttttattttttctggagacagagtcttgctactcaggctggtctagaactcctgaactgaagcaatcctcccactttggcctcccaaagtgctgggattacaggcgtgggctactgcacctggctaagctcagttctcagggaatggctgaggccataaaacattcttcaccatcttccgcatgccatgctgatgcctctcaggtctctaccctttggtctgcttctcattcaccagatgtttatcatcatgacttctgggccctgggccctctgagagacagcccatcctgggttgacccagggcaactatcctgcctacatcacagtcactagaccctagagcttgtctcctccaactcgctggctttctggaggacaccgaggtcctgagagcacaagagactgcccacaaacacacagggagtggaagcccctgcaagggaggctcccattcccttctgaatccctgggggaaggatgagcggactcagtatgaggctccaggagaaagtgagcacccagttatgcagccacacaagcgtagttcctctgcccagaacctagccggcctgtcctggaaaggtattggtcagcaggctggcttgagacaaggctccaggttcagggtcaaggcctggggaccctggagcaaaatctggaacaaatcttcctaattagcagaccttcaaacaaaacctcattatttgactgcgtgggaaaagtctggagaaaatacagtactggataggctgggcatggtggctgtctccggtaatcccagcactttgggagactgaggcaggcagattacctgaggtcaggagttcaagaccagcctggccaacatggtgaaaccctgtctctactaaaaatacaaaaattagccgggcatggtcatgggtgcctgtaatcctagctactggagcgactgaggcagaagaatcacttgaacccaggaggcggaggctgcagagagccgagatggcgccactgcactccagcctgggagacaaagcaagactccatctcaaaaaaaaaaaaagcaatactggatgaatgtttctcattgaaacgaaattgataaaatttcactagagcaagacgggaagttaaatcttctccccaaagaacatggcctgtagctagcatccaagtgtctccatggccaaactgccaggcttaaaaatagggtaatatgggccgggcgcggtggctcacgcctgtaatcccagcactttgggaggccaaggcgggtggatcatgaggtcaggagttcgagaccagcctggccagcatggttaaaccgccatctctactaaagacacaaaaaattagccgggggtggtggcgcatgcctgtaatctcagctattcaggaggctgaggcaggagaatcgcttgaacccgggaggcagaggttgcagtgagccgagattgcgccattgcactccagcctgggtgactgggcaagactcagtctcaaaaaataataataataacaataataatagggtagtttggtggagggtgggaggagggagagattcaggaaaataactaatgggtactaggcttaataccggggagacaaaataatctgtacaacaaagccccatgacacgagtttacctatataacaaacatgcacatgtacccctgaacttaaaagtttaaaaaagaaaaaaaaggatagtctgggtgagaatcccagtagggcctagtccccacaaaaccacaggctgggcggttaacctggtagagtgataagagctagacaatttggctccttactagctgtgcaagtgacttaacctcctggagcctccctgtgccccaatctgtaacacgtgcatacagttaaatgtgaagatgaaatgagatcctatgattaatgagcaaataatacatgctcgataaacccagacttctttctcttccctttagtttgcaatgtgccatcagcacctgaggtagaaatgtgcctggccactcccctagctcccggtttctccacaggaggaaagaaagttaaaccacagagcactctcctatttccatccccagccccagcgctggaaagcttcatagattttggtcacaacagcgcataccttgggtggctcttaagttctggactctgtgacccacggagggaacaaggatcaatgggaatcactgttcctcacactcagctgtctaggctaaagcctctcctatcaccacaggaaaaaaggggagaggtttacacattaacagcgaaacaactggctgggcgcagtggctcacgcctgtaatcccaacactctgggaggccgtggcgggcggatcacctgaggtcagaagttcgagaccagcctgaccaacgtggcgaaaccccatctctactaataatacaaaaattagctgggcgtggtggcgggcgcctataatctcagctactcgggaggctaaggcaggagaatcgcttgaacccgggaggcggaggttgcggtgagccgagatctcgccactgcactccagcctgggcaataaaaacaaaactccgtctcaaaaaacaaacaacaacaacagcgaaacaaaagggccggtcgctcagcctaggactctcgggagcggctaggaactcaatgcacatgctaatgagttatctggtaacgacgctctagaactagtttttttaccagacgcacagtgttcctacccttgtggtctcccctgagcactactgcttagtttgtcccaaatgaagtaaaataaagtatttctttagcacggacccaccctctcccgccttttcttacaggaagccaggagacggcgcgcccctaagagaggaccccggctgtgggagaagaggagggagcggggcgcccccgaaccggctaagcccgttcgacccctacatggggagcccaggtccccggcgaccggaccccgaagcgcactacttgcctgccaacgccttgctccgaggccctgggcgctgtctcagccgccccccgccccctggaggtgcgcggccaggagccgcccccggtgagtcagagggaggggcccggccggtctgagctggcggggagcccctatgggaggctggggcgcccgaaagggtcctagaattgggcgtgggaaggagggtataggggaagctaaggacaagcttactgtgctgtaaactttgcgagagaattgcagtgttcacttccattcaatcgttaggcccccggcctcaatcaccctgtgaacagctactgttctgtgagagcctactatgtgcttggtgcgtcctcacatctactatcattattcctgctggaaacatgaagtctttgggaggctcagagagggtaactaacttgtccagagtgtcacattgctagttcagtagcagaactaagatttttttttttttttttgagacagggtctcactctgtcgcggcacctggagtgcggtgctgtgatcacagctcactacagcctcaacctcccaggctcaagcaatcctccagcctcagcctcctgagtagctgggactgcaggcatatgccaccacgcccagctaaacttttttttttttttggagagactgtgtctcactctattgcccaggttggtctcaaactcctgggctcaagtgatcctcctgctttggcctcccaaagtgctggcattataggcatgagccaccgcacccaactgctgaaccaggattctaacccaggctgatctgacctgcaacacctgacccttctcttctttattcagaggaaaacaggccagcaagcatctgcaccaggaggccaggccttctggaaatgtgttggacagcgatgggtccacacttccgccttggctcctgaatgtggcatagccaacccatgagagatgtcagttgacaaagagcatgaggatcaggccatggccttgtgacacagtggtaagatccttttgtgggaggcagcttcgaaaatcccaaccagaatgagtttctctgaagtccatgggtggggcctggggtaaggaaacaatctttctatctgggtgacctcagacaagcacactccagcaaggagtcctcggaaaccacctcccgctgcctactatctgccttcctttgaccaactctgctcactctgcagactcagcttaaatatccctcctctgaaactccctctgcagtgctccccaggtattctggacatcaagccactgggccacctgcatctacacgcccatgggaacacttctcaggcacacccgatagcaaaagtggatttggatccatgggcaacctggcctgcttccagacaactaggcctctccaaggttgtgcccaggcatagtccttccagagcattcagtttttgttttgttttgcttaggtcaaatttatagtgaaatgcacaaatcatgtgtacatttaaatcagttttgacagatgcaacacccatgtaacccacatccctaccaagatataaaacacttctatcacaccagaaagttccctccccaccatgtgcttcctccaccataatgttagcacctctagccagggaccgtgtcaagtcatccttgcaatcccagcaccctgcatagcgcccagcaggtaataggcactcaaaaaaatttttactgaatgcattaacagattagacagcaaaacccccacattctaatactgcccagattctgttgcctcgggataatcccttaagacttcctagccacagattcctcatctgtgaaacgagaacagaagccccagtcctcctaccttggaaggttgtgaggattcaatgaaaggctgctttttttcttttttctttttttttaagagacagggtctcactctgtcacctaggctctggagtgcagtggcatgatcatagctccctgcagccttgaactcctgagctcaagtgatcctccttcctcggcctcccaaagtgctgggattacaggagtgagccactgtgcccagccgggaggatccgcaaaaagaatgaaggcctggacaatgcaagataccatcaccattattaataaactcctacttctaggatgaacacctggctgaagaaacccaggagagagaagcactggacactggcttctgggcttagctgcttggactctggccaaggtctggggatgtccaggacaatcagctttctgcttctgtgcccataaactcggggtatggactcatttccagtgctgagaagttctgaaattgcaaaagattcttcctagcaagttctcgacctgtcttctaactaccctgccatgtggccctctctgggcctcagtttcccatctgtgaatgaaagcactagactcgaagggtcccttctggctcctctaactccaaccgagaggcacagctcaggctgagcagttgcatttcctcatcacgggggactgacagggatcttttgcaatgctcaattctaacatcaaaattcccccaaatattcctttttttttcttttttcgagacagagtctcactcttgtcgcccaagctggagtgcaatggcacaatctcagctcactgcaaccttcccccccgccggttcaagtgattctcctgcctcagcctcccgaatatctgggactacaggcgcacgccactatgccagctaatttttttgtatttttagtagagacagggtttcatcatttcggccaggctagtctcgaactcctgacctcaggtgatctgcctgcctcggcctcccaaagtgttgggattacaggtgtgagccacctcaccggccccaaatatttatttgaagacattgattcaggatgcttctagccattaaatttgatttgcaaatgaatttttctggatcacctcacaggccctggggaatggccaggggtctgggtggccatattttccgaataaagctcaaaaccaaaactttggttttgccttttcttaaatcactgctaggtgctcaggggcaaccagaacagtgacatgctggaattccttgtgacttcttgggaaagtgggactgtccagtacagcatgagtggcctggggagggcaccaggtgcctgggatggggggactagtcccccagaagacaagtttacccctgtacagccagcgtcacactgggtactcaacaccataacagctaacactattgtgtgctgccactatatgccaggtgctatccttgatatgattttctcatttaatccttgcatttactctctaacatggatcctcttattatcctcctttgacagatgaggaaacagagataaagagagataaagtaggtcaaaatcacttgttctaggtcccacttagtaagcggcagaggatagatgggagccatgtagtgggagtccatgccctccccactatcaccgcatgctagtgccagttgtgagtcctttcacatgcaaacagctatctcagctctttttttttttttttttttttttgagacagagtctggctctgttgcccaggctggagtgcagtggcaccatctcggctcactgcaaactccgcctcctgagttcaagcaattctcctgcctcagcctcccgagtagctgggattacaggcacgtgccaccacgcccgggtaattttttctatttttagtagagatggggtttcgacatgttggccaggctggtcttgaacccctgacctcaggtgatctgcttgcctcagcctcccaaaatgctaggattacaggcgtgagccactgcgcccggccataccctcccttttgaggtgaggctcttgaaggcccagacctttcctccagtgctttgaggtctgatcctgatgataataacacctcactcataacctggacttcacagtttacaaaacacccctcctcctcaccccctcccaaactcggtttatttttgtcgttaaagcagagttgtaggccagggtggaccataggttttcttggtcacgagagacttcctccctccctgggctcccctctgtagtggtgccaaataaaaatctgatcagtcaagcctgtaaggtaactagcgctaatgtgcagagccagtcctgggcaggcctgttcattattttgcacactcttacaccgaaagggcccaggaccctcgcctgacccagccttgcctgccaggcctgggctgggtctcccagcccaaattctcacaagagggccgactccggccagagcgcgcccctctttgtgcctcggtttgcccacctagaggtcagtcccgcaggcgtggcgggtacatctcagggtcggcagaaagtgccaccgggagcccagccggagttgagggcctcgcgccgggcccactgtccagatccagggctcacgagaaaaacgaggacgcaggagagccacacgccaggacgcgtgtaaggccccaacccggccccagcctgggccctagacccctaagaactacaaatcccagcaggcagtgggccgcggggcggggtctcggaagctgcggcctgtggtgcctttgctgagcccaggtccggagggccctcggggacgggagcaccacaacagacccccggacacacttacacacacagtctcacaaacacacagtcacacacgcacacacacacacgcgcgcgcgcgcgccttttggcccctcccctacaaactacaaatcccggcaggcagcgggccgttgggcggggccttgggtgctgatccggacgcaaagattgcgccagccagggtgggatcccggtagctaggtgggggctaccctgctggggaagagatggccttctctcctcgcaaacccagctccccacccctgcacgcgcccctctgccctggagtcgctggtccgagccctccttctctgcgaacctgagccccgccctgccctccctacgaggttggggccgtgggagatgaagatggtgggtggggggttgggcccacagcctgctaagcaggcagagtggcctcctgaacccttcctccatcgcctagagcaaactcccattcctggaaggaggagcagcccagaccctgagactggactaggtctgttagggtccctgtgtggccggcaggactcgtggtgaagcccggggaaggcctgggtcctccaggtcagggatgtaggtcccagggtgtgcaggccgcggtatctgaccatcgtcggcgccctgcgcccaggcatcaattttacatggcagagtcaaggtgaggttaggaggctgccaggaggtaataaccagggcgctcgcattcagcatcctctctctcaaagcactctcctcacacctcagggtcaaatgtcagagctcttgtcctaacttcccaggttgcccaaggagcttctgaggcgctacagaagggacttacccagacccttcagtgcaagccaggaactcagggtccggcctgctcggtaggatgagctgtgctgaggccctacttcatccacccttctgggccagggcagcctctttccagaggcctcttctcagctgatttctggctcccaagcgggagactcaggttacacctgtatcgggagcagtgacaccacagtggccagcaacacattggactttctgtctccaactccattttcagcttttacacttcctgatctgggcatatactgctacatactggatcatcaaggaaggaggaa

SEQ ID NO: 751 - DNA, 1243 bp, Homo sapiens
ttgaattccactatgcaagggtaagtgaagaaaacttactttgatgttgttgagttaggctccgttactcaatataacattttttaagattagataacaaatggaataagttatgattgctgctgacacagctgcactgaaaatttcctctgaatttaagtattttcacaataacttaagattcaattcccgaatgtgaaggatggttaatgtggattcttcaaggtagtgttttatatgtaaagataatttttacagaccgtaagatatagtacctttagaatatttattttaaaatataattgttaggctataggaaaagtggcttttgtatacttttataataatgatcattaaaaatgttctcacatcactgaggcctgtattagtgcacttactttgttttcatcatttaaaagcactattacgagtttttatttataaagcacaacatggagcatattaacatttttatctccccccatccctgtagtgaagtggaatttatagtcactgactttttctatattataccgtgtgacttcttttcccttgtgtcaaacattgctgcctttgaaaaactggtaacctcctggcataagcatatttgtgagtgtttatcctgtatttgtgtgtttcctcatgtttttcttgagttctctatcaaaagttcttggagtacagctattctatacccagtgaaaagtggaattataatcatcagttgagttggtgatagcgtttatcttctcttggaaatgaatagttgagcctaaaaaggatatcaacctgaaagagaattcagagccaatatttttcttagataattattttcaatcatgttaatactcagacactcacaggtacacagatagttgttgaagtactcaaagttctacttcatgtaatggttttatcctttaggaccttacctgaccatgttctgggagaggaacattagttcttatgtttcacaaagcttatgtcaatctttcctttaaaagaccagatgaattgctttcctcacatgattttatcttgtaattctgagtgttacttggaaatctttttgtctgattccatttaaaatgtgtctcttagaaaccttcagctttctttttttttttccttcaacttttattttaagttcaactttctgctttctttaaaatatgcccctttattttccttccttatttagggcctatatcttttgaacatgattcttaaaaatgtaatgtac

SEQ ID NO: 752 - DNA, 2155 bp, Homo sapiens
aattctcaataactatatcattaataccttatgtatacataggagtttatataatgcatttaagtaacaaagaatgtaacatttattagccaccaagtaattaggagatagcatcaattatattgaaagaagatgagtttagatgcttatagccaagggagttaattgaaattgaaagctattgtaggtggttactactattattatcaaacctgaaagttggaacatgtgaacttgatcctttgcacacataaaagttcacaaagctgcttttaatttgcctttgttctgtagtactgcttggtgaatcatgcactagtttgttgtaaaattcatgtaaacttttatgtatacaaatgtcagatcaagcacaggttttattaattatatatattttaaactgccaacagcaaaaaacaaaaacaaaaaaccccagaggccaataagtgaaatgcaataaaaaatgaaatttattcttttggctcaataatgacgtagctcaccattctttttagcaatagcaattccctgcatgcagttcttcaatacactacagtaaatagttttgtaaaaagaattaacattaaacttttggtttgtgcaaaaaacaaaaatttatatcatgttaggtaattgcacaactttgccactttgttcatggctaaaaagaacaaagtccatgttatatttgtaatagctttagtgcagcaggaattaaaaaaataagactagtctgcatacgtaaatactacaaaagttgaataaaaaaaaacatctatgaataaaaggttatattgaggcaaccatagttggtagaaaatgatctaggtttgagtgtttgaccaatgtatctcctattggaatggtagaaaatatattataacaaagaaatccataaaacccattatctaacttttattttaggaaattatccattgaaaaatcttatggattcaaaagtttggaattgtgattaaaaatcaaaagcaaaagcataaagtaaaataaattgtgatgtcatcaacctgaaaataattttcttatgtacaaaatgctgacaaataaagttgattatatttttacattatttatatttaaacaagttttagacatatttttagcaaaatatgaagaataggttttgtcagtaggcagtatccagtgtgtttccttgaaatctagagagataccatatgatactcatgttgaattaaaagtgcaaaagtaaaggtgtttgtaaatagcttcaaattattctgcttgacataatggacagagcaggttgaattcattctatcaccaatatgtgacattctttaaccaagacttgtgaagaatggattgagtaaaatagagcagcataggcaatattaacatgcattagtgatagcctttaaactatgtttaatgaatgatacaggatacatccctgttggaagcttgcaaaagacacatacactgtggtacatatttgatttaatagaagttgtttatcaggctatatatatatttgcccaaacatgcaccacaggataaaataactatttacataacatagggtatttaattgacatagactatcagctttgctgagagcagaagatggcaaagcaatactgcagcagaaagtggaacaactattctaaagcaatactttagatatatttttctagaatggatttattagattactttttggaaagcatttgacctaaattaaatatagagctctgaaacttagaataaaatttgcacttgctgaaacagaatactttgcataaaaataatcctttaaatattagaggagactttacaggcacataactgttcagatagaaacaaacataacagactaaaatactttcaaaattaaagccatctagaaaatggaagtaactgaaactgtagccattacaattctttttctggttttgagcaaaaattttatctctctggcaaaacacctttgtctgatcatttgagagacagggttcttgtatactgtttcttcaacgtaaacctcatttacaaaaatagtgacatagcattatgaataaactatgaattggggaccatggaaatgcactagaacaaattttgtaaaaatatggcagatatggaagttaaaaatagaatggatgcaaggactgtacta

SEQ ID NO: 753 - DNA, 86612 bp, Homo sapiens
tctatgattctgtgcatctctttcagtaatccaaaaatttcagattagcccagagacactatgttttacttctgggacccttgtttctggtcatgaaatctgtgcttttttctgataatccaaagatttcccactccttgttgaagcatgaaagcagattttttcagcctagtcttctcccttccctttatgaagatgggtttatccatcctaattcaagataattaccgtggtatggaactttgcagaacactggtagtctgatagaagttagcctagtgactgattggcaggtacctagttaccaaggagaaacaaactcaggaaatcatgaaatcatgatgtaacagtattggtgcctgcactagatcctccaagctgtgtgtcagatcaatggtctggaatccacaagactgtaggtgagctcttggcaatcttactgctcactccctcattcctcattcctcctcttaacatgatttttaggaattcctagaagggtggaaaatcattgccttcccctcctctaataatgtgagcccatgcccctaatttctccaaggcagatgatgccctggggcgactctcacccttttggggacccaagtgtaaaaacattaatcccaacatcctgtcactcaaataagaagacattcattacttataaataaatggtagtggttacagtataaatgctatgtatacaaatgaagacaaactataactataggtcagtggactattgtgatctctaaggatgcctgctctttgtcaattcagtgcagtgcttgttggggagggtggtgtctcacaattagcttctggagttcaactacaagtgttctaagaaagagttagtttatgtcagtcctaggccttgacacattcatgtgagtcagttttataactttctgttcctggatgcttccctctcaactattagtccaggcaggcatgtgctaaaattacctctctaaatcttatcaagcaaagatttgttggttagactttgcccccaaaaaaatgtgtctaggagtgggtctaaaaccggtgttggccgatgttctgttcttaggaaatggagagccaggaatagaaggatctgtgttagtagttctcaaacttcagtgtgcagaagaatcacccagagagctaggttaaagggcagattaatgcaccccagattcttctggcgtagtcagtctggactgaggtttgataaaacaagcatggcatgataataatgcaggtggtctacagtctaactcggagacgcattgtattattaaatcttgtcctctgtcatttgctgcgatgctctttacctctttagactgaaaatcacagccactcttctggttacatagaacaacttactgtgataaaaaaaaaaaaaagatgaactttatcttctaggctttgaaaacggtaaatgcagtcttttgtatgtgccttcaagacacttgaaagtcactttgtggctgccacacagagatagaacaaacttagggatgcctctccccctgtttcatctcagaacgcctctctcaggactctttgtctcacccaggcacctcaaggttttggtgaaataaagcagctcttttttctcaaaaacattgttaaccctggtccgaaggtttaaaagctaggatatctgggttttttttaataccttgatagctaaactttctaaaatttctcccttcatctttgtgagcccaaatagctcgtgcacaaaagcctgtggatttccttcgatgagaactgaaatactattccctttatgctaatgttaattttcaggcagtgagcttggttaactatgagaaaataaaaactttagatggaatgcattatttatagtgaatgcaaagcatcattattatcaattcttgttacaaaatacacagaaaaaatatctttttgttatttaaatattgcatggctacattgagaaacagtacagatgttaatccacagtctctcagctgcatcctgagtaatcattattacgttttattcttatgtggaataactagtaatagactctatatttctgtatgaaattcaaatcagggaacaccaatgaattgagatgattgatattatatatacacacacataattttggaattggggacaacaatggaaatatttctctcttagagaaaatccaccaaacttgttgctttattagtgatcttgacgaataacatgtttcatttacctagatgtgccaaaaatcacttaattctttaccattgaagtgagctcacatttgaccagtacttaaatatgttttgaaaatatctgtgtaattgttaaaaatctgaaattgaaatgtaaatatctggattttgaaatatccaactttaaacacaaattttttttttaaagtgcatgtttgtgtttttttttttttttttttgagacagagtctcacagcatcgcctgggctggagttcagtggtgtgatctcggttcactggagactccgcctcccaggttcaagagattctcctgcttcagcctcccgagtggctgggattacaggcacacgccaccatgcccggctaatttttttgaatttttagtagtgatggggtttcactatgttggccaggctggtctcaaatgcctgacctcatgatccacccacctcggcctcccaaagtgctgggattacaggtgtgagccaccgcgcctggccatgtctgcgtacttttattccatgattttattttgtgtgctttcataaatcttctcttttttggttgttttaactttttattgatgtggtattttataaatggagtaaggagagacagtggtagtggtgatatgattcatgacatctttgaatgcaaattaaatgtgtaggtacatgtgtgtttatgggaaaatattcctggctgttttccctgtctttgttttttgttgttttgttttgttttgagatagcgtcttggtttgttatccaagctggagcctgctggcaatgatcatggctcactgcagccttgatccccccagatcaagccatcctcccacctcagcttcctgagtagctgggactagaggcgcatgccaccaagcccagctaattttttaatttttggtagagatagggtctccctgtgttgctcaggtttgtcttgaacccctgggctcaagcaatcctccacgcctcagcctcccagagtgctgggattccaggcttgagccacgatgcccagcctgttttcccatttttaactgataaagaatcactggcctagtctaatcttattgatttatagatgaaacacttcaggcatgtagagactaggtgattttcctgaggtcctggagttagtatttgacccaaggcattgaaactcagtccatggtctttctgaatcctcacccatctctttctcacaacaagatcgtgggccgtcctcagtccccagtaataagatagaattctgtttggtcattttgtcttcttaacttttcttctatttcaaccttagcatgaagtgctttttttttttttttgtctgagttaaatgttaaatgccttagaaattaccttaccaggcttcacctagatccccaaaccaactttattcttttttctcagcactgatgcacctgaatgaattcagtctcatcctatcacctatcaacaaaaggctggttatgaagtttttccaggatagcagttgcaattcttgcccttcaaaataatcacatataaggggactgccagttgcagggtgatatttaatataactttacatcatagcctctggtgattctatcttaaaactcatcaggcagtgcctaagtaagctaattgaatacattaaaaattgaaaaaaatacttcaaagtaaagcagattcttattgatcaccgtgtgttatatataccactgtacttggtaccacaagagatacaaaaataggtaagatacagtcatgctttcaaagagcttataatccaaacaagggaaaataaagtgtactctatgttaggtgcacttagtagaaaaagataagcgtcttgggaaatatagttttaaaattatattaaagaaaaaggttgagggtctagcagagtcttccaggaaaaagaatttgaacttgattttgaaaaacgaaaatcacttccatgggcgtaagcggcgagatgcattttgaacaatatttattgtgtgcatagtctagaagcatgtgtactcgacactgccacttaaggtatggtttgtggatcattccagtctttgaactttgttactgctccgtgacaaaataagtctcatgcatccagtttctcttattgagagaaagcacttagaaatgcatggctgtttaacatggcttcaccatccaagcacataatcagtggactcaaatcattgcacctgttatagaccagtttgggcgttactgagtcatctgtggtacaggctatgtgacatttatgcaaggtagaccatatatggcttcataagacgttgggaaaacaaagaacctagtccttcgctgcagataatgtgagaataaagactgtaggttgttctttatttgcatacatagtcattttgaggaagtgttgtgtatattagcaatacggagctgttactcattattgacttatttacagtatcgtccttgcttctttctaattttatcatctcattacagcacagaaaaaaatgttagctttatgacactagacagccatccacaatgacagtagcacaaaagggatacgggaagcacaaagtaaaggggtaggctaaagacaagcagaacaatacatagaagagagaaagggagacgtcaagcagcctgcgcctggaagttgttagtaaaattagtgaccaatgtgaaataagagggcttatattttcacttcatcataatccacagaagattaaccttcaatgggaaattttcttctagaagctgaaacacagcctgttgtgccttactattttttgttaatttctttctattattttccttatgttgttgtttcctgttgttgttcctatttggaagggattcttcattttggacattttctcttctcatttcagatgattccacactgcatggcccgatttttattcaagaaccaagtcctgtaatgttccctttggattctgaggagaaaaaagtgaagctcaattgtgaagttaaaggaaatccaaaacctcatatcaggtttgttgatgtaaaagcatgtgtttccatgcatatagtttctgttattaaaatcaacaaatacttatacaatgctggttacataaagagcttttatttatttattttattttattttattttatatatttatatttttgggaccgagttttgctcttgttgcccaggctggagtgtaatggtgtgatctcagctcaccacaacctccgcctcccaggttcaagcgattctcctgcctcagcctcccgagtagctggaattacaggcatgcaccaccacgcccggctaattttgcatttttagtaaagacagggtttctctgtgttggtcaggctggtcttgaactcccaacctcaggtgatccacctgcttcagcctcccaaagtgctgggattacaggcgtgagccaccacacccggaccaagagcttttatttatttatttatttatttatttatttatttatttagagacggagtctcgctctgtcaggagtgcagtgtgcgaccactgctcactgcaacctctgcctcccaggttcaagtgattctcctgcctcagcctcctgagtagctaggattacagatgtgtgccaccatgcccagctaatctttgtatttttagcagagacaggatttcatcatgttgaccaggctgatcttgaattcctgacctcaagagatctgctagcctgagccttctaaagtgctgggattacaagcatgagccactgtgcccagccatatttttatttttcgagacagggtctccctctgtcacccaggctgaagtggattggctcagtcttggctcactacaacctccccctcccgggttaaagggactctggcacctcagcctcctgagtagctgggattataggtttgcaccaccatgcccagctaattttggtattttcagtagagatggggtttcaccatgttggccaaactggtctcgtattcctgacctcaagtgatctgcccgcctcggcctcccaaagtgctgggattacaggcatgaaccaccacgcccagcccgtaaagagcttttagacaggcatcatagatatcctgaaagtctaaggagatgattgtttcctgaaaagctaagtacccaacctctgtttttcgtagtgctgggaattaaatatcctgattgactttctctttgaaaacattaacaattcataaccacatatatttaacttaataaacatattttaaactatatcagtaaactggcaggaaagtaagaaatgtcagaagtctacaagtaagtgggtttggaaccgaaagaagtaagctgaacaataaagacagttttcatgttaataaactacaagtatgaattgagctttggttttcatggcttcagagaacagaggtcacaagacaaagcctagacaacccacaggagaatccaacatgagaacatctcccagaataaacctgggatacaagggctacatctttacagtaaatgtgaacaagaaataagcttgacttccaaagagactcaaaagcacaggtaattgtgtctttcaaacattaaaccttagtggttctagtagcagatgaaatacaaccgaaaagaatttgtaaactgcaagataggtctgaagaaatcctccagaggcagcagaaagagacaaagggaagcaaaatactttaaaaagaaagagagaaaaaatgtctactcaggattccagaagaagcatcaagaaagactgaggcagaagcaatatttaaagagaaggctaagaattttccaaactaattgaaactttcaagccgtagctataggaagcccaatgcacttcaagcagtacaaataaaaatgaagccacatctaaaatagtgaaatggtagaacaccgagtcaaacagattatcataaaagtaaccaaacttgtaatacagatgacattcaaagagatcacaaactggcagctgacttctcaatagcaacaaaaaatcaggagacagaagataaaatattcagtacagtgagagaaactgtcaaatgtatggatagcctaaatacttcttttaaagcaaaacaaaataactacatttttaggcagacggcaaccaaaatctgactccagcagaccctcactaaaggaaattttaaaagacatacttgaggtggaagagaaatgattccagatagaagagctgagctacaagaataaataagtaaagcaaatggtaaatgttagtaattccacaaaaaaatttattgcacagaacaataaaaataataaaaagaatactgtcttgtgaagataaaaagaaaagttaaaattcatgacaacattagaaacaaatttttaaaagatgtactagacaatggattgtctatatggttaaagaaataaaattggaaccctactgcgcagcatacacaaaaatcaattccgagtgtatagaagacctaaatgggaaatttgcaatacttttaaaagcagatgggtttacatatttatgactttggggaaggaagagattttctaaatatgacagaaaaaatacaacttataaaagaaaatatttaactgtattaatattgaaaacttatgttcaatagaatatactgaaataaacaaaattacaagctgtaaacttgaagaagatttttaagtatatttgttatgggtaagggattcatatccagactatttaaagaatttccacaaacagaatgtaaaaaacaacctagtggaaacattagctaaacactttaacaagtatttctaggaaaatgaaaaccaaaaattcagtaaacataaaaagattgtcaatatcattagtgaacagaaatatataattaaaactacaacgacatactctttcaaaactaccagattgacaaatttagaaaactgacaatctgttggtgaagatgaagagcaaacagaacccttgattgaacactgctggtagcaatttaaattggtaaaagccattaaaaaaaaaaacactccctagtaaagctaaaggtgcacgtactctatgatccagtgtatatgattatgttcatagtatattcacaaatacacataacctggtatgttcgtacaaggtaacctcatacagtagtaaaaatgaatgaatgacagctgcaacaaatgggtagatctcaagaacataattttgagtaaaccagttcacagccaaatgcatagtatgtaatttcatattcataaaatttgaaagtggttgagatggagtggttgttcaaggtatagaggaagtaacagaggaagcaaaactttacccctcctctcttaggatttttcagctaagcctgagaattaaattaacataaagcagatcaaaaggagaaaaacatatttatttaatacaagttttacatggcaaggaagccttcataagaaaatgaaaacccagagatgcagttatcgttgcacatttatttactgaattggacaaagagtagtaaattgtgaaaaagtaactaagttatgtggggagctagaagaaaatattttaacaaggtctggacagagttttctctgtctcaacttcctgtccttgatggaaagaacgttactttccttctaatatagaaaggacatctttggcatggggattttatccttgctttttagaaaaagaatgaaggtgaaagtggtcgtcttgtacctgctgttttccaagtacctttttttttcccccaagtacctttaactcaaaatagtcaatataggcagggcacagtggctcacgcctgtaatcccaacactttgggaggctgaggcaggaggatggcttgaggccaggagtttgagaccaacctgggcaacatagcaagacccccatctctacaaaaataatttaaaaattagttggccatgggggtgcacacctgtagtctcagctagtcaggaggctgaggtgggaagatcgcttgagtctaggagttccaggctgcagtgagctatgattgcaccactacattccatcatgggtgacagagcaggaaccggtctctaaataaataaataaataaaagtcagtatgccagagcagcatatttttgggtggcatgctctgaactccttcaaatgataacatacatgataaaattataaagaatatcacgggaatggaaaagccaaaattaaagattataattaaccattaagaaggagtggtataatcaaagtagatacagcagacttctaaagtaataatatcacttttaaacacagatcttcattggcttatgatttttataacttacatacatcttataaatattatgcctctattcaaatttgataatgaaaaactttaacaactactatctaatattatgtaaaaaacaaatatatatgtcatagtttaggagagactggagtcatcaggtagggttctcagaagaaatgggatatgaactgagataagtaattttcaaataggcagagggtaaaggacattgtattcaagttaaaggacggcagtattagtatagtggatattattttagaatttactttacatgctcatttatccatttgttcatttatcaaacatattcattattcatccttcaaacctcaccagtgtttttcaaacagaattccagggcacatggaattggcttaaagatcaccagagaaagaaaataacagaattttcatccaagattcagcctttgcagctctactttgaactagcccatatattaggattctgaaaaatacgtcatatagacaaagtatttaaaccactctattaagcagctgcaatgtaccagtcagcatgctaggtctgagtattcaaagattaatcaactctacaacatgcttactagtactgttaatttgaggactgcctagatgtggacgtagttggagtagaatgatgtaactacaagtaaaggatgaccaagttctaggtattctggaggaaagaaagtctaattcaggatggcgaaggtagatgtcactgaagtcttcacagaaaaggagatattttaatatatttggagggtgaatggttctttcatcacatggataaggaaaagaagtgcattccagaaagtaagaaaacaacaactctctaatggaccatataattagggtgaacatgtaatttatcatctgaggtcactttttaaagcagaaggccgctgttcataattattctaggacagcaggtgtaaaccaagcacttgtcttgggcaagccagaatgaatagttactctccctagaatatattaaacccaaggctaaatcaaagatttttaaatactttgtgtagtaaagaatgcaggaagcaacggctgttaggtacacacatgatgagttaactggtccttgtttgccttgcgtagccaagtgtaaggtcagatgttagccgtaaatgaaaacacattttgcagcagaatttggcaagtgctgctttgttttcccccaaactgtgacctttaattaacattgcttttgtaacactgtgtttctagatataggagtttgccttgttatttaaagcaagcagtgaaacagaaacctattatgtttttagatttccaggaaacactgagaacaaaactttttaatcaaatgcactagcaatttattgcagtatacttcttgcctttatgcctttggcagtgtctctgtaacataatagcagactggtacctgggagctaaagcattcctcttgttgaaagaaagagcaagacaaagaatggagagatcaagtattttcagacacctttctgcctgaactttttcagtcttcaggctgaatttgagggggaagaacaagtagaagaaattccgaagtgagtctccatggggatcttcagcactaggttctctcctcagacaccgcaactgacctctcttctttgtgtttattccctcaactgagccttctcttttcattgtttcctgcccctcaattttgaaaggattgacccagacccagaaaaatttaagaagttttaacttgtgccaacttcccttatattaaacttccctaaggacatatgacattacttaatgcactcagcatccctttccagatagaagaaatgttcactcacttggtcggagtacttttgctgaggtttgtattcaactgagttggcagaaaacaaattccaagtcataaatgccctgaccttcccttagtgccaagttgacaccatcaacaaagaaagaggattttgctacagcgaatcctatagataccctcccagcaaagccacagcattttaccctccagagtgtcacagcatcggtgtttggttgtgcacaaccccactctctggagagagtggagtcgtggttcctcaaatgattcagaaatcagcttatgagactcacaaatttctcttgtcccttgggaaaatctctattggctccaaatgagcattgcctctatattaccaacacttaaaagattcctcacacattgaaagtaaattgtgaaattttcaagcgtgtttcagtatacagtgagataagaaattcagtgcaatccacattcaattggaatgaacagtgactgcattgcaataaaacttggtatagcgctttgtaatagagactcaactgcatttcggagaaagcactttattttctaaataatcccttttcgtttgctatttgtatgtaaaagcaggcgataaagtagattaatggactttctgcacagcattttagttgagatgactagtgtaggaaaacctacagaggagctctcattatgcccacaaccacttttctaaaaagactcacatggccccactcctaaattccacactctgcttgcagctcacattatgttgcgatttcctttttgagttcttagatttgtcatattaaattgctctactatcatttgaagtaagagttatggtcaagacgtgatcagctgactcaaaaaaaaaatgtctagggcagacagtcagttctagagattcatgtgcacatagagctgctagaatataacctggctgttctgtctttattatactttcttgtctgtgtcagagcacagagaattactgtggagactaaaaacattgtcagtttctaatcccaatcttcttatatacaaacacataaagaggtacctcatgtttctatttcatgctcctggtctacctttcttacctctcttgtttctaaattgttacatttcaaagacatgaataaacatgtgttgctatgtggtagtgtgctggaatgcttcataaattgtggatgttcaaagctaaaatatccagcaaagaagtgaaatatttagttaattaaattcaaccagcatttatggagcacaatgagagtgttagattttagatggctaaagtgagaatacaaaagtgatttaggtaaattatctacagtaaaagcagcattcctacataaaggagcatggacaattccgtaggagattggacaaagctttggttaatttttgttgtttttgttttgagatgaggtctcgctctgttgcccaagctggagtgcagttgcagtggtgtgaccttggctcgctgcagcctcaatctcccaggttcaagtggtcctcccacctcagcctcctgagtagctgggactacaagcatgcatgcaccaccacacctggctaaattttgtattttttgtggaggcagcgttgtgccatgttgcccaagctattctcaaattcctgggctcaagagacctgcctgcttcagcctcccgaagtgccgagattacaggcgtgagccaccgtgcttaatcatctttggttaattttgactagaaatactaaggaagacttcattgaaaggggtgtcactgcaaaatggctttgaagtgggacagaggtcttgacaaaaagaagggattacccttctgtatatttgcttttgttgataccagacatccaaaatcttgaaactaactcacgtacatttttttcatgtaaatccttttacattatgtacagacaaccacagtacccaagaatgttataagatgatacacagtgaatgtgcatgtgcacacacacaaatatttaaatggtgatttttactatttaaaggagataaggttaatggctctcattccttactctcattatggatttggatcagttttgtttgtgctgctgtatctcttaatttttaacattctggtgtgaatgctgctgtgatactcttggtaattcacaaactcctactatgctattttcgttagttaatattctgtgtaagagttgtgggggtaaacgaatcggatagtgactgagttatattagtgcaaacgttctgaagtgtttaaatgacttctgaaaggagatttggtcaagagaagctctcactctttggaatggtattggttgtaaaatgaaataaaaacaaaaacataggtcttattaccaaaacttcgctgttaaaatgtgtgggtcccactaaacctgctttactgggctaaatactctagtcacatacataggtgatccaggtagataaacagaaggacaaaaaacaaaaaacctgtctttgccccgataacctaatagcctaatctgcagtttgctgggatggttgattgatgtttgtgtgccggtggtgaaggagctcttcaaagtgatccacggttaaagcaggtttggtccccacagcagctcaagatcaatagttcctctgctttgcagccagccattgcagtcatattaaggaccaaatcaaagcaactctgctgcaatttcatcagatacttagcaatctacctggaaatagtatatgctgtcatctgtatagacctatttaaagaatgattgcaaactagaaggacttttactgaggagccccatttgaagaaagctgcacaggtgctatgagaaatctgtggcccgccttcaaaacagtgaagtgtttgtagcatcataagtagtcagaagaacattttaatgatattaaaaaaattttaatatcattgtttactttaaaagacatgctctttccatataagcacttaagatgtcaccattgctgggtagagcatttctaacttcttaatcatgctttttacaaaagtcacaaatgatttttcatgctatttatagtttttatatattttagacaattcagaaatattgattaatatgacaagactttatctactggcatttttatactataggtggaagttaaatggaacagatgttgacactggtatggatttccgctacagtgttgttgaagggagcttgttgatcaataaccccaataaaacccaagatgctggaacgtaccagtgcacagcgacaaactcgtttggaacaattgttagcagagaagcaaagcttcagtttgcttgtaagtagcaattatacaatgctgcaaatgttgctttcagtttgtgtaccattataccaataagcttttatagcagtttcattttagagactagattttaattggttacatgatcatctttactctttttcacattttggaaacaattttatttgtaggataaactgtaaatctaagtgagaagatgtattcttctacttcgataaggattgagatagttgattgtatgataatttgattatatgatgctttctttatatacaaataaattcacacactgagattgacacatgtataaatttatgtaaacaacaaatttgacacccacacacacccacacacacacattttaaatagaatgtgtataagcaagcaattgaacaaattttacacacacacacacacacacacacattttaaatagaatgtgtataagcgagcaattgagctgccagtaatttagtagagtcaataagagaaatactttaacgataaaggtgagagttggaaaaaaactcagtagtcaattaatcctacaattctctaattgtttcctatttcacagagttgaaaaaatttaaagcaactgtaataatgacaaaaacatggagacaaagtgttatccacctttgatatttccagcttaaaatgtttaaaaaaacaaataaccgtgtcttaagaccaccatttaacaaaagtccatgaatatatgaaagaaagtggaatttagaaatcacaatttgaaaataaaatccataggcaagagcaattagcatacatttgggtatagccacctttgaggattgaggttcagctacatttttaagggtttatgtatttgcatgtgattatatatttccttgtgtgaaatcccaactcatatagcagtgaattttggcattagccaaaggtttcataaagtctgctggcagtaacactgtagaatattctcattaacaaaatcctctccaggaactcaacatccaatatacctaatatccagttcctaatctattaatgccatttggtggcatttttataagttgggaaatgaattttctaagtattatgtatatgcgagattccaggattattctgttagtgaatgtctcttgagatagtcttctaaatattcgtaggtgtttagaataataggagaataatatgtgtgattgaatgtaacagaaccaaagtgtttctttctcttggtttaatacaagtcttgtatctatattgattttttagtaatgacaaatcttgctaaattaatttttggaaataaccataggatcatgtactctcagagtacgggaaaatctcattatttagtaaatcttgtaattctttgaattttggatgtcatagtgtaggaaatgtttaacacagtataacaccaaaaaaaaaaaaatggagatggaaatattgtatctgggccagcgcggtggctcacgcctgtaatcccagcattttgggaggccgaggcgggcggatcacgaggtcaggagatcgagaccatcctggctaacacgatgaaaccgcgtctctactaaaaatacaaaaaattagccgggcgcagtggcaggtgcctgtagtcccagctgctcgggaggctgaggcaggagaatggcgggaacccgggaggcggagcttgcagtgagccgagatggcgccactggactccagcctgggcgacagagcgagactccgtctaaaaaaaaaaataaaaataaaaataaaaaataaaatactatacccaaacttctttattgacagcttacatttaaaaaaaaaaaattaccagctcttaagattatccttttgtaaaagaccgggcattttactaccaaaacatcagaaagatagaatctcatattcaaggacagtcatttacatagaatagtttaaccaaaacaaaaaacaaaacaaaacaaacaaacaaacaaaaagctctaccactcagttcgtggtgggttgacctgaggacctaccaggaaatggaatccactttgctcattccacttcatgtgtgatgtaggcattcctcccaccctcaaaatccttggctgatcatcatttggtttgaaaaattctagtgacagaaagttcaccaattcatcacgaggcaccctggcccacagcagactgctctacttgttcaaaaatacaaaaacaaacttgacatctctttcttaaaattgagccaaatatctcaatttctatcacattcactcccaattcttactttaaagatgctggttactcttcaaatatgtgaagatatgatcatgtcccttgtcccataattcttttcttcccaattaattaatccacagccatcttcttcacaacacactcaattatgttaattcatctattgcagccttatggaaatgcacagaattccatatatgtgtcttaacttttgcaaaggacactggggacagtagtatctcatgatgtgaacttttttcagttaatgaagctgacaataatatttatttaatcttcatttttaagtaccagccccagattgcaactttattttaaacatataatcatgtaaaatctgagaaagtatttcttataaattcctattcatccagtgctacccaaccacgttgttttattaacctaaattcagaatattgtatttacccctaataaattcatgttctgagtagtgaccctttgttccatcatatctgaaattgctttaagtcttttttttcaatcagacataatgattgttctcctagtttagtgtcagcagaaaatttgataagcatatctccattcaaataattgatataacatgttgaccaggacagggcagcatgtcactagagaatttccactaaaatgaaattaaacctttaatttaatattatttggacactcttgttcaaccagctacaaatttagccaaatatactataatcgaactccaatttcatccacgtgtttttaaagtagtgagaatctttgctaaagccttgctaaaatcaacatgtattgtttctgcaacatccagtcctacctgctccgtctgcatcgtcttgagcctttccttaaccatttatcctaaaactgccagagtaatcttttaaaaaatgtaaattagatcattccgcttccctgctttatgccttctactgtacttagaataaatctcaaactcattaccatggtctcattttaatttctcaaaaatgacaaactattttttgcaacaggatcttgatacttttgttccctctgcctgatcagcttttctcatgatctttcacacagctgacttcttatgatcctcacttctcaatttaggtatgacctcctgagagaaagtttccgtgtcaccctgtctaacataacaagcaatttccatcatttctcctcctctctgctgaccttcctccagccctctacttttacataacagtatcttctatttcacttaccagaattttttgtttttttattttttgagactgagtcttgctccgtcgccctagctggagtgcagtggtgcgacctcagctcactgcaacctccacctcctgggttcaagctattctgcctcagcctccaaagtagctgggattacaggctcacaccaccatgcccagataagttttttttttttttttgtatttttagtagagatggggtttcaccatgttggccaggctggtttcgaactcctgatctcaagtgatccacccgcctcagcctcccaacaaggtgagattacactttgcccagctcatttaccagaatttaatacaatctagaatgattgtgtatttacttttttctcatttattatttcactcctatggcagaacgtatattttaagagaactgagactatcttgtccatccttttatttcctagccatttatatgtttgaataaaggaattcctgtgttacgtgcctgttcagtaacacaacaaagaaaatatatgtataaagttaatttgagggtgatgtatttttatatacccaaacccaccctttctattcttgtaattttctggagtttatctttttgatcattgatccatagtttctagatgtttttccctatcttttgtaaattaaaagaaaatcaaaagacattgcctatattcagaattcactttcaattgattaggataaaatccttttcttcagtgaattaataaaagtgaggcaagacagtgacatcttttgaatgttactagtttctttgactccacgtattgtcatactcattgaaggaaaaaaaaatgttgctttttggccacacttactgcactataccatgcaagtgagaatatttcttcctctttaatcatacaattttatggttaaaaaagacattaaaggtctcctggcctgtatctttttaaaaatgaaattgaagattagagtaacggaattactcattgttaatacatagttaagaagctacagagccaaggaaaggcagtcttcagctcccagtttcatgcatgctggccctactttgctttagatttactctaatttatgagaaaaacaaccttcactttatttaccatgttacaattttcaaatctcatttacatactttctataattttattcagaagatagtcttataaggtagacattatttctattgattattaaaaatgttttcatgctgcttttgtgcacagaacttagtcatgtcttgtattagcatttagcatttttaagttgaattaattcacataagcaaaatttatagctaactagagatgagaccactaagaacttgctcttcctcccactttttaaagtcaatatatttaaaatagaaatccttctttgattaaataaggatagcataatttaagtcccccttgatgagatatggataagcatacattattgtaatgtaattgggagcacattttgtttttcagtctctctgcagcattaagccatcagcaatcactcccctcactgtcacttagcctactaccataccctttctaccttttagcccttctatttcacctagggctacaaatatgattgactagatcctctgtgcctggcacttaataaacttgaaataatggttgctgaatgaataggaattagacattaaagtcatcatgccatgtgtggggcataaggaatgagttgaaccactgagtcaagcacgttctgatggtcctttggagtgaattggaggtgagagcaagcattctcaccttgaggttgatacagaagacagttgacatcttaattccttataagtgtttctattggtgtggcaggcgttggcccacattaaaaggatgcttatggccaggcgcgatggctcatgcctataattccagccctttgggaggccgaggcgagtggatcacgaggtcaggagattgagaccatcctggctaacatggtgaaaccccatctctactaaaaaaatacaaaaaaaaaaattagccaggcatggtggcgggcacctgtagtcccagctactcgggaggctgaggcaggagaatggcttgaacctgggaggcagagcttgctgtgagccgagatcacaccagtgcactccagcctgggcgacagagagagactcagcgagactccgtctcaaaaaataaaaataaaaaaaataaagatgctcatgtatggaatgaatcaaacaagccctcaaagttcgcttttaccctggaaagtcagcctgagactacgcacagcttcatgaagtgtttcaaaggaaagctcctttgagcttaagcatacctccccaaccttcattcactctacactccctttcgtccaggagcaaaaccaagttgaatacttcaaaaagttcttccatagacgaataaatcagaagataaggcctaaagaggaggggatttcagttcgttatttgcacagcttaacgaaggggatgtttccagagcttgtgtctatacagaatgaagtgctatagctccatcaccctagctgcccacttttgcagcccagcatcccggtctaaatctgcttgaggatctttgtgcacagtcactcaacacagcaacttttctctgtcatataaacactgatatttattttaaaaaaataaatttcagtacacacccctacactcataaacaatacaaatcctcatttttttttaacttaggaatgtgggcttgagaagatgagatgttatattgactaagtttagagggaatcaaatgtcgttaattgttccatttcattctatgtgtcctgtgtctctagaactccagcttctcaataccactacacttcccttttaaggttgttagcaagattacattgtaaagcatatgtaaaatcccagaatcatttccaacataggaaagttatacaataactgcttctgtgtttttttgtctgttctctcttccattcccctttctgtccctccatgtcctgtctttttaaaataactatcacttacaaaaacttaattgactcatagtaactgcatgtatttatgggttacagtgtgatacttcaatacctgtatgcaatgtgtaaatgatcaaatcagagtaattagcatacgcatcacctcatgcaactaaactatcatttctttgtgttgggaacatgcaaaattctctcttctgaaaattagagtaaattggttttttgttgttttttgtttgtgtgtttgttgaggtggagtctcgctctgtcacccaggctgcagtgcagtggcacgatctcggctcactgcaacctccacctcccgggtccaagcgattttactgcctcagcctcccatgtagctgggaatacaggcgcccaccaccacgcccagctaatgtttctatttttatagagacagggtttcaccggcctcgaactcctgacctcaggtgatctgcccatctcggcctcccaaagtgctgggattacaggcgtgagccaccgtgcccagctgagtaaattgttcttaactgtagtcaccctgtggtactagagagcacaagaacttatccctcctatctagctgtaattttttgtctgttaaccagtctctccctatccttcttcctcccttccccacctctagttaccactcttctactgtctactctaattctgtcttactaaataagaccaacttatttagcttccacatacaattgagaatatgtggcattcgtctttctttgcttggcttatttcagttagcataatgtcctccagattcatccacggtgccataaatgacaggatttcattctttttatggctgaataatattccattatgtatgtatacttcattttcttgatccattcatccattgatgggcacttaggttgattccatattttggctattgtcaatagtgctgcaataaatatgaaagtgccaatatatctttgatatattgatttcctttcttttgaatatatacccagttgtggaattgctggatcacatgaataactaccattgtatacctaagtatagttgataagagcacaagccctggagtcagactccttggattcaaattcagcttctataatttcgtgagcttgaacaaggtacttttttctgccccaggttgtttacctcctttgttgtgaggatcaaatccattaataattgttaaactcctagatcattgtttagcaaatagtcagggcataataaatgttataatgtgaatactctatgttggatattatactaagcactttggaagcattattccatttagttctcaacacaacccaatgaagcacagatattacttttattttataggtgaagaacatgaaaattaatgatgtgaaataactttcaccaaggatacagcagtgggagaagggaccagcataggaacctggtcacctgagtcttgagcagatgcctgttatatggcattttacatgcatggcttcccttatgctgtgaaaaactacactttaccagtgaaatttatgttcaatccgtagatttgggtggttggtgaaatgtttcctttgtacacaaacttgaattttttgttgcattaacaatctttgatatagtaagtacatccatcatatatttgcttttgtttttaattttttagttgtaggtattcttgatgccatcatactgttgatttactgtgaacatctaaaagcataatgttacatgcaatgactatacataaatttgtggactctaattttaatataattggtttcaggttttataatgagaataattaataacaatatttctgctctaaaagttaagatgcagatttccaatttattgcaagtaggctgtaaagcattttgaatattgatattttatggtgaataactggttggtaaactgtttatccccaagcagtaaatgaaatatttgtataagcttcttactcccatatcatttctcccctacatgtgagaaagatgaactttaaatgtagattattatgaagagcttcccagagaataatcttaatatctaatgactccagattttagcctgtcaaactgattactttataaacattgtttggggccttcatcctggaattttcactttcttgtagtagttcagatctgcaaagcaaaagacttaagctactcatcatctcaggctgtagatgactgtaagtcatacataagtacttccaaattgctaatggtaaaattaaatctttgaacaaaatctggctacctgcctgctgtagggaaactggcattatcatggtcatgggcaaggtggtattattctggaggaagcaaatgggtgatatctatgcttacctctatggatacctcacttaagatgaggaaagtaactagactaatacaccattcatgccctacatctctaccctctgagcatgtgttaaggggaagggcatagaagatgaaaagtatttttaaaaaatggaaaaatggagatgttaagtgaaaggagtgcttacgtacaaaagccacttcattttggccttcctgtgacttcaagcaagcaatctatgaataaagtaactcttctgctgttgcggaatgaagtgaaaaaaaaaaaaagaaaagaaaaaattttaaaaagagagtaatgtaacacaataaatcactccattctgaggttaatttaagttagccttatcagttaagtggcaaacattttttatggtgaaaatatcaattgaataaacagcaactgattagatagtctcattgaaaaagatctttcttatgactactacagcgagccttaatctgagttctctttaactggggcacactctgacaactgtaatgatggtggtggtagtggtagtggtggtggtgatagaaaactttattaaactgagaatgtattgtattctcactgggaattttggcaacctgatttttgagcccagatccttgcttctattcacggtaattttcaaatgttcattgcttttaatatctaataactagcttatccttcatagccaatgagtaaaatgtgcagtcgatcagaacagtagctgggagtttgatacacggctaaactcataactggcctgactactttttaatttggaaagctgcttaaacaggcaaactttttttctgagcgataaaatgtggatggatgactatttagatgaataatctgtgaatatttagatcaactgaaatgtaatcaactttagaaacatttgggtatcaaaagtaaaaatatttttcaatggaaggctttgatcttcaataaaagggtaaatacttttattggaataggtagaagaagtcaaacccaaacttgctgagtttctgaaataatgatagtttctgccactgagtatagtactagacagaaagacattaatggtgataatgggtgtctattgaaaatttcacaaggtaaatcttaggagctattaaagtacagatgctagttaattgtagctattattaatagtttattatgtatactttcttttggtcatcccacagtccagtttggggactgataaaaagcagtttgtgacataagacaatcaatgaagtatagagattgctttaaattcaagaaggttctgagagtatgatatatatatgaaaattggcgaatgaaacctgatggggatccaagcaagattcatcagacttttaaaaaacatgaaggctaaaagagaacaattaatattttgtatcaccataaaaaaaccaaggtactaaaatatcactcctttttgtttcgttgttatgagtaattcagtcaacaaatattaaaataattctgatcatttttaagtttaatttttaggcactgaaggtcaacattcatgtgttgccattcggggaaaagggagaccactttctgaatgattgaaaatgtcacaattgctctaattatatcaatatccttttcttcaagaattttcatttgagaggttatggtgctgtagtacatatattttcacttgtggttaagtcagaatctaattgactaactatagtgatttgaatggtacctgctatagactgaatatttatatctccaaaatgcctatgttgaaatcctaaccccagtgtgatcatatgaggaggtggggcctttggtggtgattaggtcatgagggatctgcccttgtaaatgggatcagtgcccttataaaagtgattcctaagagctcccttgctccttctgccatgtgagtgagaaggtggcagtcagtgaaacaggaagagagccctcacaaggcaagaaatctgctagcaccttgatcttggacttcccagcctccagaactgtgagaaatacatttctgttaagtttcccagtctattgtgttatagcagccctaacagactaaaactgtaactctcaaaaaatgtgtctacctggaaactgtgaaagtgaccttatttggaaaaacggtctttccagatgtaattaagtagatgacatcttccaaaatcacccagatggaccataaattcaatatcaagtgtcctcataagagagtgaggagaaaacacaggagagaaagagactatgttaccatggaggcagagattggaatgatccagcaggggaaaccagtgattgctgaaagccaccagaagctagaagaagcagggaaagattctctcctagagccttcgaaggtgcccagcactgctgacaacttgatttcgggtatctagcttccagaactgcgagagaataaattttttttttaagccattcaatctgtggtaacttgtttgcagtggttccaggaaacaaacaggccaacatatgcacaattctttttcatttctttcctgaccactttgatcaattttttaaaaaaatctttgaatgagatcaaaatcaggtgcttttgtaacttaactgtattagggtgaaaagtattaaagaaatggcctctatcaaatgtaggattatctgtgcaagttttgtctcacactatgcattttcccctggagagcataacagagttttgaactttataaagtatgatttgaccagataatgaaatggggactgcaaaaaattcaaagggtaacctttccctttcccgggtatgtttttacctctcacttggaacagacctctgcaggccttctctgaaataggcagaattggccctttctccatagggcaatgatttgaagtgatgcggagtagtttgttggccctgagtcccgctctctggacttcttccgttttctaggtcattttccctgaattcgacctctttgtctggcactctaaagccctagaaactggctattatcacgtttagagtgtctgacctacctgtggctgtaaccgttccactgtggtctctcaagcgatgttatcgttgatgttatgacatttctagccccagaaagtccctgtgctagtgagggccagcttccgtcctcttcgcagtcagcacctttcccggagtaggctctaacataaacaaggcatttgccttctagctgtcatgtattttatgcaccatgctagctagtttttacttcatgtctataatatatattcactttagagaaaaaagtatgcgttagggttcagaggttaaatctcaaattcaagggcatcatgaaaagatgtgtgtgtttcccaagaactaaattattctgttacatatttcaccaaagattaaattccaaactagccactaaactctcagtagatggcactgaaggtaatttatccctgaaatatgtatttagggtacacactaattatgattagagtattaatttgctcctaaatacttgcattgttatctgtcattagcatttcagatttgttcatttgttcatagcctctacttttttttcccctcaaattgaatgcagtctagtgtggtaggtaatctgttagctctacctcataaaatttagattaattatatcttaaaggcccttctttatatagtcctataagtaatgtatatgttgaggtgagggagtcaacaaatggcttttcttatttctaagcgcaatgactactttcttctcaaatgctgaataatgccgaataaatgctgttaagtgataatgaatgttgataagtgctgaataaatatttgtggaataaatgaagctgaatgaaccaatgaaggaatataagagaaaccgaaatgtcttggcctttaccagcctatgaggttatatttcctcttgaatattctatttccttaaacaaagaaatagaatattctattaggaagagccctccaataaaggtgcatattccatatagtctttctcattcacctagaaaaaaactcattatgaaggtgttgcctcttactttcaacaccatacttttttttttttttttttgagacggagtctccctctgtctgctggcgtgcagtggcgggatctcggctcacctctgcctcccaggatcaaactattcgcctacctcagcttcctgagtagctgggattacaggcgcacatcaccacacgcagctgatttttgtatttttagtagagacggggtttcaccgtgttggcctggctggtcacaaactccagacctcaagtgatccacctgcctcggcctcctaaggtgctggaattacaggcgggagccaccttgcacctagccagtaccatacttttttttagtaacatctttgttaagataccataccatacaattcattcatttaaggtgtacaattcagtgatgtttagtttattcacgaagttgtacaactgtcaccactgtctaatttcagaacattttcatccccctaaagataaaacctgtaaccgttaacagtcactttctgttccttccagacctgataaccactaatctactgtctctgtggattttcctattctggacatttcatgtaaatgaaatcgtaatatatgtggccttttataacttgtttcagttatgttagcaaggttcatctgtgtcgtagtgtgtattagtacttcatttcttttttcttttttttgagatggagttttgctcttgttgcccaggctggattgcaatggtgcgatctcagctcactgcaacctctgcctcccggcttcaagctattctcctgcctcagcctcctgagtagctgggattacaggtgcctgccaccacgcccggctaatttttgtattttcagtagagacagggtttcaccatgttggtcttgaactcctgacctcaggtgatctgcccgcctcggcctcccaaagtgctgggattacagcgtgagccaccatgcctagccagtacttcatttatttttaggtctaaagaatatgcagttatatggatgtaactccattatatttacccattcatcagttgatggacgcttgggttctttttactttttagctattatgaataatgctgctatgaacattcatatacaggtttttttgcggacacatgtattttcatttctcttgggtatattcctaggagtggagtagctagtggagttactgtatgtttaacatacagtaactgggcaacagaggagactctgtctcaaaaaaaaaaaaagtatgtttaacattttgagcaactgtcaaattattttccaaattggctgtatcattttacagtcctaccaactgtatgtaaggcttataatttctccacatcctcactagcacttgctattgttggcttttttagttttagtcaacctactgagtgtgatgtgatgtctcatgtggtttagatttgcatttcccacatggctaatgatgttgaacatattcccatatgtttattggctattgctacatctttggagacacttctattcaaatcctttgctcatttttaatcctttgcccagttatcttttcattgttgaattataatatttctttgtatattcctcatacaagcgccttgtcaaatatacgatttgtaaatattttctctatttactgggttgtattttcattttcttgatggtgtcctttgaagcacagaagttttaattttggtaaaatctaatttatttttttcttttgttgcatgtgctcttgttgtcacatcaaagaaaccattgcctaatccaaggtgacaaaaacttactcctatgttttcttctaagagtttcatggtcttagctgttaaatttagctctatcacccattttgagttaatttttgtatacgttgaagtattcgttcaaaagaatgatttttttttcagattctttcttttgcacgttatcggttttaatatcatctgttgaaaagatggttctttctctcatgaatggtctggacacttttgccgaaaatcagttgacctcaaatgtaagggtttatttcagggccctcaatttcattccattgatttatatgtctgtccctaggccagtaccacactgtgttgactgctgtagctttgcagtaagttttgaaattgggaggcagctgttaatagtaccttaagatcaaagaaatatgatgctcacatcgcatgagctatggactctatcctacattccctgcaagcaaaacatactgcctttggatatgtaatataaaattcaatatcaataaattctgggctgtctgatttaggtaaccacacatttggagccctgacaatctaatccactgtttccccaaatttgaggtagaactcatttgtccttactccttttctcagggtctcagttctattgtctgcaaacaaccactcaaacaagaatgttagtgatttcctaacagcagtcactattttacaggccaggcacaatctaaatccatagagaagaaatatttttctctaggcatgaaaatcctaggagaactgttaaataagcaagaggaccatttaacattgtccagctgggctccatttctaacttttccaagaccagtggagaggtaattgctgtatatttgcataactaaaaggcccaccttgtactcgttttctaagaacaatggacactgacccaaggtttattttaaatgggcggtttttctatctctaccagagtactctgtaataaataatttctcctaaattttcttaggtctttcagtcttcctgttggccttgtacttgctattccctttatctaggaccacagaaaggctgtgaccttcagtaagtttctatacccctctgaattttgctgccttcatctattgaatggacataatgatagtatttgagaattatttaagttacatagtatccttcagagttgtgaggattaaatatgcctggtaagtgtaacctgtgtgtgtgtgtgtgtgtgtgtgtgtgtgtgtgtatttgaacaggttttcacctagtcacatgtagatgtacattaacatgtgaatgctctgatttcttatctcttttgtctgtgagtattctagtatttattatgctatatgataattacagggtatagttttgtctggctctctcactggtccacatacaccctgagaactgaattggatccatgtttttatattttacttggtattaaacattggtacatagtagatgttcagaggtttcaaacacagttggcagttgttctgtctaggatattagcttcattttactctaaccagccatttatcctacataaaattcaaggtcagtaatcacctgagatttctaagaagggattattattaattaattactgatgctgtcaagaacttgttaattctcctctatgtttgaataatcaagtacctttgggcaaatgtgctgtaaaaacttgagttatccatactcagtatggagatttcttttgtttatttttccttcttcccataaatatttaatgaataccaactggatagcaagcaatgcgttggacacagggaatgcatcaatgaactagacagatatgaagtctacatccagtagggaagacagacattgaacaagtaacctcaagtgtggtgaatgttaggaagattgaaggtcttgaaggaacgaagggcagaataagcagtagaaaagcgggaatgaagagctgacctaaaagtagtgtttgtatataaggtaatttttcaactttttaatttcaggaatacacgtgcaggtttgttacataggtaaacttgtgtcatgagggtttgttgtacagattatttcatagcccagatattaagcatagtacccattagttattttccttgatcctctccttcctcctaccctatgacctccgataggtcccagtatctgttgttcccttctatgtgtcgatgtgttctcatcatttagcttccacttataagtaagaacatgcagtgtttgattttctgttcctgcgttagtttgctaaggataatggctccatccgtgtctctgcaagggacatgatctcattgtgtatgtaccacattttctttatcagtctatcattgatgcgcttttaggttgattccgtgtctttgctattgtgaatagtactgcagtgaacatacacatgtgtgtgtctttataatagaatgatttatattcctttgggtatatacacagtaatgggaatgctgggtcgaatgacatttccatctttacatctttgagggatcgccacactgtcttccacaatgcttgaattaatttacactcccagcaatagtatataagtcttcatttttctctataaccttgccagcatctgttatttttttactttttaatatggccattctgactggtgtgaggtggtatctcattgtggttttgatttgcatttttctaatgatcagtgatgtcaagctttttttttttttttttttttttagactgagtctcgctgtgtcgcgcaggctggagtgcagtggctcgatctcagctctccacaagctccgcctcccgggttcatgccattctcccgcctcagcctcccaagtagctaggactacaggcacgtgccaccacgcccagctaattttgtttttgtatttttagtagagacggggtttcaccatgttagccaggatggtttcgatctcctgacctcgtgatccgcccacctcggcctcccaaagtgctgggattacaggcgtaagccaccacacgcagctgatgttgagcttttttatatgactgttggctgcatgtatgtcttcatttgaaaagtgtctattcatgtcttttgcccactttttaaagtggtggttttttcttgtaaatttaagttccttatagatgctagatattagaccttaatcagatacatagtttgcgaagactttctcccattctgtgtgttgtctctttactctgttgatagtttcttttgctgtgcagaagatcttcagtttaattaaatcccatttgtcaatttttgctttagttgcaattgcttttgttgtctttgtaatgaaatctttgcccgtgcctatgtcctgaatggtattgcccaggtgttgtcttccagaatttttatagttttgggttttatgtttaagtcttttatccttcagttaatttttgtgtatggtataagaaaggggtccactttcaatattctgcatatggctagccagttatcccggcaccatttattgaataaggaatcctttccccgttgtttggttttgtcaggtttgttgaaggtgagatcgttgcaggtgtgcagtcttatttctgggttctctattctgttccattggtctgtgtgtctgtttttgtaccaataccatgctgttttggttactgtgtccctatagtatagtttgaagttgggtagcatgatgcctccagctttgttattttgcttaggattgccttggctattcgggctttttttttttgttccatatgaattttaaaatagtattttagatgtttaaggagaggtataaagtggagggatacaaaaaaaagagcaagacatttcaagtgaggagaaaacatagactgtagcattcatccattcagatatttttctgagtgcctactctgtgctgggcagataaacaaagccagacccagtccctcatcttaactagttcatgttctagtatggaaggaaaatgttcatcaagtaatcacactagaaatatgtgatcaccaattgagacaaatgctaagaaaatggtagtggttctataatgtttgtgacaaaggaaattaacatagagagcattaagaaaaacttcactaagaaaatgattgtaactgagatctgaaggatcagtaaggattaaaaaggaaatgttttctagacagaaaatacagaatgtacaaaggtgctgtggtggcatagagcatggtattttcaagggattcgaagaagacctgcctgtgtggctggagggcacagagcaaggctgaatgcagcagagcagaaagtggtgggagggaggaagaaaagggaagagagtttgtcctgcattttagctcaagatttactgaggccactatgcttaagcgtgtcactttactgacttaagattaggaaaattctcatatggtcccattaagcatgctcagtgtcttgaagtctacatggtatgcaagacagtagctttctgtaagtctaatcatcagttcacacatcgtcaaccatccacctgtaacaataacaggagctaacacttctcacttgctttgcatgtaccagccattaaattaggaattctcttttttaatacttacctcaacactagacacctgtactcttgatgttcccattttacgaaggagagaactcagacataaaaaaattaaataacttgccaaacttcacacagctgggaagttgaagggctagggtatgattccaggtaatttgacttcagtacttgaattattaatcaccacactatactggctttctgatatttttactatggtgaaaatgcatttccgtcagagggaataatttgtttgagaaactcaaaactgagtttagaatttgatggtaataaaatacccagactcaatttctaaatgccgtactgtcaactaaactccacttgcatccataggtgaaaaggtgaagccgtgttttgttcttttgccagtaagtggcagtgctgagtgtagtacaaagagatagaggatagggtttcaatatcaccactcgtacttgtcgtcactgagtttctgcacggagatgaaaggatgagattgaagatgctaacgaagtcaggaaaagcccacttaaccgacagtgctagagaatggagctcaagtaatgctgatagtgctttttttccgggttaagaagacatttctcctggctccccttcctagagtatgtctcacatagttattttaagaattagaaaacatatgtgaagtacctggtctgtagtaaaaagggaaactatttgttttcctgggattagacagctaatcaaatactgctctactagcctgctgtgtatttttaattttgcttaataattttaaattattaatcatcaattaaatatgggatagctataattagatattttatatgccttagagtttttaatacctgtgaatagctgcacatataagttcctctgtcgtctttgtttctagttataaaacaggtgccctcagagagcatcctacagattgataaagcaagtgccacctggagaaacctaattccttattcaagaaatcttcatatgccaagaaatacatagcaagtaataacctaaaactgatcaaaataaatatttagtgactgtttcttcaatgatgacactgtacccacacacacagaaactaacattgttggtgctggaaaggacaaatcaccagctttgaaaatgtatcatgaacttagggatttgggcagtgggagaggaacagccttccagaatttgatcagctgtctatagcatttccaaatgaatcctactttatgatggcccttgagaaggcatccctcatcaccactctttccaaatcagagttaaagcccagagtcacaatagggcttcctttgggggtttggttcaaaatttaaatatcacctgtctctgccactctggttaatgtggccttcttcagtgactgcctctctcaatgccctgtggatttccttcacctttctcctgatcgcatctataattttatctataagtctaccttttgctttgtcagtcccactagaaactccaccagtgcttcacacacagtgttagatacattttttagataatcaggctagtccaaatgaccatcagttagtgagtggataaagaactgtggtatacatatatatgatggaataccactcaaccataaaaagagaatgagttagtggcattcgcagcaacctggatgagattggagacgattattctaagtgaagtcactcaggaatggaaaaccaaacatcgtatattttcactcataagtgggagctaagctatgaggacgcaaaggcataagaatgatacaatggaattttgggacgcggcggggaaaggtgggaagaggatgagggataaaaggctacaaattgggttcagcgtatactgcttgggtcatgggtgcaccaaaatctgacagatcaccagtaaagaacttactcatgtaaccaaataccccctgttcccccaaatcctatggaaataaaaaattaaaaattcaggagatgcaatagtagcagagcacaacgaaataacagaattaaggacacattcgccatatgtctcttttatattgagaacacagcaatattaatgaccagatgatgaccttcaacctaaactggaagttgtgtgacaaagtccatgttggtttggaagctaaaggtggaaagtgagattaaatactatagggcatggaatggtagtgacctgcaacttggagctgatgtaaggacttgataagtcaaagctcactaggatgcaatactagaaaaaatggtcttggtgtatcacatggattaagtgagattaaaagtagtttttttattagatctcaaaaaaaatataccaggctaataagtcattccatgtaaaagcgagggtgacaaagagaagctggtaagaaaggcaaccttgaaagtcttcacactttagagctaaacatgcaaaatatattcagagacaagatgaatgtgctttccttttggaagtgatattgatctggggagagggggagggtgatcttccaaagactttatttcttttgttatcaagtgattggtgtgagtgcacccttttgatcagaggtatgtagacatgcttgagtaacagctctctctctcctcttattgaactgctttttgtgattgatttttaaaataaacgaattgtttgcttcagctaatcagggactagttagtgtatcctgaaaaaggaagtttatataagtgctctttattacctttactgagtgagtgggcttttttgtttttgtttttgtttttgttttttaaattttcagttagttgccccattgacagacaatagagataacagtgagtccatggaatacctcatggtggaaaatgcacagccgattagaaaaatgttctacttgagcgtaccaaactaatcccaaacagtgaattctgatcccctttctgtctcagattttctctatgatcacgtcttacgataataagaagcaaagtctctaatggaagttcatcagtggcaacaactgtggctaacctgacaacccagcacctagtacagtgctcacaggcagctggtgttcaataaaagcttcttacatagctcaccttctcagtatttttgtgtttttttcctttaagtggttagaaggcagaatttaaaatattgtcacatagcagtgggcgtgtaaggtcatctgctgtttgccaaccaaatggtgaggctagaaaacatttgcatataaatgttacatttggttgaggcttttaaattacagaaatgtaggtaaaatggtcagagtggcagttagagatgaacaaatgttttacatctgtggagccttcatatttattgctttgagtgtcattgccatttcctgctggaaattaaacatcacaaatgtatccttcatttgaccaggtggcctcgatgcttctgaaatgaatggcgaatccggtaatataaattgtaatcacatcacaagcatcttcctcttaaccttggtaatgatgtgaaatagtgcattttaagcttgttttgaaggttaagcaggaaatcttatcttggataattaatatttcaacaaaaatcaatgtggctacagttagcaggtaggtaatctgactaattggctcaatattaaatttgttaactacaaattgtctttcagctgaaattgtattggtagaaacaaggaaattggtgaagtatttactagatttgtagcacagtcttgttcagcttgctgtagagagcttgtgatttaaacatggtggaccaatgggagctcattctccagccacctccacagcagtcctgatgacttcccctatctactttataatggcacttaggctgaggcaggaacatttcctcaggaaattgtcaccgtgtccacagaaagtgggttggtcctctgtgtctactgcttcactttctccttaataatccaagccagcactttatgccttgaaaaaaataactaatagttaagttgtctatatcgttttcctttttagaaagtactttcaaatctgttttatcttttagtctttacaaaggcctgtgaggtatgatttatcatcatcaccatccccatcttacacatgtagaatgtgaagctcagaaataggaagtgacttcctcaagttcgtgatcccattaagggacagatccgaggatcaaaacccagacttttgacttcaagtcttgaagtcttttcattgtaccatatcttcatttaaaatggggtccaccctgaagccaaagaaacacatccttactagtaggtatctgacatttgtcttattttgtgaaaaagatattttgggagcacaccttcaaatgctggttcccaaaacttacctatactgaaatttccaccagtctacgcaaatatgcactacattattaaaataaggtggccaggcacggtggctcacacgtgtaatcccagcactttgggaggccgaggcgggcagatcatgaggtcaggagttcaagaccagcctggccaatatggtgaaaccccatctctactaaaaatacaaaaacaattagtcgggcgtggtggcgcacacctgtagtcctagctatcctggtggctgaggcagaagaatcacttgaacccgggaggcagaggttgccatgagccgagattgtgccactgcactccagcctgggcaacagagtgagactctgtctcaaaaaaaaaaaaaacagaaacaaaacaaaaggcagtgtttagtcaattaaaggacagtttttctgttgatactatctttctgtaatttttcacgttgaaaagttctgtcttttatgtattgatgatggtagaaaattgtggtggtactggtggtaacttttagtatccatagttagaaacacctatgttggtttcacacacatctcatatttccccttaaaattctattgctccattaaatccaacactctgtaaaccaggattttaaaaaacaacatacagatgatagaatgggtggcaagtaaaaatgcttcttgcctgcagcacaggcccttagaaatcatcagcggagccaagggtctacaacaagcagatcaaaaatagcagcaagacaggctaactatcttcaggaatcaatgccagcctcttatggcattccctagaggccatctcttgggccttggcacctgtgctagtttcatggttagattagttatgtcctgttgctgaagaacaaggagtgacttctcttccatctctctctgtctctttttgtttgtttgtttgtttgttttttttttttgagacgaagtgtcactctcttgcccaagctggagtgcaatggcgtgatctcagctcactgcaacctccaactccctggttcaagcaattctactgcctcagcctcccgagtagctgggactacaggcacgcgtcatcatgcccggctaacgtttgtatttttagtagagacggggtttcactatgttggccaagctggtcttgaactcctgacctcgtgatccgcctgcctcagcctcccaaagtgctgggattacaggcgtgagccaccgtttccggccctcttccatctctttctatttagctttggaggaaaatgttagagatttaaaaccatttgctataaggcagtattgccttttgcacacacaaaccttccctggtgggggagggccaagggccctcagcttccttcatcccaagagaggaagtgcattgttataaaatccctcatcagtctggctctaccaaagaaaaggtatcataaaagcttcagatctctgcaaaatagtgtctctttttctacagatctttcttgcctggcttctacacatgcatcactgcactgacccgtaaggattaaggaaagtaaacaaacagaaactatccagggctagagataatcagtggaccaggctgagcaaaggaatgtaaatctaagtgtcatgtggctaagaactgctgtttgaaaagctgacgcagtgggaatagcaagagttgacaggcaatgcttagtgtatggtgagatgctcagtgtgagaccagttaccatttgaggcatagctcaggggctctgctaccaagcatggcagataactcccagaaacacacacaatgcatatccaggtgatagtaacaatgtgttttactgtgttttcctcattttttggtttgcttttctattaaaaattcagagaggggtgcatatgtgcttgaaaaatactgtttccccttcactggtagtgtctagcatccctgagtggtctgaaatggaaagagcaacatggagcctcatgcatcttcacagagatttgtttccaaagtcagcacttaaagcaaaatgactgtcattaaagttaccctcagaattctcttaagttggaagtatacatacccatgggagataggcatgccacctctcccccgaggatggaacagacaagtaattgtttctttggttgaaaagcaggtgaagaattaacttaagtttagagccacattgcatgagaagtgggtatctttaaatactctacaacatgggaaggtactctctctatgtgaagccagtgaaaattgaaactgaaaaataaaagagatttgggtccctcatctctaatgcagtgttggaaactgatcaagcaagccacatggtgggcagaattacccacactatttacatggctacctcttctctctcacacatatcactccaatatgtgacctctggcaaatcattctacctctctgagtctcagtttcattctctgtataatggggatgatgtgagtatcaatggccattttaaggaccaattgagacaaagtatgttgacatattttcttccaattatgtaaatgtcttatataaaataaggcatgctttattgaaagaagataatagaaaaagatctaaagaaaaaaatctgaaaggagtaaaaataaataaggaagatcttgtactttagtggaagagaaagacatacagtattaattccaggatattatgtggtaaatgaaaagacagcagtgtgcacagtatgtaatgaaaacatggagaagcaatatgtaatccgtcctggggtacacagtaggctccccaagagagacagtgactgagcagagtcttgacagatggttgatagttaaagaggccaagagagctggcagggtgtttcatgcgacaagaacagcaaagcctgaatcttcatggatatgcacgggacatggaaacattccatgtttcaaggttgtcaaatatgaactggagagtgggaggctacaaggggagagagagagagctaaggcggggagatgatggaggaccttgtttgacatggtaatgagctttagctaatcttttggtggctgacgatctcaaagggttttaagccagcagagtggtataaccaggtttgcattttagaacttgattactgtggcttcattttggaatgggcatttaaggcactaggataccagcatctggaaaaacaggaaggctttccaatatcgcaggcaagaaataataagagtctatcctaagacaaaggcagtgaaagtagaggaggcatatttgaaaaatacttttgtggtgaaatcgtcaaggttcgttggatggtttgggtgaaggtagggacggagactgagagtaaagagtacagaaagaaagaaaaaaaagatcatagaatgactttaaagtctaatgtcttggatggtggggtatcattgactaactttggaatcaggttagggttggagattaagaggtggcaaatttactttaagacataccaagttgtgtgatttatcacacaaacctggattcttatgagtgtgaaaagtgccactgtcaataattttgccaggacaataaatgtaaacctcaattatttcaggaaaactagaatgtaaagtcaccttatctgtaggatactcagcagttgaatatatgagaaatactacatcgatagggctgaaggtttacagtaaatagacatgaacataaagattagattttaaatcatgagaatgtataagatcatccaaaaaagagagaaaagcaaaggcaccttggtgaaaactagtgtttgaagggtaggtgaagttgaaagagccctcaaaagagactaagagggaggaagagaagagataggaatcaggagaggatagagagcagatattttcaggaagcagttgaaaatgtccagtacaacagagaaatcagataagataaggattgaaaaatgcccactggatctggcaacatggaattgacttttgccagagcggtttcatgggagatctgaggccagtatccagatagtggggttgtagagtaataagctttagttaatcttttggtggggggggttgcagagtaaatgggaagtcaagaagtagagaaagcaagggtatacctgaagaaggaaagagaaagagaagtgcacagctgaagggagtgtagagtcaaagaagtgttgctttatatattttttcaggttgacaaaatttttgtatattttaataggctgaaagagaaagtttaaagacacaaggtttattaataagttggtagtagtactgacttgttagatataaagtttgtacaagttttattcaatgatatattaacttatttaagttttgttttacattttgctctgataagtagtgggtagggaagggaatccaacattcttacggggtactttccataacacactgattgcagcatggagaacacttggcaactggaggaagacctcagaaaagtaatgcatgtaggattctagaggaagatgagactaggtgttcggttgggttcctgctcctgaatttgtgcagtaaggccgaaattccttactgtagacagatttccttgtctatggatggcaactatgtcaccttttctaaacaccctgtgggcattacaggcttagggggttaccaaactctggcactgagtaataatgaagccttcatctcaatgtagtagacttttttttttttttttgagacggagtctccctctgtctcccaggctggagtacagtggcatgatctggctcactgtaaactccgcctcccaggttcaagcaattcacctgcctcagtctcccaagtaactggaattataggcacccgccaccacatctggctaagttttatatttttagtacagacaggatttcaccctgttggccaggctggtctcgaactttggacctcaagtgatccacttgcctcaacctcccaaagtgctggcattacaggcataagccaccatgcccagcctcgatttagtagacttttgaccaagacaaatattagtccagaaaagatagatcaggccgggtgcagtggctcacacctgtagtcccagttacccgggaggctgaggcaagaggatagcttgaacctgggaggtggaggttgcagtgagccaagattgcaccactgcaccccagcctgagtgacagagcgagactccatctcaaaacaaaaacaaaaacaaaaaaaagaaaagatatgtcagctgcattacccccaccccaatctccatttcatctgccaatcttcttgccttctgatcaacctacctttcctaccgccattgttccttctctcttccacgtcacttttatgttatggtatctcacttatctcctctactttcaaagtaaccaaacacttttctttccttgtgtgcatcaaaatgaaggagggacccatttcctctacaaataattgactgaaaaataatggttgctcttcactccattagctcctgtgaactttagaaaacaattgatagcttatgtattttcagttttggaaaaccttcaagaatagctgaactttggaactgcatactagacctagcaggatgggacagcaaatagaataacactccttcaggctagtgagtgtctctttgttttcatttggaaagactgcaggaggatgactgttacagcagttttggaaccattgtgtaactgtatcccacgagacaacatcatttggtttcaagatgtttatttaatactgttttcttatttgtattaaccatcaacaacataaagcagatgcacattgaggctgtttacaaaatagcctgttgtacttgcaagatttccaggattcttatgtcaattccctttcaaccatagcctgaacagtcctcttctttggaagcacggacagcgatttcagcttcgcaaaaggctagttgtgcttataacgttcacccagcagcctgctggtgctctttattcatcatatgctctgtgggacagtcatgactttccagcagacataagtgatggtttgcttttgcatcttaaaggcattaatcttgtatgatctgatccatatgctttgtacagtgactgtaacaattaaatgttcacatggactcttttagggaattgcattggcttatttcagaattcaaatactgcttagtgtttttatttccagccagttcattcttatgaatctgttttcaagcctcatctcttctcctcccgtgttctcccaccatggccctcttccccatgcaaaactcctctgtacatagagttcctatggaaacataccatgtctgaccaccctctaggaagttgttgcccatcatttaatctctctttatttgattttattattcttattatttttctttgagacagagtctcactctggagtgcagtggcacgatctcggcccactgcaacctctgcctcccaagttcaagtgattctcatgcctcagcctccagagtagctgggagtacaagtgcgcaccaccacagccagctaattttttgtgtttttaatagagatgggattttaccatgttggccaggctggtcttgaattgctggcctcaagtgatctgcctgccttagcctcccaaactgctgagatgacagatgtgagccaccacacccagcccatttaatttctgtaatataatgttttaaaactttgcaacagagcagttattatcactctttgattatctattttttgtcttttttactaagctattgtctgtcttcttcactacaatatgagctccatgagggcgggaaccttttataatatattcggtgctataataccaacacctagcattggacctgacccatatatgcagttaacatatatttgttgattgaagtattgctcttcagcccgaactgaccccttcttcctttgcgctttgcattttatacatacttatgtcatagcatatttattgcatgtgtcaaccttaataaccggattcaagtgaaatgattattgaacttatttgaacacaaagtttgaggatggccacccagaaggacacagactctaaaagagtggagtcatggctccaaagtggggagatttgagggcccctcttatattggcaaggtctggggaagatgagcaggattacatcattttccatacaggattggtgaatagttaacagcaatttgattggttataagtgtttctttttttttttttttttttggaaagaatataagtgtttcttttttttttctttttggaaagaatatttaggtatatttaatattccacatgaaggatgtaatagtcaaagggtctgttgtctcagtcaaggggtcctctatctcagggccatctcctctgagccaggaataaggaaataaggtaggaaattaatctataacagaaagtcagtaattaagaggtcaagctctgtgacttgatctccaaagtcaacattcctcagggcctaatagatagactatccattttcttttacacgtgaatttgtgtgacatgccctctactcttggtagaattggtagactgtaaacttcttgaggaaagggactgtgtcttcctcctctttggttccctgggtcccagcacagagcttgttattaagtcaatgatcaataaatatttgttgattacctataggttcctcttgattaaatttaactgcactaaattttatgtaataagtttttgctgagcccgtagagtacaaagtcctcagttacaaatgtgggctaaatggaaacagacatacccccttcattcaaacatcttatgtatcttaggtatacgatgcagagactctgtgtgagggtgggtatgcatataaaatacattgaaaatccctaatttgtattccaggagagacaccatgcatctttttgttttgttttgttttgttttgtttttaagacagactctcactttattgcccaggctggagcgcagtggctcaatcttggttcactgcaacctctgcctcccaggttcaggcaattctcctgccttagcctcccaagcagcagggattctaggcgcccaccaccacgcccagctaacatctttgaatttaaggatcctttgtgctttcaggaaaatcacatttgtgttttatggtatttaaacagaaattagtataacccatgattaatacccctaacatgagggaaactataagactactcaatattccatatctatctcaggttaattatgcttcccccactaaatttagtaaagaaagatggaaaacaatgagagttactcttacccatctacggctctccaactaatacttctaagagtgtgtttgtaggctctatcagggaatatatttgctcttatgttttcgactgaataaagatttgctttagctaatgtacctggcatggattacccatccaacatcaggtcaagtgaccttaccctctctggtagcagcaaaggacaaaagaccaatcaaggcaccagatcctccagttactataaactgagtcaccttaaaagtagccaggagagtaggctttgctgttctgccacacagcatgtaacaagaaaaatggagtcatgaattcttggtttatttgggaggtatctcacgcaagataccctcaagtggccagttctaatgtatgtccttttacctaggacacaaattctttccaatatggccagcatatttctccaaacatgcataaccaaataattgtatccttttctctgtgaaagtttttaaaagatatatttctcttttattgacttaacctattactatgtctttgtattataatccaatagttttgtttctcagtagacagtaccttcctaaattttaagaaataactgctgggtgcggtggctcatgcctgtaatgccagcactttgggaggccgaggtgggcggatcatgaggtcaggagatcgaggccatcctggctaacacggtgaaaccccgtctctactaaaaatacaaaaaattagccgggcgtggtggcgggcgcctgtagtcccagctactcaggaggctgaggcaggagaatggcgggaacccaggaagcggagcttgtggtgagccgagatcgcgccactgcactccagcctgggcgacagagcgagactccgtctcaaataaataaataaataaataaataaataaataaataaataaaataaagaaataactgtcccagaaatattttgtgttatccatgtatgtataagagaaaaccatgatacaattgttttaaagatcttgaggtaaattacagaatagtattcctgtaggccaaaaaattaaattatgttctcaaaacatgagccactcatgattttttaaaagcaagttctcaccagaaaatcacctaagctctaagacccaaagccactcaaatttcactactgtttttctctgtttacagcatatagaactctttaaaattcctattgctctcactcatattcattataaaaattttaatttactctaaccatgactacattcagtaagtgctgtttcagacaggaaatggaactattatagtgatgaactcctttctcctagttattaaaggaatctgttcttatcatactgattccatccaacttattataatgcatgaaataaccaattcagtgggttcagcataatgggggagagaggggaagaaaacaacacacataataatagctgacttttaatgagaattctttagggctttcaccaagcagatccaaaataatttatcttatgataatatcaaaagcaaattactcacaagattatactgttaaggactgtcacaatattcccagggctgtaatgctgtctcttacagttttagaaccaactttataacttttgctattagttgctaagaaacaaattataattgcagctcagactctttactgtgttagcctcttaatgccccatagtagcatttatttccttcagatgatgaaatgatcaacaaagtaattgttttatatatagctgacaatgaaagcattttcaggaagcaagccacgtttttatgatttttatctggtggggggagggtagttagagcaatgattttaataacatcacgatgttgaaatggcttgaatcttagaccaatatttaatggcttccttttcaggttgtggtgttgtttgttttgtttgtttgtttgtttgtttgtttttgttggttcgtttgtgacagggtcactctgtcgcccaggcttgagtgcaatggtgcgatctcggctcaggtgcacaccatgacacctagctaatttttttatttttgtagaggctgggtttcaccatgttgcccaggctggtcttgaattcctgggctcaagcaatcttcctgccttggcctcccaaagtgctgggattacaggcatgagccacagttggttattacttagaaatcaattttattttattttttagttattatgttggatggaaagagaggttgaagagtagaaactttggagtgagactaataagagtttgaatggtagctctatcacttactagatgtgatgaactttgtgtaagtcatttaatttcctcaaaagcttagtgttcccttctgaatattaaaatgaagatattaatacataccttgtgacatcacatgggcaataaacaggataatgtatttgaagtatctagaagccatacaataagtggtggtggtgatttgtatgattgttaagtcctaaaatgagggggaaaattcttaggatatccttaaaagccttcataaagataattggctaatagagtagagtagcaatacgttatttcaaattagtacactattgactctcaagaattcataccaacgtcagatagtgacataagaaatttgttaatttattcatttatttgaagaactaactgaccattatcattttaagtactcactgataaaaggataaaagtagtggggaggtcttaatcccacagctgtaatgggcaacatgtgatcaaagagaaaaagttagtgtgtatatctgatgtgtactctgacccaacagatgttacatataagaataagataaaactagttgtcctgcaaatctacattgtgagggccaaatgttgaaacagaatgatataaagtatttccaatttagctgtagtaagcaccacagtttttattactaatgccttttctggtacgagacatttagtgtttgactgcatggacctttacagtataggagatcatgtgtgcctgttggcctctgtggaatggattccttgccctctcagccctgttcccctaaaaacatgtttaaaatctctaaaaggctctggatcttccaactctcaatatagaggcatgttctcttttatgcattttctctttggcttccacataagaataaaagactatatattttttaagtagtttctccagaaaataatctggattttaagcttctcttaaagacatggaatttctggcaaccatgtctgccattgagttcctccacatggatttgttcttctactactttgatcttacatgtaatatgcaatcacgctagcctacctcactcatctaacttttgtttctgacccttaagggcaagtgggtttgtagtccttgctattccccagtacatacgcatgcccttaaaattccacgcccgtatggatgaaaaaatgccactttaatatctataataatacattttcatttcctgagaggtaaagttgtgatgctgttggtcatagagaattaaattatctttagcatccctgcattatacgttttagatattgtgaattcgttgctgattgtaaatatctctcacaattccaaacccaagttaagtagaatattttgttctacatttaaataccacttgagcacatgagactgttctgggaactctaggaaagcaggaggcaaatcaactatggtcctgccaaaaatctcaaagcagtagaaatgggaaaaataaaaagaaatatacatggagtggtgaggttcaaatgaaaaggaaagaaaccaacaaacatgccctaagaccagttgaaacagtgtatccacctaaacgaggaataaagatgcttttcatcttaattccagaaagctcaaactcactgaattcaataaataccatttatagtctttattcatctatattcttcattcctccttttgaaactatggagaaaatagttggccatcttgcaggtttatcatcattaacaaatcaaatgtaaaatgctttgcaaagtttttaaaaaatgggaaaaagagcaagcataatactatgctgtgaatgagatctaagctgtatgctaaggatatatgcgtgagtgagcaatgtcaacgaagagtcaaactctttgaagagatattatttgaatgttaatatattaattgaaatacttgaggagatatattctgagccacatataggtgactatggcctgtgacacagccctcaggaggtcctgagaacatgtgcccaagtggtcggggtgcagcttgcttttatacattttagggagacatgagacatcaatcaaatacatttaagaaatacattgtattcctccagaaaggcaggacagctcaaaggtggggggtgcttccaggctttgggtaaattttttttttttttttttttttttttgagacggagtgtcgctctgtcgcccaggctggagggcagtagcgcgatctctgctcactgcaacctccgcctcccgggttcccgccattctcctgcctcagcctcccgagtagctgggactgcaggcgcccgcaccacgcccggctaattttttgtatttttagtagagacggggcttcaccgtgttagccaggatggtctcgatctcctgacctcgtgatccccccgcctcggcctcccaaagtgctgagattacaggcatgagccaccggtaaatttaaacaatataaaggaatgtctgggttgccataagaggttgtggagaccagttttattatgcagatgaagcttttagctagcaggcttcagaaagaacaggctgtaaaatgtttcttatcagactgaagtctgtgttgatgttaatggcggagaggtataaagagtataaagaggcatgtctgaccccagcttcccttcttggcctgaatcagtctttcaggttacgttttaagagccctggttgaggaggaagtccatttagatggtaggtgggggggggccttagaattttatttgtggtttatagcaagatacctctgcatgctgtatgaaccctttcagtctgccttccatgattgcatcttttcactaaagagcttcctagtggcgatgaagacttgaaaatgtaatacatacccataactgattcctaccttcttattctgtgtgtgtgtgtgtgtgtgtgtgtgtgtgtgtgtgtgtgtgtgtgtgtgttttaatgggaaggaaaccacagtttctaaatggtcccaccttccttattaacaaagaattagcataagtcccagaacattatagctgtttctctaagaagttgtgatataccaccgggcgaacaggagaccaggtgtcatgattcagtttggggatcgaaaactagtaacaacttcactttgaaaatcttttcagtgcccattccctggggctttcaggctaagctactgcttttatttctctgctatttaatgtataacaaaagaaaaagaaggcatgtatcctggagccctgtggtgaggaaaagcaacttaatgtttatgaagtgctttcaaggggatcataatcttaggaccaatgagtaacccggaatgagttttgtgtttctcttgggtctcctggcctgatccataaatttacttagctatgtcagggatcctagagaatactggtccagttccctaactttagaggtgaggagtgccagtgcggtggcttacgcctgtaatcacagcactttgggaggcagacgtgggaggatcacttgaggccaggagttcaggaccagcctgggcaacacagtgagattttctctctactaatttttttttttttttaaattagcaggacatagtggtggtacatgtctgtagtcctagctactcaggaagctgaggtgggaggatcacttgagcccagcagatggaggctgcagtgagccataccatgtcactgcactccagcctgggtgactaagcaagattctgtctcgaaaaaataaataaaaataaaggtaaggcagattgaggccttagagataattcgtcttgaaaaaggtcacagcagttagctgcagtctgaatgctattattaggacttcctgtccctctccacactatacctattgttttcacagggtgtctctcctttatctccagaggcagttcattggattatcactgggatcaatggatcagaaggaataagggggtgaagtaggagccaaaggaagtagttagaaactaattgtgttttttctcagcaggattcaggctttttctcagcaggatccagcttttaaactttttaacttctaaacttttctctagagtaattgaaactaacagtattttagtggtgaaatgtttgcagtgcttagaaaaatctcgaacaaatttcatgtctctcatgttataaaacagcatttgaactcaagactatagaagagttgtaacgtaaagacgaatccattttcggcattttgaaatatcatttgatcactgcaggctaattgctgctgttcctaatccaccaggttgacacttaatgaatgttcatgatgaatccgttctttagttagttgaaccctataattttcttgcttcgttttcaatttacaatatttgtaataaaggtgccatgcataattccctaggaaaggtcaatatactcttttattaaccataagcctttctggtcttctgggtgtatatttgtcagggaatagactattcttttatgatttcaaatgttagattgtacagattggttatctttactatattacctgctgaaatttctacatatagacatttagaaaattgggataatagcaaccagccttttttactattctttcaggaatgagaaactcaaacgtgtgtggggaccgggtatgtaacatgaatgagtgaacggggaatggatacaaggccaaaagagacaggtggatattatggtagactggagctcatgtgttctcccttaccgcctatactgttttgaaaacaatttaatcattatgctaggcaaacacaacacattttgggctgattttctcaactttgtttattgcgcacctccacatccgtttgatcttcgaaacacaatatagggagaatataattagacccttttttcagatgaggaaactgagttttagagaagttaaggtctttgcctgaagtcatacaactaagaagtggtagaaataatattcaaagttaaaccatactctgatgcctgtaaaaccaaaactgcactctaaggaaagaaagatcatgtgatgaatgcagttcttttcagcactgaaagaacatcaagctggaagttaagttaaataatgtgggagcattacagtcacctagaaaaagcagagttgtggtggccgacctggctggattaaaatcccagctgtgcttgtcacctgacagccatctcactttgagcaagtatttaatctctgaacttcatttccccctctgataaaagagataatatgactcacctgaccagatggttttaagaattcaataccatggctcatagaaggtattcaataagcgctagttccctttctcctacagaagtaagtgctggtatgagtatagggaagattttaaactaatgagttctttctttttgagtacttggataattatacttgagtagttcctgcttggatatactctgaaaacttggccttcttggccctggacaccctaaccccctgcagtcttatttattcattcttctagtcaaagacatgggcaagtacatgtgttctatttgtatataagtacacatttgtacatgcgtacacacacacacacacacacacacatatatatagagagagagagagagagagagatttaatatgataaattggcttacatgattatggagtatgaagtcccatgaccttctgcctgcaaggtagaaacctaggaaagctggtgttataattccagtccaagtctgaatgcttgagaaccaggggtgctgatagtgtaaattccaggccaagggcaggagaagagcaatatctgagctcagtaggcaggcaggaagcaaaaggagtgaattcctcttcctctttcattctactcaggccttcagtggattgaatgatgccaaccacatagttggggggcagtctaccttgctgagtccactgattgcaatgctgacctcatctggaagcaccattacaacacatccagaaataatgtttaagctttgcactccttggcccaaattaacatataaaactaataatcacaaatgtttaacacaaacaagttacagtgaaaatacaactggttttgtgatagatgggaactggaaggaaactcgacaatgagtggtcaggaaaacccctcagatggcaggattacattgcataatttgtgctaccaccccatgtggcggctctgctgaagtgatacggacaggagacagggatatactgggtagaagggcagtccctagtgagggccacaccctcaagcctggactcatggcccaaagtgagaacatgccttcctgttttcccacccacatgttgcctttcccagaaccaccctggcccacgctgcccccccccgcccccccatcctgtacccataaaaaccgcagaccccactggcagagcagagaggcgtggcagaggagagaagaggtgtccgaacgttgagaggtgaagaaccagctgggcatcggagactacaatcggagaggatttgggctggggatggttagagaggagtttgtcagccgaactccaggggaagacaacccttcccctccatcccctttccagcccccgcttcctgctgggagccactttcattggcagtaaaagcctccacattcaccaccctccaatttgtttgtatgacctcattcctcctggatgctggacaaggacctgagtgcaggtgcaagaggctgtcacactgaccctccactgagttgttttaacacttaaagtgtccacggacagcaaagctaaaagagcacactgtaacacataccttccggggctccggggccacaggcaacccctagatgctacagcggttctgcacagagtgttgctcctgccagttgcccagaagtgcttgtcccagcctctgcacctgcttacctgcgtgctccctcaccctcaacgggttaagatctgtgggctgcgtaagcaagctaccccttcacaagtcctgtgaagggatcaagggaactgccccatttcaatttgagtttagacctgaaagacaagaaaatgattctcacccctcaccaccatctcctgattacctgaaataatgaacagtgttggtaactatcaaaacccatctctatcattttaaaagtcattatcatgttctggaaatttttttaaaaagcttctactggagccaagagtggctcagctttcaagaaagaatggtttttgctcatgattttctgtattttaaaattattagatccatttctgtgaagtgcaattgaatggtatagtgaccaccatcacaggtcagggagagcagcttttcaggagagtgaaatctggtgtcactcttgaggccaaaaataaaatattaacctcaaatgcagtaagtaacctcagtaatttatacaaatggttctattttttatttgaactattgtttcttggcactcattcatgcaaaaactgggttagaaattggtatagttggttcatgctatgaacatacagtttgatcttaatagttaagaggaataacaaaaacttgaaggtattttaagaaaatcggccaggcgcggtggctcatacctgtaaacccagcactttgggaggccgaggcgggtggatcacctgaggtcaggagttcaagaccagcctggccaatatggcgaaaccctgtctctattaaaaatacaaaaacagccagtcgtggtggcgggcgcctgtagtcccagctacttgggaggctgaggcaggagaatcacttgagtccaggaggtggaggttgcagtgagccgagatcatgccactgctctccagcctgggcagcagagcgagactccgcctcaaaaaaacatacataaataaaataaaataaatataaaaggcatctgaccaaaattagtttaccacttaaggagtaaaccgaggagatatatagtgatcattacataccggaattattgctataaaagccatagtgtttatttggtcagtgtccgaactttttacaaggtaataatagaggaagaagaatcctgtaatgactgaattgcattttctggaattggattccctgaattcagatttagtctagttcacttaccagctatttaaccacagtcacgttatttaacttctctgagtctttttcctcatctgtaaaacagggatgcaatagcgcatactttgttggttcattaggttagctcatgcacaaagtgtacttatcacacagtcctgccatattgttttgtgggtttttgttttttttttttttgaggcagggtcttgctctgttgcccaggctagagtgcagtggtgcgatcttggctcactgcaacctctgcctcccaggttcaagtgattctcctgcctctgcctcctgaacagctgtgattacaggcatccgccaccacgcctggctaaattttgtatttttagtagagacggggcttcaccatgttggccaggctggtttcaaactcctgacctcagatgatctgcccacctcggcctctcaaagtgctcggattaccgtgcccggcctatagtattaataataatatataatgtaatcataagagtaacaactatataccatcacatcatcatcataacagaaatagctaatgtgtattgggtacttaccatgtaccaggcatagttctaagcattaatttcaagtggacatttgggaagagagaagtaattcaggcacccaagggaaatggatttttgaaatgtgaattgtcttctgtgtcctgtggccttccattttgcagacacccactcatttcactgtatgatataatttggaattatttaacccaatggaatataaactgatggaatgtgtattacttcatactatcatgataaaatagaatttggagatagaaataattgatctctcatatgacacaactgcccattcacaacattcttactgaattaagatgttcaaaagcaaactttaaaaaatacatacgtaaggatctatgatatgataatttttaaatactattatttggctaagtattctccacaatctttggaaaaatatactgtcttgttaaattcttttccaattaaattgtaatcccataaagactcctattctaaaggtcaaattaaaaagcatttatcctcagaggctctaaaaaacagtcattagaatgccaacccttaaatggaaacaccattaagctcaatagctgaatagcttttattagaattacccaatccccctagccagccctgcaaccctgctgacaccccagggcctgcaggagaggataacctctgtatttgtttaagaaatgacaagaaaaattttcttttttaaagatataacagtcaaagactttggtctttacatagatgagcatatcaatcttctaagagacacaaaaacagaaaaaaagttctgattctatctgtctttttttttctcctgatgcttttaaggattcccctgtattttattttctctttatgcctttgaggatttcctctggggctctacataatcaggtggatctttaccatgtagatgctgcattcagtcttaatgaaatgatctcgggagccctaggaatttgcctgaccattcaaaataagcatagcaaatgaaatactggtctctagaaccagattgtggaggttgaaattttgacttctcctattacctgtgtgtctctgggaaggtcctttactctgaatctgttttctcacctgtaaaacagtaattcctaatccaaggagcacttgcaagaattgaagatatgacacatgtaaagtgtggaattatgtttagttattattatgcaccctcattattaggaaattgccatgcctgagaaggcttagccctgacctagttgccaaagtggatgcaactcagatttctttttttcttttgagacagagtcttgctctattgcccaggctggagtgcagtggcgtgatatcagctcactgcaacctccgcctcccgggttcaagtgattcttctgcctcagcctcctgaatagctaggattacaggcttgcgccaccatgcccggtgaatttttgtatttttagtagatggaatttcaccatgttggccaggctggtctgaaactcctgacttcaagtgatccacctgccttggcctcccaaagtgctatgatggcaggcgtgagccattgtgcctggcctcggatttattttggtagaaaatagaggataacccaaagaacaatgtagagaggtttttaaaaaaaattaaaaagctaaattagaggagacctggaaaagtatatatctgattgcaagattaagggtaaagttttccattgtttggaactggcccttaattctggttacaatagactagaaaagtgcttatggtgtttagccatttagtagagtatccaaggaaggtagctctttctttgagaaggtacaattagtaataatgatgattctaataatagcagcaattgccatttagtgctttgcatttaccacatgccacgttacacaatttacaagcataatttcacttcttatttaggggaaaaattattatctctttttaaaatgagaaaaccaagatgaagtcaaatgaagtaatttatatggagtcacactgtaagtggtgaagttagaattcaaacctgagtttgttagattttcatcttctgagtgctactgcctcacctggatgaggttccctcttctgtatttggggccatgtaaagggattagttgtggtgaagtgaactggagagagaaaggcattgagccatagtggatctcaagagatcctctgggccagcttgctgccttccatcaggtaaatgacccagccatctaggacagatgcttgctattttttctgaaagatcttcagggatagtcgtttcacaagctcctcagaagggaaaggagcagaatcagtcaagcacagcaaagtaagggcctaagtaggcagatgtgctcagtgtcactgggacccccagctgacaagcttgctgtgcagtgttctgcttgagaactttctgtttaacatgccaggcaaatcagccaccaagtcctaagtccaggaaaatcactttattttctgtgagtgttgcatgaatttatccaactgctttggttgtagcagggcaagtttgatgtctgtcatagacctatccaccttctgtaaaagcagttcagaggatgaccaatgagctatctttttctgccattcataacttgtgcatttccttgacttgcttctgttacaaggaaaatgatcttattttttatgcaaatcttgcacataaaattgataagtatttgatgataatcagcatctgccatcaccattttgcagacatgacagatattattacttttgtttagataaggttcaaatgagcttggatttggttgcttatttaatacttgtcttctctgctagcctgtaaactctgtgtcacaagagtaattacagtgtcttaaacctactatacactgaaggatgaagacaacaaaggcagaccaagatttgagtcggcagaatttcagtttccacaaggacaagccattttgacctctctgagattattaaaatgagttttatcatgtaactcacaagattactgtaaggaattatgcaaataatggtggtattattgttatttttattatttagttcagaaatcactttttaaagatgaggaaactgactgggcatggcggctcgcacctgtaatcccaggacagtgggaagccaaggcgggctgatcacttgagcccaggagttcgagactaacctgtgcaacatggcgaaaccctgtctctacaaaaaatacaaaaaattagctgagcatggtggcgtgtacctctagtcccagctactcaggaggctgaaggggaaggatcacctgagcccaggaggttgaggctgcagagacctgtgattgtgccactgcactccagcctgggtgatggagtgagatcctgtctcaaaaaaaaaaaaagatttagaaactgagctctatacaaacatagtaagagttcacccaagttcatggacaagaagaatgcaaacctgatgcctgatgtattacttttctcagctactgtaataaattgacctacatttggtgacttgaaacaaaagaaatgtgttcttttacggttctagagactagagatgagatacccgaaacttagtaggaatgcactgcctctaggggttttagggaagaatctttgcgtcttccacctcctgatggctgccctagcattcctgagcttgtggccacatcttcccagtttctgcctctgtcctcacattgccttctcctctgtgtgtctgtctaatctccctctgcctcactcttagaaacccttgtcatcggatttagggcccactcagataatccgggatgatctccttatctcaagatccttaccttcctatgagatgggttgataggtgcagcaaaccaccgtggcacacatttacctgtgtacctgcaatcctgcacatgtacccctgaacttaaaataaattaattaattttaaaaactcttaaccttatttatatctgcctaggtcccttttcctagttaaagtcacactcatgcatcccagcacttaagacatggacattctttcggggggcccttatttaacccatatttttacatgatccctatgttttcctgacaaggattctaatttggatgtttttacaataataagtgttatactgtctgaatcaaataataggaatttctactacacaacaatcttcgtgataatggcttaatatataatctttatttcacagatgaatcatttcaagatccatgatcctcctagtttgacagaaataacataatttgcttgaatattaatgttgctcttagttttgagtgagatgtttttaaagtatctaaaactgattggtacacacatcttttcatttgcagctgaatatgtactaattctggctgtgagcttcctaagcaagaatgctagaagccaattgaattagcaaatgcactcagatttttgatagcattattccactgaatgtggaagtccttcagaaagaatcagctacagaaaccgtcttgctaacagacacctgtcaaaaccaattccattcacttagcactcacttctaatattgaagggtgttttgttataacttcagtatcttcccacccttgtgagagagaatagggtgggagagagaaatccttagtttaggctgttttgaaatgggtatagtaataataaatccctcaaattttatataagatgtatttatactttgcattttcaaaatacacattctcaaataccagtatttatggaaacattcctctgatgagtgaagatttgcaaagcagagcttagctttcataaaagatagggacatctctgtcacaccacccatgacctgagacatgtaacctccttggggaagtattattgtttccattatggttgctgaggagcagcaagttcagttgctgaattatttccacatgataggcaatgaaatgaagaaagctaaccttgtataaaatgctcaaaacaggaagacagagttcaaatgaaaacaaattcacaattagcttcatccgaaatagaaacaggtttgcttgctggaaagaaagttcacactcttcactctcgattcctatcacgcttctgcttgtttctccaaagctatatgaaggctggttaatcaccttatctattcataaagtctattaatctttcttattaacttgtaagaccttgtcagatgaggtccaaaaacaagttttaagaccttgctattactactggtaatgtagtaatgtttctccatttctagcttttacccacaaccacttggtttatttccatctataatggaacaaagaactttgagttttactggatttttgtcccttaattacggatgtttgccttcatgaaatatgacgtggttttggtttaatgaaagagcatcgaagctgtcaagaacctcagtgatttttcttttcagttcttaatcactgctatttgagggatgttttgatagtatcatttcttaattgcgttttcgaaaaatgatttgtttcaatagccacatttccagaacttgacaatcacctcactgctgctaccagtatcgtattaccttattccatgctacctaggaaaaataacagaaaaagtaaccatttcttgccttgattacagttactgactacagaataaggagaagaaaacaaaatcatgtggaacttcagattctgagacattaaaagggcccacatagcattcagttagtaacccattcctatgaaagaatctttgagaatgaatcactcaaattcctatctgagaaaaatgaccaactactgcctgccactttactagtgggccatgattagttggaaataccaaatgaaaacatgtactgccatgcatatttttcttggtggtgacatttgtagcataaagtttacagcataaggaaatttaacatgtttcaaattcaccatatctgttaggcatgctttcctgttcattcatctcttttaatagtttggaacaaataatgaaaaccatgtgccatgttttacagattctgagcctcaaagataattaaatcatgaaagaaatgtttctacatctgcaaaaaatgtctggtgcccgatccatcagtagaaaaagacttacaggcaggaagctctgctgcagcagttctcagggtatgcttaggaaggacactgattctcagagagatcaacaattaacagttcacatcttagttttctaaaagacttctgggagtctttgatgctgtaatgtatgttggatagtcccaaaaaggagatacaataaatagtaactcccagtctcttgataataaatccctttttttgttcatagaaaagcactgtttttagaacaaactttgcaaaaactgttaacatagcataagacagtggagtagaagaagagtgaaagtatcgacttgggttctaaccctggctgtacctcaaatagggcatgttaagcatatcacttgaccgctcaaggcttcaacttcctttagagatagaaataagtcatctcttgagtcctttgaaaacttacatcttccattctgtttaggctgctgtaagctgccattgactgtgggcttacaaagaaaggaaatacatttcttacagttatggagcctgggaagtactaaatcaagacacaagcagattcaattcctggttagggcctacttcctggttcacagactgctatcttgtcactgtgcactcacgtggtggaaggggcaagggagctctgtcgggcctattaggggactaatcccattcatgagagccccatgctcatgatctaatcacttaccaatggccctacttccagatacactttggggttaggattttaacagagaatttgaggggtggggtggggacaaacattcattgcataacactttaaaataccataattctctgtccatggttaagaaggttcctgtgtaatatatgtaattccattctgtaagttttattatggtctgatagttttagtaagagttatcaaacccactggaatatttaaatgattaaataacccgaaaaagttactgttttgaaagtatcacagtcatgagcaaataatctaaattaggcagattaaataccaaaattggacctgacaggctgaccctgatcctgaaaggctctgaccttttcctggtggcattggttcaaacatccatcccctctcttctctccaaaaaacatggaaaggaacttgtgtaactgggatttggtgagctcccaatacccttttctcacaactccagtgacattcccacggaggaagggactctataatctattctgttaaatggtgagaagcatcattttttcgtcttagcagtcttatattagagtaacaaatgggtatcttttttttttttttttctgagatggagtctcgctctgtcgcccaggctggagtgcggtggtgccatctcggctcagtgcaagctctgcctcccgggttcacgccattctcctgcctcagcctcctgagtagctgggaccacaggcgcccaagaccacgctcagctaattttttgtatttttagtagagacgtggtttcaccgtgttagctagaatggtctcgatctcctgacctggtgatccacccgcctcagcctcccaaagtgctgggattacagacgtgagccaccacgcccagccacaaatgggtatcttttgattcaaatttgtcttgtatccaaaataggtacatgtgatcaaggcaaaaagaaataaaaatatataacatttgattgtgagtaatcttttcattacacctaatgttaatgtgttcatgattgcagaaggtgtaaataaccatttcttagatgtctagtttattaatcacagaaatatctggagaaaagaacaggattttttattctcacagagaattgttgattgggactttcttgacccgtaagatgtaaaggttaaggttgtctttgttgctttcttttaaattaaatccaagtgcatcttaattaggttaaatacttggttttggaccaaaaaatagggacttcaacaagctacactataacttataccaactgaagttggtagcttttaccttccttcatcattgcagttcttactaaaatggaattagtgggagatgtttcttaaaggattatatttgaaggttttctggaaaccaaagtgtgaaaagttgaagcactcatcagtatggcatgacatgaatttgaagttttttaaaggcaagcaagcagaatcttttggcataccctaatctaaaaatatcacttgattagattcacttttcaatattccttttaattctatggtacggtttttaatgtgcccttatttctctaagaaaaaaatgaagagctagaatctaaaaataaaacccgtacttaatacacaagctaaatatactcccaagttttctcactgctacattaattcaatgaaatctaatttaggctagtaccactgttatgaataaagatgaatacacattaccagttcacattgtgttgtagcatttttctttgagacttatcggaagaaatgttaattgcttaagtccttacataagatccggtgttctttaaagttttcttgaagagagattaagggaaaggtgacaactaagtttgcatttatttttagcttcatcctattctattgctgtattcccaaagtagtcatcctgactttatagcattccttaagagttaactttccaaaacccagatactataatgttgctcagtaccccacccctacttcatactcagattcctacagtagcccttgttgcttataagagtattcccaaactggtgaattctgctcctgcccaatgttttgttattgttgttgttttcatagagatagagtcttgctctgtcacccaggctagagggcaggggcatgatcaaagctcactgcagcctacaactcctgggctgaagtgatcctcctgcctcagcctcctgagtagctagaattataggtgtgcaccaccatgcccaactaattttttaattttttgtcaagctggggtctcactatgttgtccaggctggtcttgaattccaagctatcctcctgcctcagcctcccaaagcactgggattacaggcgtgaaccaccactcccagaccagaatgttaatttagaaagctacactgggaatggtggcttacgcctgtaatcccaacactttgggaggccaagtcaggtggattacctaggtcaggagttcgagaccaacctggccaacatgatgaaaccctgtctctactaaaaatacaaagattagccaggtgtggtggtgggcgcctgtaatcccagctactcaggagactgaggcaggagaatcacttaaacctgggaggcggaagttgcagtgagccgagatcgcgccactgcactccagcctgggcaacaagagcgaaactccgcctcaaaaacaaaaacaaaaacaaaagcaaactccaaagagttcagtgcccagatgttagattaaacaagtccctttactgcaaagtttttttgtgcagaatgaactgaatctccaagagttcaatatagtttttaacctttcacaacttaatcataaaatatttgtaaggcattcctgtttagtaagattattctgtggaagacaaagtaaaattctagggtgttaacaatgtctgttacactatgacccttactcacatttcttgcttcatgtcttttatttttgtgcagataccttactactgtttgatgaccacactgagtattttttttttttttttggtataaatttagaaggtaaaagtgcaattttgtttcatggatatatcctgtagtggtgaagtctgggattgtagtataaccatcacctaaataatgtgcattgtacccattaagtatttttttttaatccctcccaccctcccactctttcaactctccagtgtctattatttcacattctatgttgatatgtacacacgttttagctctcacttgagaacatgtggtatttgactttctgcttgtgggttatttctcttaagataatggccttcagttccatcgatgttgctacaaaagacaagattttattcttttttatggctgagtagtattccattgtgtgtgtgtgtgtgtatatatatatatgtttatatatttatgtttatatagtctgtatatatacatactatatctatacacacataaatctatctatctatctatctatctatatatctatctatctatctcccattttctttatccaatcatctgttgatagacatttgggttgattccatatctttgctattgtgaatagggctgctataaatatgtgaatgcaggtatctttttcttttctttttgagacagggtcacactctgtcacccaggatggagtgcagtggtgcgatctcagctcactgcaacttctgcctgctgcactcaagagatcctcccacttcaaactcccaagtagctaggaccataggcacgcaacaaaacacttggctgtttttttgtatttttagtagagatgcggccttgtcatgttgtccaggctggtctcaaactcctaagctcaagtactgcacccacctcaacctcacaaactgctgggattacaggtgttagccactgcacccagctggtatccttttgatataatgatttttttttcctttgattatatacccggtagtgggattgcctgatcaattggtagttctattttcagttctttgagaaatctctatactgttttccatagagttgtactaatttacactcctaccgatggtatatagatgttcccttttctctgcatcctcaccaacatattcttttttgactttttcatagtagtcattctgactggttgtaagatgatatctcagtataattttaacttgtgtttttctgatgatcagtgatgttgaacattttttcatatatttgttgtccatttgtatgccttcttttgaaaaatgtctgtttgtgtcctttgccttttagtagggttatataggtttttgttgttgttgttgggttaagctccttgaagatcctggatattagttccttgttggatgcatagtttgcagtatttccttctattcttcagattgtctattcactctgttgattatttcttggctgtgcagaaacttttaaattaagtttcatgtgtctattttggcttttgttgcatttgcttttgaaatcttactcatggattgtttgcataggccaatgtcctcaagagtttttcctaggttttcttctagtatttttacagtttcaggtcttttttttctttgagatggagtctcactctgtcacccaggctggagtgcagtggcacaatctcgggtcactgcaacctctgcctccggggttcaagcgattctcctgcctcagcctcccaagcagctgggactacaggcgcctgccaccatgcccggctaatttttgtatttttcagtagagacggaatttcgccacgtttgccaggctggcctcaaactcctatagtttcaggtcataactttttcacatgtatttttagaaaaaaattttaattttaatttttatgggtacatagtaggtaatactaagcctttcacatagctcgagtttatttttatatatggtgagagataggggtccagtttcattctcttgcatatgacaatccatttttcccagcaccatttactgaatagggtatgctttccccagtgtatatttttgtcaattttgtcaaacctcagttggctgtaggtatgtggctttaattctgggttatctattctagtctcttgatctatgtgtctatttttataccagttccatgctgttttggctactgatagccttgtagtagaattcgaagttgggtaatgtgatgccatctactttttttttttttttgcttaagattgctttggctattcaggttccacaggttgctttattggttccacattaattttaagatttaaaaaaaaatgagaaatgacatcggtattttgataggaattgcattgaatctgtagattgctttggataccacagtgcatatttttaatgccttttcgtcattgtgcatgttgttctttaccctgacattcgatttatttcttctttcttctctcaaaatcttaatttttttcgggtctagactgcatgttatgtactttcttattattttttatcctgcaagaaaataatttgctttctcatttgtaatctcacagcattttgtttacataccactaaagttcttattatctgttttgaatctggtaattgtccacatcttcctacaagatgaggagttcttcaggggcaggagctttatcttaattcatctttgcaactttcatttcttagttctctgccagacatgtaataagcaatcattctggttgaagagaatcgagttgaataactacaaaactgtaagtcaaaccatgtcactcctctgttcagaaacctgcagtggcttccatattgactcagactaggaactaaagatcttatagaggtcccctctctgtcccaatacctccctgactccatgtcttaacttttatcttccttattcattctgttccagccaaactggctctgtgatattcctcaaacatgttcagaatcctgtctttaagagccctttcttctacctgaatgttttcccgtaaacattcatctggctaaaccccttgccaccttcaggtctctactcaaacgcacctacttcctgaaacttacccagagtccatttttaaaaattatagccttccttcctactcccagctctctcaatccctctgattctactctgtttttcccattaccactgcatgaccttctaacacactatgtcatttaactttttatcatggtattattttcctgcctcacctgatcagatgtaagttccacaagggcaggagtatttgtctgctttgttcattgttgtgttccatgaccttaaagcaagatctggactctgctttatgaacatatgttaagagaactgaatgaatgaatctggtttttatcccattttctagttcagtgaatttgtgatgtctgtttgtcacagtatttccatatagaacttagtaatatcagggtagcttttgttagttttcattattgaaaaattgttctctgtacttcagctcactcaagctgtgaaagcagtgaaacattgcatcaattaaaatattccaattaacactaatcaagaggagcaatagtaataacatagctgaaccaggttgttgaatctttgtagcctcacacatcactgtaggcacagtatgtcaattaaataagataatttttccctattatgcatcttggtaaaataatgaagatattctttggagaaaaataaagcattattaaaacatgggtccctgttttaaaatagcatgcttctgctcttcaatccagtatagcattgcttgtatcattgtcgtgattaagaataaaatttcatggcatgtctactctgtcagacagtgaggtaggttttgggagcctaggaaatatgagatgttgtttttgccctcaaggagattgtagtctcccctgaaagtgtttttttattctggtcctagataatgtacttattagaggtttaattctaagcaaacctcttaacttttctgagtttcaaatattttctacaattaaagtttatacttaatgccatccatgtctgcttactgagatgttttcttaatcaaatgagttattagtaaaaatgttggagttttctctatttgctaaaaataagtactataaaaatgtaaggaaacatatcattattggtctagttgctgctactattattattacaactacttctaattttgttcttgccattattatcattttaaattattattgttaccatcattatcatctttttcataatcatttttatgcctgaagcatgggctaagacactatatttaccagtaacatgtatccagtgcccaccaagtgcccatccctgaaatttatcgataaccctcacatcaatccttttggagtctttgtggtcatttgtggacttgtgaagagcagcaaaatatttaagtcacccaacacttattttcccagctgaggttgaacaaagtgacactctgccttctcgtttgagctctaggtgtacaaacaagtgagctttttgctgtctgtttagtggcacgttgttttgccttctttgcttttttgttggtgatttcactgtttaaaatagcccaagggaatagcaccgaggtgctgtctagtgttcataagcataagaaaatcgtgccttacagaaaaaatacgtgtcagatgagcttctttcagaccacgaattcaatgtcaatgagtcagcattatgtattaaataccatgtcttcaaacagaaacaagtaaagcaaggttatgtattgattggttgatgaaaatggtgtgaccagagactcgcagaaacctaaccctgtatttcccctacggtttagcagtcactaattcagtgcttggggcaactttgcagagaacataactacagccagtaatgtaaattgactgtagacacccggcagtatggtgctgaggctgaaagcaattgagaacacaaattgtcttaaatgacttgacttaaatgagaacacaaaactttaatacttttagaaaaaaaaatgtaggagaatatctttatgacttcaggataaagacgagtttcttaagtaagaaattaagaatgttagccttaaagaaaagactgatgcattcataggactgtcgtttatcaaagaataccagagagtgaaaaagacagagatatagtaggaaaagatatttgtaaaaatgtaacaaatagaggttcccaagtgaatgaagaactccaatgagtcagtaagaaaaataaaaatcctttatataactgggtaaatgatatgaactggcattttcagaatgattaaatgtgaatggcccataaatatatgaaaaaccaactttattaatcatcaaagagatacaaattagaaatcatgaattatcatttcagacaccagattgacataaactaaaatagtaagtattgttgaggaacaacaggaattctcatttagggagaaaagattgaaaattgtcccagccattttagaaaacagattgtgtaaatatcttgtgaacttataaatctaaacttgtattttccactcttaaatatacaggctgtagaccaaagaaactcttgaaaatatgtgtaagacacaggctttttatatcagtttagtttataatagcaagtaagtgggaaaagaactattgatggacagtggaaagaatatattaactatattaactgtggtaaattctttttttttttttttgtttgagacagagcctcgctctgtcgcccaggctggagtgcagtggcgtgatcttggctcactgcaacatccgcctcctgggttcaagcaattctcctgcctcagcctctagagaagctgggattactggtgcctgccaccacgcctggctaattttttgtatttttcagtagagacgagtttcaccatgttggccaggttggtctcgaactcctgacctcaggtgatccacctgccttggcctcccaaagtactgggattacaggtgagagccaccaagcccggcagtaattcttatgaagaaccgttaccacacaattaaaatgaatgaaccacagctacacccattgagactgagtctcaaaggaatcatgttgagtaaaaatagcaagtgttagaggaatgcatagtacaattccatttttatgaagtagaaattaatttcaaggctgaacaatacattatttagggatatatatatatatatgtctgcacacacacacacacacacacacacacacacacgtatgataaaaaccataaagaaaaaacacatgacaaacaaaataatcagcagtgggggtatagtcagggaggaatacacagaagcttcaacattactggcaatgcttcatttgttacagtgggtgttaggatcacaggtgtgcactttagtattcttgtaactctgcataaacattatttgttttctttgtttgcctaatatgtcacacaataaaaaatttaaaatgaggaaaaaccatcaggttatctggagcaagacagcctgggttagtattctggcattatcgtttactaacaatgtgtacttgagcaaattattttgctgttcagcaatcagtttccttatctataaaaaggaatataaaattacccactttagggattgttcagaggattcgattttatgtattgttaatatgtgaaaaacacttaggataatgcctagcacataggaagaactcaataaatcttagctctaaatactactattcaacctacaagtggctgaattagctaacatacaactaagcaaggaaggtgtgagcattgctcttctatcacttgaggaccaggatacctcatctgagatctggaatatcttcactagctcacccaaccacacccacatattttgagcactttttttttgagacaaggtctctctgtgttacccaggctggttgcaaactcctgggctcaagcaatcttcctgcctcagcctccaaagtagctggaattataggcacacaacaccatgcccggctattttagggacactgaaaagtgtctttatcggccaggcgtggtggctcacgcctgtaatcccaacactttgggaggctgaggcgggcggatcacctgaggtcaggagttcaagaccagcctggccaacaaggtgaaatcccatctctactaaaaatacaaaaaaatttgccgggcatggtggcaggagcttgtaatcccagctacttgggaggctgaggcacgagaatcgcttgaacctgggaggcggaggttgcagtgagccgagaccgcaccatcgcactccagcctgtgcaacaagaacaaaactctgtcttaaaaaaaaaaagtatcagttgctgcactgtgtagcatcctgatcactgttgcttcatctacaatcttttaagaagcctgtggcaattcaagtgccacatgagctttgtagctgtaaagtttcttgtgatagaagagcaattggagttgtgctagaattcagttgctgaaaactgcactaggaaagttgcaaggcaaagacaaacccaaagaaatcagaatagaaaatgatctcaggagcaatgttgtgacgatggaaagatgacaggccagtgctctgacatggaaaatgagaatgtagctggatattagcttggctcatatttttgaaacccagagcatgagtagtctcaatattgatagcctgggtttgagtaactctcttaaactcacttgatgccaaagctctcatgagaatccagttgtgccttgtggtgaggtgaggctgtaccttggcactgtctgtgcacactgacctgcattgaaaacaatgggggcagtgagcagggccgaggtggagattgagaggaaccaggtcgtggatgccaaagggggagaaattggccaggtttttatcccggaagctaaactgaaaactcaagtcccttgatcctcattgttctgggtccacagtctgtgcagatggaatgttgattgggtgatcaccgccagcaaaaagtacagactgttttttctactctcataacactttttgttttgttttgtttttgtttttgtttttctgagacagagtctcgctctgtcgcccaggctggagtgcagtggtgagatgtcggctcactgcaagctccatctcccgggttcacgccattctcctgcctcagcctcccgagtagctgggactacaggtgcccaccagcaggcctggctaattttttgtattttcagagagacgggggtctcaccttgttagccaggatggtgtcgatctcctgacctcgggatccgcctgcctcggcctcccaaagtgctgggattacaggcgtgagccaccgcgcccagcctctcatagcactttcttatactctacagcatttactctaaacacttttacagcaatgctctacatactttctttacaccttacagtagagccactgatgtgcgtatcatatctggattgtaaacgtcttgagatcagggaccatgttggattcatcttcacattcctcacaacatcttccacacatggcaccacaagtaatattgacgaagggagggctgtcaggccgcacaaaggatggtaaggtcttcctaactgaaatcctctggcttcctaggatttcagaggcagaaaacagtaactatccatcgctgacacagatgatcaccatgctagtttgttcattgtcttctcttatcaaatcagtgtggatttcatatgtctcctcagttgtttctcccacttcttcagcagcttagaagttttgttttgctggggagctgtttttaacttttagatataaggtgaaaatgcttatttattagtttcctcaggtgttacatgaactaagatgacttccacatcagttataaataagaaagtaccaaactaaatcaggactgctgtgtcacttggcactacttcacgtccttcttggcagcctcgatgggggacgagagctgagttggcaaaggggggagtgatttatcctcccacacttagaagtaggatggaaagcagaaaggttctacttttatattacttcttcttttcaaattttcatattaacatcccctatccggtttctctagcttatttttctgtagtgggcatcaacgacactatgtgtgatttgtttattttatttgtcatctcttacccacattaagctctttgagaagagagatttttgctttgttttgttttgtcagtgatatatccccagtgtctaaaacagtggctggcatcatgataggtgccgatagtaggcatactgtaggtactgaatgaatcttcgttggttcttaactaccacaaagtgcacttaagagcaaggggcatgagcaatggcatttctaagaactgacaggtttaacacacggcagccttatctctgattcttctttgtgaaaatgagaacagggaaacagcacccattgcaaaatctaaatcgatgatgaatgaacacgtagcttgcgtgtatatttgacgatggttttattttcaaaactgtaattaaatgagataaaaatatatggttgaagttgccgaagcaacttaaattcaacataaataacagctgctcctcatctgggaatttcatttatatacagaacttttttttttttgcccttaaaaatttttaactggtatacagctaattcagcatccagtatcccaagatacactttatactcaaagaagatggaaaagagaagagaaacagccctcgttgagccagtgatgaaacaaagctgttactccccatacctttgatttccctaaaatagctatgatgcaaagcatgtccagtttcttaggagcaatgagtctaagcatgactggcattttttaatgagtccagcaatccctactttaatagttcaaaatcctgaaactgagtacagagtgaagagtcttctattagctttgaaagcaaaatttttctgcagagcatggatgccaggaagtactgataacatctgcctctccttgtaaagtaaggatcagtgcagtttcctcccaagcttcttggaggaaaaaaatacctactctttggatagaattaagagaaggtataattacttgaacatcgatctagtttcatttgcgagtaggaagtgagaaactgcgcctctttcctgagacatcgtatccactaccactaagtgctaggcaaatttggtagtgagttcactgcctcggtttatattcctgaaaggctaataaaagaaaagaaattgaatgaaaaagtttgagatgaagagatttctttcactttgaagcagggtttttcatgaccaattgtatggctcgtagatttgtagtctctggggtttgatcatgaactgtggtccttatgtctccatttagtaatatgtttccaaggcttttctgtagattactgactttatcatggcctcttgatgcataacttttcagcattttcttcagagaatattcattctggtgttacttgaatgtatctgatttgccttctaaggtgcctatttattaagaagattggtacaatgaattacaacctgctaattttaattttcattggggagaaaaaaaggctataaagtaaaattcaaaatgaagaatcatatttctttctgtcaaagctataatgagcataagtctatcagttataaaattatcacactagatgaagaaaagataattgtatgatatatcactgactggctgataacagccctaatcacaaataataggcccatgcaatttgcaaggagttgtttcatgttttcatcatctctggcattccctggggcaggggtgagtgggcgagtgggtgggagagtatttattttgcaaagcaataactccagttcatatgttgattacattccaattttaatttatctcttagctttccacttaaggatggggatgcgggaaagtaggtggctccatgcccttgattggacaccttttcttgaagttattctccaaagcttccctggctattgagcatacaaaggtcctttgtagccaagatgctggaaagcagtgtgtcatgaggacaaatacaagaaagttcaccctagtccaacaggtctcaccaaccaccacagcctgtgaaacaggaagaacagcagtgctcaacaagtactaattaagtatctactatgtatcagacactgttttgggcattggctatagcctcataaaaactggcaagattcctgccccacagtgagcttttatttggggaggcaatggagacagtaaaaaagaaagtacacaaatgagaaccgtagttgcagatggcggcggtggtgatttctgggaaggatgtagtaaagaggggatgtgacagagagtaactggagtcaggtcacggttgactttacttaagccctcaggtaatgctgctctgaagaagggtcatttgagttggttcctaaaggctaaacatgataagccaaagaatggggaaagagcactccaaacaaggggaacagcaaggacatgggtcctgagactgggttagctgcaaggtgtttgaagaacagaaagcaaaatgtggccattacggtataactaagtaaggagggaagtggcagggagcaaagctggggacgtaggcaggggctggatcctgaagggcctttgcagagcacagtgaagggtccatattttattctgaaattgaccaggccaaatgccttctgaaacctttgtttctctttgtgttgtgtaagtatgaaaccaaagataaagaatgcagctgcctaaccattaacactcctgagtcaggatgatatgagaaaagagatgagctcccgtagagaaaaatgctggtaataatagcttgcatgttagggcacccgtctccgaaggagaacaacattattaacggtgccatatctcactaattgtagtaacctcatgagttagataggtgtacttttttgtggaacacacagggaaactcagacattttaaattaagttgttctttggcctcttaaatagcacaaaggtctagataaaatagagtatgtcaaagaaatgaggaaaaggaaagaactaaaatgagaaataaaaatagccatcaggaacgctgtaagctcccagagaaaagggcagccaagcaacgtttattttctgtaaagtcaagaaaataatagttgaggggtgaaaaactgtgagagtctcagacagtcaaacagaccatcaaaaagtatggtttcatccctgttatttaatttgatatagaatagaagttatatatagggacttctgggtcgggaaaatccggattctaatctaagctcttggatgtttatttttctttctattaaatgagaatagtaatagaacccacctcaaagagtcgtggtgaagaccgaatgaataaatacatagaaattgagaaattgtgtcatttagctaagctggatggaactggccttagcattcttccaaatagataatatttataaagtggttaaattgccaaagttaagaagccttcttaacatgtaatattgattatgctatttttaattcttgcctaggttttgttcctggaaacaaagagtgatatgtgatctagtaatgtggtgcaagaagagaaagaggagaataacctccaattttgctaaatagaggattgctgaccctaggcaaatttgtctttggcagtctccacacaccactttcctcatccagttttttaagtcattatccttcttgaactttctcagcgctattttgccttctccactatttcatagattaaattttcctttgattcttctttggttattcaaaactcacatttgaagactccatactgctcttacttacttgttaagtgaaagcaacctgattgaattaattcactcttcactgaaagtgattaatagcaaggtcatacttttgaagaaggtatttatggtttaaaatgatatttttgtaattccaaagtaatatctaaattgtaaggttttatttggtatgaccgaagagggtgacaaaaaactcaggcagttggagagagaacactgtgagggctggaatcagcacctgggacagctctgaataagctttcccttttactctgaaataagtgtattaaggatttccatagtgatgttcatggctgcagaattagaggctctgaaaaaaaaaagaaaaaaaaaaagatcagaagtcatttctgtgaatgagtcatttgtatctcaagggtacattgacttaggaatattagacctagcataagattttggtcccggccaggtgcggtggctcacacctgtaatcccagcactttgggaggccgaggcaggcgtatcacttgaagtcaggagttcgagaccagcctggccaatgtgggaaacctgtctctactaaaaatacaaaaattagctgggcatggtggcaggtgcctgtaatctcagctactctggaggctgaggcaggagaatcacttaaacccaagaggcagaggttgcagtgagctgagatcacaccactgcactccagcctgggcgatagagcaagactcagtgtcaaaaaaaaaaaaaaagttttggtcctttactttatttttattttattatttatttatttatttatttatttgaggcagagtctcgctctgtcgcccaggctagagtgcagtggcctgatctcagctcactgcaagctccacctcctgggttcacgccattctcctgcctcagcgtcccgagtagctgggactacatatgtgcccgacctcctagtcccttactttcgactgccaacaaactggggtaattaatgtcaggtttttgtttttgtttttagacggagtcttgctctgtcacccaggctgtagtgcagtggcgcgatctcggctcactgcaacctccgcctcccaggttcaagcaattctcctgcctctcagcctccagagcagctgggactacagcacatgtcaccatacccagctaatttttgtatttttagtagagacagggtttccccgtgttggccaggctggtctcgaactcctgacctcaagcaatctgcctgccttggcctcccaaagtgcggcgattacaggcatgagccactgtgcccagccaaaaatcacatatatttacatcctttaaaaaaggtaaggccgttatcctcagcaaattgacagaaaacgaaataccacatgtcctcacttacaagtcggagctaagatgagaacacgtggacacataaaggggaacaccacacactggggcctgttagagagtggagggcgggaggagggagaggatcaggaaaaatagctaatgggtactaggcttaatacctgggtgatgaaataatctgtacaacaaacccccatgacacaagtttacctgtaacaaacctgcacatgtacccctaaacttaaaagttttaaaaaggtagacaaatatcaattttactgttgtatagaaacaatatttttaagtaacacaagcattctcagaccagaagattataggaagaatttctcatgaagaattatctgaatccagggtatagtgcgtatatcttaaatataagtgttataaagaatacagttcatgcaatataaaggataagatatctgattcacttcagcatcaatcttgacttgaaagcataattaggactagcagaagaggatatattttaagtcttatcaggtttgttttttttgttttgttttgtttttttgtttttttgccacagtagtgttgacttggccactctaatgttactttatccggtggaagttctcccagtgagtcactttctgtaaactttcctttggatgctcaaaagtcatactgatagtgctaacatttatagactactgactttggaccaggcagcatcttaagtgctttacatgcatgatcttaatcttcagaaagtcctatgagacaggaattattgtcctgacattagaagtgagaattgaagttcaaggagattaactaactcacctacatcatacaggtagaaagtaagagtgctaagtttgtactcaggtccttctgactccaaaaccagggtgttaaaccatcaggcagttcttcctcttgctatatactctcttacagggaagtccagtcttccttcttcctaaatggaaagaatgtcaaaaatacgactttgaaactcaggttttgtaaatttcgatttattttcactacaagtctcttcaatccaggaaaccataaagtgtgcatccacacacacacacagggagcaaatggcagagagtcaagacataactttaaatttgctgcatgatagtgagtttttaaagttactctccaaaaatacttctttttataaatggtgcagtcatcattatggagatcatattcataacaaatgtatcacttgaccatttttccaagttgatgttcatctccttactgattgcgtcttttaaaaggaagcaataacaaagggaactggtgctgacaatttcttgttctaaggccaacctgggagaattaatagaatccaggtctacccaagtcaggaaaaaagtgaattggtatttttttacttgcattaaataatacatgtattacatgcatggttactgtatcatttttcctttttttcttttctcccttctctctgtggattcttaacaaactatgatgtgtgatattatctcattaacctttcctggccattttaaaactaaactttttataccttcctctgagtcatcccaccctgtgaatagcttcagctcttcctgtccatatgtgtaatggctagtccattaattatgacctaaataaattactctttcttatttactgttattacttctcaaaagagatcttggaccctcttgattttatatcctctagactataatcaggtatttatggtaagatacttcttccccagctctaaatatttaaaaatttcccagacaaaaaatacgtggacattttccccttgctctctaatttactccatggcctgaattccaaatgttttcctatattaagactttttattattgatagcatattgcagctttaaggcttttgtacacgtccactcctccaggaatgtaactgctaaatcacttcctctctggtctcaatgaggtaacacattccaaatactatagcatgttttctaatctcattttaaaatgaaattcaggtattacattccataggagaataaaggacagctgttttcacaaatatgatatgaaaacacatctgccacacaattgtacaatccttagcacatggctgttggaaaaagttatgtaaaatgctgacaaatgaaatcaacaccaaaaagtagaggtatttattttttaaaaatctacacatcacatgtcaatgaaccacatataaagcttgaaagacaggctattttgagaaacaatggtgcacggatgttaattccttgttttacatacacattatttattcaatactatctttggtgaccaattgctaaacggaatacaagccaagtgtaattgtttagctaccttcctaacaaggcagcaatcctgcttcttaatagagttgtttctgtttattttctccttgttcaacttcacactttgcacctaacatttacaatctccatgttgagtgcccaaccacaaagaaaagcagaggaatagaagatttgaaaccaaagtacttataccaacccatcacactatgtgttgaaatgtggatttctttccatattcactgagtgtaaatgttatttaaatgaacgtttttgtgtcctggcatggcaagtaactgatttgaaagctctttttcactgactttacgaaatcagtgaagatgccacagattatggtgcttcagagcagtaactttggagagagacaaaacatgagtttgtatcttctggccacttcctaggcacgtgaagaaggtgctgcacctccgtgagcttcagctgtgtcacctataaattgggagtttaaagtgtaatggaattcaatgagatcaaataagaaaagtacttggccacatggtatgactgcaatatagtctgcaagtcaattctattgttgctattagtgtgatggccacagtgacagagcattatccataatgtatattccgtctcataatgcctgctgctactgatcattacccaagtaccaaggctttggagataaaatgactctggatcctcatctctcaccttatacaaaaagcaactgaaaatggattaaggacttaaacctaagacctgaaactataaacattctagtagatgacattggaaaacccttctggacattggcttaggcaaggatttcatgaccaagagaacccaaaagcaaatgcaataaaagcaaagataaatagctgggacctaattaaactaaagagcttttgcatggcaaaaggaacagtcagcagagtgaacggacaacccacagagtggaagaaactcttcgtcatctatacatctgacaaaggactaatatccagactctacaacgaactcaaacaaatcaataagaaaaaaatcaaacagtcccatcaaaaaagtggactaaggacatgaatagacagttctcaaaagaggatatgcaaatagccaaaaaacataggaaaaatgctcaacatcactaatgatcagggaaatgcatatcaaaaccacaatgtgataccgccttacacctgcaagaatggccataatcaaaaaacagtagatgttggtgtagatgcagtaaacagggaacacttctacaccactggtgggaatgcaaactagtacagccactatggaaaacagtgtggatattccttaaagaactaaaagtagaactaccatttgatccagcaatctcactactgagtatctacccagaggaaaagaagtcattgtttaaaaaagatacttgcacatgcatgtttatagtggcacaattcacaatagcaaaatcgtggaaccaacacaagtgcccatcaatcaataagtggctaaagaaactatggcatatatatatatatatatgatggaatactatgtagccataaaaaggatgaataaacagcatttgcagtgacgtggatgagattggagactattattctaagtgaagtaactcaggaatggaaaaccaaatatcgtatgttctcactgatatgtgggagctaagctatgaggacgcaaaggcataaaaatgatacaatgaggccggatacagtggctcacacctgtaatcccggcactttgggaggccaaggcaggcagatcatgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccaggaggcagagcttgcaatgagccgagatcgtggcactgcactccagcctgggcgacagagcgagactccatctcaaaaaaaataaaaaaaataaataaataaaataaataaaaaaagaatgatacgatggactttggggacttagggggaagagtgggaagtggggcaagggataaaagactacaaatatagtgcagtgtatactgcttgggtgatgggtgcaccaaaatctcacaaatgaccactaaagaacttactcatggctggacacggtgactcatgcctgtaattccagcacttttggaggctgaggcgggtggatcatgaagtcaagagatcgagactatcctggccaacatggtgaaaccccgtctctactaaaaatacaaaaattagctgggcgtggtggtgcatgcctgtagtcccagctactcaggaggctgaggcaggagaatcacttgaacctgggaggtggagcttgcagtgagccgtgatcacaccactgcactccagtctggcaacagagtgagactctgtctccaaaaaaaaaaaaaaaaaaaaaagaacttacccatgtaaccaaataccacctgtatcccaataactgaaggaaaaaaatttaataaataaataaaaatatatgtggaaacattgctggtaaaggcttaatcatgagtgtacaaactttgacataatacccatttacacacatagctcttgacttagaaaagtatcatgttgttaactgttaggatctggatagatattcatacctgaaaagaacaatttgaggcatgtaatctttccctaaacatgtgcataagtatcatgtcctttgattcacatctacagcttgctctagtgtgcgtttgctattagaaacctttccttagttgcaatgtttgggatatgctttggcactaaatcacagcattcgcaatggacagaagaaacataatgactacatacttgaaacaaagaacattcattctcgttacatttatgagaaaattaagacctgcccatggtatgtagacctgcccatggtcaacacagctaataagtggcagagatggttttcaaactcagatctacccaaatacagtctttccatttgctgtataggtagggtttatcatctggaatctatttcaattaatgactaataaacgtttctgattattttctcaaataccagattaatgagatacacttcaaatgcctaaaacttgtagaagtgaatgaattcataaactaagaaggaaaaaacatgaatacagttttttaaagctcaggaaggatagttaaaaatcattgcccatatttctcattttctttctcatttcttaatactatttctctaatcagaaaccatgattggttttacctagatgatacgtgatctctactacctatcagctcttaatttttcatgcaactctggaaattgaat
